United States Patent 7,892,730 (COMPOSITIONS AND METHODS FOR CANCER) - sequence listing, part 9

SEQ ID NO: 826 - DNA, 194883 bp, Homo sapiens
cctcatctctactaaaaatacaaaaattagccacttgtggtggcacattcctatagtcccagctacttgggaggctgaggcaggagaatcacttgaatccaggaggccgaggttgtggtgagtcgagatcacaccattgcactccagcctgggcaacaagagcaaaactctatctccaaaaaaaaaaatgttatttttaaaagatgaatggtttctcgtgcatcttttcagattgagacgttctccattcacacaaacgcatctacgtgcacgtggtcccttactttctttacttagcagcagcctaccatacacattgcattatacttggggttttttttgttttgtttttttgtttttgagacggagttttgctcttgttgcccaggctggaatgcaatggtgcgatcttggctcaccgcaacctccgcctcggggattcaagcaattctcctgcctccgcctcccgagtaactgagattacagacgtgcacaaccatgcctggctaatttttagtagagatggggtttctccatgttggtcaggctggtctcaagctcccgccctcagatgatctgcctgcctcagcctcccaaagtgctgggtatgagccaccgagcccagccccctacacttgggttaaaaacccaagtgatatggtttggtggtgtccccaccccaatctcaacttgaattgtatctcccagaattcccacgtgttgtgggagggacccagggggagataatcgaatcatgggggaaattctttcctgtgatattctcgtgatagtgaataagtctcacaacatttgatgggtttatcaggggtttccacttttgcttcttcctcatttttctcttgctgccaccatgtaagaagtgactttgccctcctgccatgattctgaggcctccccagccatgtggaactgtaagtccaattaaacctctttttattcccagttttggttatgtctttattagcagtgtgaaaatgaactaatatagcaagttaaaaacacaccacatatacacgctgcattatactacacagttaccagttaccatacacaccacattacaccacctggccaggcatgatggtgtatacttgtggtctcagctacttgggacactgaggtgaattgcttaagcccaggagttttagaccagcctgggcaaaatagcagaccccatctgtaataataataataataataatactaaataaataaaaataaaaatgtaggctgggtgtggtggttcatacctataatccgagcactttcggaggctgaggcgggagaatcacttgagcccagaggttcaagaccaacctgggcaacataatgagacctatctgtattaaagtaaaattaatttaaaaaaattaaaatgtggccaggcacagtggctcacgcctgtaatctcagcactttgggaggctgaggcggcagatcacctgaggtcagggattcgagatcagcctgatcaacattgagaaaccctgtctctactaaaaatacaacaattagccaggcgtggtggtgagcacctgtaatcccagctacttgggggagctgaggaaggcgaatcacttgaatctgggaggtggaggttgcagtgagccaagatcgcgccactgcactccagcctgggcagcagagtgcaactcagtttcaaaaaaataaaaaataaataaaataaaatagtctgggcacggtggctcatgcctgtaatcccagcactttgggaggttgaggaagatggatcacctgaggtcaggagttcgagaccagcctggacaaccccatctctactaaaatatgaaaattagctgggcatggtggcatgcacctgtaatctcagctactccagagtctgaggcaggagaatcgcttgagcctgggaggtggaatttgcagtgagctgagattgtgccacagcacaccagcatgggtgacagagcgagactccgtctccaaaataaataaacaaataaataaataaataataaaaataaaataaaaatgtatattaaaaaagacgcagggccagccatggtggcttttatctgtaatcccagcactttgggcgtctgagacaggaggatcacttgaagccgcaagtttgagaccaaactgggcaacaaaataaggccttgtcagctgggcatggtggctcacgcctgtaatcccagcactttaagaggctgaagtgggtggatctcttgaggtcaggagttcaagaccagcctgtcccacatggtgaaaccctgtctctactaaacacacaaaattagccgggcatggtggctcacgcctataatcctagcactttaagaggctgaagtgggtggatctcttgaggtcaggagttcaagaccagcctggcccacatggtgaaaccctgtctctactaaacacacaaaattagctgggcatggtggcgcacgcctgtaattccagttactcaggaggctgaggtagccctccctctctttcgttcttgacagggcttcactctgttgcctagcctggtcttgaactcctggcctcaagctatccttccgcctcagactctcaaattgttgggattacaggtgtgaaccactgcacccagccttttctttttaaacattttattaaaatttgtttttcatttaaactttttaacagtcttatgaactaggtctgatgatcactgctatttaataaatgataagactaaggtttggacacatttactagcttgccacagtcacacagttaataaatcacagataatacacggtcatggccagctgcagtggctcatgcctataatcccagcactttgggaggccgaggcctcctgacctcaggtgatctgccctcctctgccttccaaagttctgggattacaagtgagccaccgtgcccagccaagtttttgtattattagtagagacaggtttcaccatgttggcccggctggtctcgaactcctgacctcaattgatctgcccacgttggcctcccaaagtgctgggattacaggtatgaaccaccacacccagccactgtgtcttgcactagcaaatttaacttctgtgtcaatcattgtccctctcccctgagaggtctgagaccacctagaggaacttacctagcctgcattcagttgatatttcctgagcacccttgcatgcagagggctcttagaggcagcttgacttcatttagaatccagagagaacccagattcttagcatcatctagtttatttttatttttatttttatttttttttaagacagggccttgctctgtaacccaggcttggagtgcagtattgcgatcacggctcaccgcagcctcaacctcctgggctcaagtgatcctctcacctcagcctactgagttgcaggggctacaggcatgtgctaccacacctggctaattaaaaaaaaaattggcggggcgcagtggctcatgcctgtaatcccagcactttgggaggccaaggcgggcagatcacctgaggtcaggagtttgagaccagcctggccaacacggtgaaaccctgtctctactaaaaatacaaaaaattagccgggtgtggtggcgggtgcctgtaatcccagctacttgggaggctgaggcaggagaatcacttgaacccgagaggcggaggtcgcagtgagccgagatcatgccattgcactccagcctgggtgacaagaccaagactccatctcaaaaaaaaaaaaaaatttttttttttggccaggtgcagtggctcatgcctgtaatcccccagaactttgggaggcagaggtaggtggatcacttgaggccaggagttccagaccagcctagccaacatggcgaaaactcatctctactaaaaatacaaaaattacccaggtgtggtagcgcacacctatagtcccatgcaacttggaaggctgaggcaggagaattgcttgaacccgggaggcagaggttgcagtgagccaagtttgcaccactgcactccagcctgggtgacagaatgagacttcatcttaaataaataaataaataaattttaatagaaatgggtcttcctgtattgccagtgctggtcttgagttcctgagctcaagtgatcctcccacctcagcctctcaaagtgctgggattacaggtgtgagcctacttgtatgctatgggatacagggctgagcagaaaataacccagcccctgccctcaaggggcttacagtctagtggtagggacaaatattaatcaagcactcaagcagtgtgaaaagccaaatgtaattatcaccacccctggagttacagagagctagatggctgaaacagcagggaagggacccctgagctgagaactggtgaatgggctaacaagcaaagagagggaagaacattccagaaaaaggaatcgcatgtctaaaggccctagggagcacagggactaaaagaggccagcatgacaggcagagagggatgggaatagagagggagatgaagctaggaggccttgtgcttgtcaaggagttttggctttattccaagtacagtgggaagccgttgaagctgggagcgtagagggagagggtaactatagcctgatcagatccgatttagatagttctggctcagaacagtcaagtggggaagagttgatgggtttcctggaaatgaaagaaactgacaagtagtgaatcagataaatacttggctcaaggtcatgtccattcctggaatcaacccatattcaaacactctttgattgggcaggggtggggtaggcaaaaaggcccactcccttagtcaaggcaggatgtctctgaacggtggtcctagtccttgagctccctgtgggatgaccaagaccttaaaacaaagataaacatgtagaatgatcggcccaggatttcagagaagagtgaggaggaccctgcttccacctgagcagcgggatgatcctgttccacccaaggcaggggtcccagtcctagaacccgccccttccttcctcctcctgatccccagaagaacggtgagctctgtgtgtgtgtgtgtgtgtacacctttggctctaggatcctggttcttactttctcacctacttgttctgtgactttgaataaatccccttctctctctgggcccgtctctttattggaaaaagaggaagttgaagtaatcagtgactcaacttttggggtggttcacagaccctttgagagtttgttgaaagctatgaccattatacacataatttctggcagttgcaggggttcctgtagccctggggtggggctgggtagcaggctttacctgggactcaagtgaaaaatccttggatgagacatcaacaggcaccttttctgatggcctgctaagaaccaagtctcatactctgttctagtcctcatctcaatcctttaactttttttttttttttttttttttcagatgaagtctcactcttgtccgccaggctggagtgtaatggcatgacctcgactcactgcaacctccgcctcctgggttcaagcaagtctcctgcctcagcctccctagtagctgggagtacaggtgcctgccaccacgcccggctaatttttgtagttttagtagagacggggtttcaccatgttggccaggctggtctcgaactcctgatctcaggtgatccgcctgccttggcctcccaaagtgctgggattataggtgtcagccactgcgcccggccatcacagtcctttaatcattacttttcccacttggagctcggagatagcacttaagtgacttgcccaagctgagaagagctgaagcaggacccccaagccaggtctttgtgaagctaaagactgttctccctgttccaaagggagacatcactactcttaccctttccccattccgccactgcccccataataccacacattttagacctcatagccccctcttttttgtatttttttaaccccaaagaaggcaaacgagggttgcaggtttatttatttatttatttgagatgtggtctcatagtattgcccaggatggcctgaaactcctgggctcaagaaatcctcctgctgcagcctcctgagtagctgggactacaggtgtgccgccattcccagccttttaaatttttatttattagacatgaggtctcgctatgttgcccaggctggagtgtggaggctattcataggtatgataatcgtgcactacagcctcgaactcctgggctcaagcgatcgtcccatctcagcctcccaagtagttggtactacaggtgtgcaccaccccacctggctgtattttcaactcctgtcatggagcaaggtttaccttatgaagtaagatagaggatctgaggcctcgataggctaagtggcctacaaggtcacatagcaagtgagtggtcgagttgagagctagagacagaggacatttgtgttcaccttggaagtcccagtgaggacgagccttacctagctccaactcagaaggccagaaggaagaatggtttgggggaggctgtaatcaggggaaggatgcagggccctggggtgagccctaaataaggggcttcctgtgagcctgaggatggccatgcccttgtatatactttgtcctccaggcaagttctctgctggccctttaaatcttctcaacagctctgggtggggcatctatccccactttacagatgaagataccaaaagaacttcatccaggccaggcatggtggctcatgcctgtaatcccagcactttgggaggtcgaggcaggcagatcacttgaggtcaggagtttgagaccagcctggttaacacggtgaaaccccatctctactaaaaatacaaaaaattagccgggcgtggtggcgggcgcctgtagtcccagctactcaggaggctgaggcaggagaatggcatgaacccgggaggtggagcttgcagtgagccgagattgcgccactgcactccagtctgggcaacaaagcaagactccgtctcaaaaaaaaaaaaaaatacaaaaattagctgggcgtggtgacacgtgccaatagtcccagctaccgggaggtcaaggcaggagaatcgcttgaacccgggaggtgcactggactccagcctggatgacacaacaagactccatttcaaaaaataaaataaaataaaataataaaataagataaaataaaataatattaagaaaaaaaaagaacttcatccagctcctgttcagaagtgaccacacacacactgtcttcagcatccctcccaagttcccctggtccatttctcaggcctcatcttcctgcccatctccatcttaccgtgcccttatttacggtgttcttcccttttcaccctctgaaacttcgcacctgttttcgcctttgcctggaatgttgcctccttcccccactgaactccttcctactcatccttcaagatcctatgccacagtctccccagtcatgcagcaaaatgggacagattgccatcttccttcccatttccctctcagctctcaccccacgtttccttttttctttcttttttttgtttttgagatggagttttgcccttgccgcccaggctggagtgcaatggcgcgacctcggctgaccgcaacctccgcctctctggttcaagcgattctcctgcctcagcctcccaagtagctgggattacaggcatgcgccaccatgcccacctaattttgtatttttagtagagatggggtttctccatgttggtcaggctggcctcgaactcctgatctcaggtgatccgcctgcttcggcctcccagcgcccagcctcatcccgtgtttctaatcaatggcttgtgtccattttcctctgccacacactgggctctcgtgtgtttgccaaaggagtgagggaattccaggaaccctcctgaaccacccagcctcaactggtctttcagttcctaagaacagcaggacatttaaagtcgatgcctgtaatccctactgctgacttcaagtatcaagtttatagttgctgcccccatccccttcgtttttactcccttagccgccttctttttttttttttttttttgagacggagtctcactctgttgcccaggctagagtgcagtggcacgatctcagctcactgccagctctgcctcccaggttcacgccattctcctgccttagcctcccaagtagctgggactacaggcgcccgccaccacgcccggctaattttttgtatttttagtagagacagggtttcaccgtgttagccaggatgatctcaatctcctgacctcatgatgtgcccacctcggcctcccaaagtgctgggattacaggcatgagccaccatgcgcagcctcccttagccttcttttatccatcttgtgcctcggccctaggggtccttgctatgatcttccctttatccagctttccatgtcccccccaggagccaggcattctaagccacagagctgaccctggaacctgtcaccacttaccttctaggctcccatggcctatgaaactcgcagtacccttgcctaaggcatgcagtgcccgtccctagctggccccctggaggagtcctgtttcccacccatcgtcttttccactctccatccatccgttttctctaccttgttaaagaaaaaaactaatcagattctcgttaaagatggcagggaagccaggcggggtggctcaggtctacaatcccagcactttgggaggcccaggtgggaggacagcttgaggccaggagttcgagacctgcctgggcaacacagtgtagtcccagctgctcgggaggctgaggtgggaggatcagtttagcaggggtgttcgaggctgcagtgagctatgactgcaccattgcactccagcctgggcagcatagagagatccttgtcttttttttttgagacggagtttcttaatgtaggccggccagggtgatcacataccaagcgtggagatattcttgacagcaggattctggctaaaactggactaagaaggccaaggacagagcccaaggtcggggcctggtcagaaagaggtctcggaggagcctgactcaagtgtgatcaagggaagtcttggtcacccgctggcaacttggctttttcttgtctcccagcctcaattcaagctcatcccccttccctgctccatcaaaatctccttgatttccaaggccagcttcagtgtctcctctcaaacttttctgagccttccctccacgggaatccatttttcctgcctgggcctggggagagaagtccatttctccttcccaaacccagagaccattgaggcaggaaagctccctggctgccccatagggcagggcagggtaggcggggtttagtgactccccggcgccgacgctgacccgcacccctgaggaaggggtctccggggacggccgctgttgtcgctgtcgcctccagtccccgccccttcccccctcagtgaaggggacctagagtgagaactggtggtcacgtcctacgcctaggagggcccctgggtgttcacccacccccccgggggccccatcctgggccagggtccgcttcctcgagggaaggggcgaattcctggaaggtctccttccgggcgcagttgcaatggattgccttgggggtgctgaaccctgctgggggtacagagacgtttccgaaactcagcggctcggtcgcccccaaaggccaggcggaacacacgcccacaccgcggctcccttcccgaagtaagaccgccgggccacggccgcccccaggaagccccgcgccccgcaccccacacccggggacacaaacaggcgccgggtagccgcgagggccggcgcggcgcctttaagaggcggcgggcggcgctgccccctggcggccgccccgccgcttcctcgccgccgcgggctcaagcggggcggccgggccagcgcggggcggcggcgggcaggggcggcgagtgcgcgggcgctcgccgccgcccttctcggcgggcagcgcgcgaggaccaggccgaggaggaagtggcggcggcggcggcgggtgaggatctctggccgggccgagtggccgcgtgcgccccgccggggtccaagcgcgcccaggggttacggcccggctgggaacatcagagggcgaggacccgggcgggaggaggagggaggaagggctcggaggccgcgcttctgccgccgcctgagggcgtgtggctcgggcccgcgcggcgggagggcgggcagggcgggggcggtgtctgcggaggcccggcttcccctcctgcgggccctggccccagctccgactcagactcaggctcagccgtgccccagcctcagccggcaggccgggcggcgcggcgctcgcgagccggtgggcgggcgggcgagcccgcaggcggcgggggcgtgggcggtggcagcttggcccagccagtggccttccgcgctgagcgccgctccctcctcccggccgcccgccgcgccccgctcacgctcgctccgcgcggcaggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggtaaggagggacgcggcgccggcgcccggggacccccggcccgagcccggtgacccccggcccgagcccggtgcagcctcattagttgttttgggagatcggagccaaacgggaagaagcggcgcgcggggagactgagtccgagcagccaggtggcggtggcggccgccggccgcgttccagggaagcggtggccggtgcgggcgaggtggcacggaccggggcgttcaggtgcactgtgacccggctggggaggcccccagcagcccagggcgcggtgggagtgctactgagggttgcggagggacctgggaaatcggggcatccacgctgtggggtaagggcttgagggtacttttggaccggagtgtttttcttccttcgtccccttccctttcatgaagaaagggcacccacgtttgtggaccacctactatgtgccccgcgtgtgctcggctcttgaggctgtcattgcatatcatgaggttaagcccagttgaagcgagtagcaattcttggcatgtatgtggtgatttgctgtctcattagagcctcgcagcagccctgcaaattggccagggtggtgattctgggccacctgtctgagaacggggaccgatcggcagaggagcggggtacctagcttggggtcccgcagctagggagtggctggtgcgtagaaagtgctgggtaaatgcccgtggtgtggagtggccttctgccatctgggctgtgtgcccctgctcccaccatgctggtgctccttggcggagtctccggtgtttaacagatcacgttcttaataaattacagaactactgagtcttgggtcaggtaggccttcccttgctccacaactgtagctttgcctctgagaagcagttaagcccttttctcaatgcaagcctaagagaatctagctctgaaagccttttgcaaactccaggtggaaaccttttgtgatgcagcttgttagactgatttttgaaaatgggctctacttgcatttttgtccctgtgggggccccacacatcttggagaattgaacagttgggtttccgtaacccctggtgctcctgggggcccgtggctggtctgagctggcatgcgcaggtgagcctggcagcacctctgtgtgcctcatgcctttcccaagggcctgctgctcctttgccccgtgcaagccccgcaggcgctcttcctgcagccagaggggcacagcttgtacaggatagtgcctggttctttatcccttggtctggggatggggttggctgccttctcccaggccggtttccctagaagacaggctcttcatgatcaatagggcatgcagagtggccccagcaattcatgaagaaatcaggaggagctcgaagccagagctttgaaaatgagtcttaggacccttggaacattacaaaagggtacttgaacgttgtaccgcggatacactcacttgtgggaagggcattctaagacactaaagaaatttggagcagctgctttggcatgttctcgaagtccagttctgatgtgaggcaccggagctccccctgcagtcatgtaagacttgggaaatcccagcgaatacctcgcaccctttgtactgctgtctgtatttatgtcatcttgtgtctgcaactcaagcttgaggcttgtcattgggttggcttgttttgcttggtaattaggaggctctcgcaaaatattcttcgccgagactcacaactaggtcctcgtgctggacctgcagattggcttgaccttgtagacattcttcctttaaaggggtgggaggttcagagcaagctatgctatcaacgttctggggagtagagcattactttctctgaaagagttgttgtcttcaaagtctagttgccttcctttggccaaaatattggcttcaaagaaggcagaagtcatcagggccattctagaacccgagaaagcccactttgtgttttcactagggaagctttagatattttatcacttaagcctaagaaggaaaagaaaacaccaaagagtttttccgtttcttatttattactttcagggcagtgccccctggtggccacatttctatactggctgcaaaatgctgcaactgttgagccagtgaccagggagccccgtgaggttgttttgtttggtgtgagggccaatgagactttagtggctgagagacagtgcaaaggacattatcatgttttccacattcagaatctgggggcgcagggcttctgtactgacgacgggtgatgaattgtctatgaattccctaatgaaaaagtctaaaggtatttgaaaatggccctgctttgggccgggtgccgtgtcttctgtctgtaatcccagcactttgggagtccaaggtgggtgggtcacgaggtcaggagatcgagaccatcctggctaacatggtgaaaccccatctctactaaaaatacaaaaattagccgggcatgatggcaggcgcctgtagtcccagctactcaggaggctgaggcaggagaatcacttgaacccgggaggcagaggttgcagtaagtcgagatggtgccactgcactctagcttgggtgacagagcgagactccatctcaaaaaaaaaaaaaaaaaaaatggccctgctcttaatgtttgggcaaagaatgacccgaatggtccggcccggggtgggttgtttagctgaatgtccggccttgtaaaaatctgatctcagagcaggaagagatgttggccatcatctcatctagcccctttgtcttacagatggggaaacccatcaagagagggggcaggttccggactcttggtcttttcctttaacttctagaatgggtccaacctggctaccttgagattgcctttctgattgggcatctccgacaataaggcagtctccctcattatctttccaggggtctggtggctgctatttagcccccaggacacattccttgcaaagctgagcccctctgcaagtgtaatccttgtcttggggggagggtttggggggtagtgcacgttgatggcaacagtgggtggttagagccacttcatgggccatgaagtgccccacctgccgtaggtagggacaggcgccagccttttcagatgtgcactctgataggatggggctctgctagccagcagatgggcctttgaatccacttgtttgtcagtggtactgtttgttcctgttgccatcctgtttcttcccctttctctggggacacggctctggttgtgttctcttgtacccctcccacctgccttccctagcctgggagcaaccttgtaggtctcccacaccaccccctctttgtggctttttttttttttttttgaggtggagtctcgctttgtcgcccagcctggagtgcagtggcgcaatctcggctcactgcaacctccgcctcccaggttcaagctattctcctgcctcagcctcctgagtagctgggattacaggtgcgcaccaccacgcctggctaatttttgtatttttagtggagatggagttttaccatgttgtccaggctggtctcgaactcctgacctcaggtgatccgcctgccttgccctcccagagtgctgggattacaggcattcctggcctttgtggctttttctagatgctcagaaggggcttcagagggggagtgaagaaattaaagctgttagttggaaatactgggtgatattaatttaattttaaattttgtagttctgtacagtgcctcactggggaatactggctggccccagtttcctcagctcatgttttctgtgcctcctcctctcctcctctctgtcccattctttctgtggctgaacctacgttgcaggaggtgggggcggaagaggcacatgacttggtgaagctttccatataaaatttgggtgaaccttatctgtctttactgtaataattgctgatttttaatgaagtgcttccagggacctcatctcatttaatccttccagcagcccagggatggagggatgagggatggagggatgagggatggagggatgagggatgagggatgaggacatccctcgttgggatggagggatgaggaaacagaggctccgggagtctataggacctgcacagccagctagagggctttcttgagtccactcctgaggcctttgcgctgagaatgtggcttcccttgtttatttgcccaggttaggctggggcttccaggaggctacagaagcacaagaatgtctgtgagtttctcatcctccagagacttggaggccagctgggctgacttggcttgcaagaaacgtgtttctggagcagtctcagaccttggtatcccaccagggacccttttgtcccaataccttagaagggactgaggagttcattaatgttcacgtttatgaccacccttggtaggtagcccaggcctgcatctgctctcatgggtctgggagtttggtgtcaacagtaaactggcttgggaggcgtgccagtgagagtgtagcatgccaccgggcctgtcccttccccttgggccctacatttgttcctttaaaatagggccatctccaaggtccttttctacagggatggcttagcattctggtctggaattctttcgggagattctctgcagggaggaaggaggatcttttccaggattaagtgatgctggtctgtgggtgggtatttttttatttgttttaatgtctggatttgccaccatttcgggggtgcagaggtgggaagaggtgctgacttaggttttctttgcagcagtgcacagggagtattcataacccagccttgcaaatgaacactttctaccagcctcctggggagcaaacagaacttcacataggaggaagcgtccgtgtgcacatggatctattgaagggactgcctcagtttcaggcctgactccacgactgactgcctatgtgccccatgaccctcgacacattccctacccctctgtgcctcactttcctcatctgtgagggtaataatttagcttagggttgcgagcatcaaatgagggaatttgctaaagggtccaggatagtgcctggaattctgtcagtggcggcggccgctgctgtcgtcgtccctgtggagtgagtgagtgggtctctgcccatggatgcctctctattcagggacctttggcctttgtagatttagtgttcttggttttggcagtttgcaagtcaccctgaaggccacgatggctgaactgatcatcttgcagggatgtgggtttgaggatttgaaactgttcagtgggcatagctaaggagggggcccaggcttgcctggtggcctttcagcatcacagcggggttctgttctccttcagcacatggcccatctgaatattacagccccccaggaggtggaggtgctgtccccacctactttatggatggggaagctgagaaatttatgttaagatgctacttgtatttttttaagtttggagattgagaagagtttgttctggatttcctgaaaatgccaagtctccactggtaatcttgttactattactagctaacatttattgttttctgtatctttttgaatatttaagacatgcacatattaaaaaaaattcagaggactcaaagtatacaatgaaacgtcagccctgttcgcttctcattgctgagttccagttccctggggcagtctgtctctataggtgtttatgcacactcaggggcgcgtgcacgtgtaggtctctccatatgtattactgttgtgctcttgcacattgcatgggactgtgtgtcttggagaaactccacatcgctgcttcatttggagaaagttttgtatcattacctctttttttttaaacagctgtgtggtccagttcttaaaaggatggaacatgtttcttccgctggtgttggtttctgctggtatgggcagcatgacaataccccgtccccttgcctgggtgtacattgctagatgaggagggctgggtcagagggcacaggcattttactttttcatactttttgtgtgtatgtgtgagacagagtctccctctgtcgcctagactggagtgcagtggcacgatcttggctcaccgcaacctccgcctcctgggttcaagtgattctcctgtcttagcctcccgagtagctggaactacagtcatgcaccaccacacctggctaatttttctatttttagtagagactgggtttcgccatcttggccaggttggtttcgaactcctggcctcaattgatctgcccacctcggcctcccaaagtgctgggattacaggtgtgagccactacgcccagctttttcatacatgttctgaaactgctcacaaagaaatttcaatatgtcagtcccaatgacagtgaatgggagagcctgtgctgcgcaccctcctgcgctcagggccgggacaaatctgtgggtgagatggtcctctggattcatatttcacctagtgagatagtgagattgaggagtttaggttgctgggggctgactgcaggcacctggaagagctgggtgcacctgcatggcaggatgggcatcaatgtttctaaccactgggccatcctgcctttaccggttatttctcccacatggtttagcaggtttgggacattcagtaaatacttaaagtcaagtgccccatgagcacagttcctgaacagctggatgtaaatagggtttcagttcccactcattttgaattcagctggaaagctacatttgagagaatactatgacacttcccttttaaaaagtagcattcattttaggaagcaaagcattcaagagctgtgcacctccttctttccctcgcaaagtcactgtcttaaacaccttccccatcctgcatgaattgggcccagcccagcctctcccactctggtggcccttggggagccggcccgggtgtgtgtggccttgctctggagagggtgtgggactcccgagaactggcccatggtcacacagtggaaatgtgggaggggaacttgcctcgctccaagccgagtgctccccactcaccactggccaaagcctccttgtgaacaggcctttcctcccggctgcggcccacggtgtgtattagagtggccaggccatacctgtggggccctttgagtctttctggggcttcgtcttgctgctctgagcctgctcagaaagcagctgcccttgtggcctgcatctccccagcagagcctcatgggctggtttctgtaggcccatcctctggatggcccctgggagtgctcccacagccatttttagggttcggtggggtggatctgagattcgtgtcagagatcccgtggagccgtggagcgtcaagaatcactctcacaagggagctccagactccagaccccgctccgcatccccccacccctccaggcccttgagtgctgggtgccccaccctgttaattgctcatgatgttccagggcacacctgtggcagaggccacctgcagactcagctgccccagagggtgaatcgggacccacaggccaaaggccctcccagacagcttcagggagatgtcttcgttccaaacctctctcgccgtcagaatcttcactgatacttaggcccccaccactgggcctgttcttcctctctgacttgctcattgtcctgcttattttaagtctgtcttgtttttaagtagttggttctatgaaggtagagattttggcagctttatttactgctgaaaccccagtgcctataccagtgcacataggagctcaaaaaagaatctgttagtggctgggtgtgatggcttacacctgtaatcccagcactttgggaggctgaggcgggcagattgcttgaggtcaggagttcaagaccagcctgggcaacatggtgaatacctatctctactaaaaatacaaaaattagcagggcatggtggcaggtgcttgttatcccagctacttgggacgctgaggcaggagaattgcttgagctcgggaggtggagattgcagtgagccaagattgcaccattgcactccagcctgggtgacagagctggactctgtctcaaaaaaaaaaagtatgttagtggatcaataactgcctggtggtttttggaagcctttttcatgtccctatggctcagccaaagccacttgtgactctggaatgctctgggccaggaaggaaaccccaggggtgggggagatggggagagagttaggtggtaagtcccaggttccggaggggcttgtgggcaagtcctgagcatctgccctggccaggcctgtgctgggtgctggtccttgccggcatgtacacctgcaggaggtgaaggcaaaccagctctcagatgcactggaaatgctgcaaggtgtgactagagccaggaaacctgcaaacaggagagaactatggcgcagtggctgcagccactttagcactctgtggtcagagaaggcctctctaaggaggcgacattcagcaagaggggcctagagctctctccaggagctaaaggacccacagggtgggcggtgtccactttgtagaggccacacaccctggcctctaccataagccttataagcctctgccataagccctgggttccatgtggattggagggcaggcagctctgggcagaactgaggccggtttccaccttagacagggtggttcaaggaggtgtcggggtgtccttctagagccttgtttcctgacagtgtgaccttcctcccatccgagggaggctgcagttatgccctcggggccagggataggaagacaaaatgctccccgtgggtctggttcagtccagcctttgtgttctggaaatgagccgctctgggctgtggggtggtggggtggatggggtggtagtgggtgggtcagctgacctttctcaagaatcaggttaggtctcaggtgcccaagggagccgagggaagccgcgcctgacctgtgtgctctttggcagtcatcgatcttcctccaagttacttgtttgccaaacttgcccaacaaaagagacaccaggggatgggcgtggtggctcacgcctataatcccagcactttgggaggctgaggcgggcggatcacctgaggtcaggagttcaagaccagcttggccaacatggtgaaacccagtctctactaaaaatacaaaaaatcagctgggtgtggtgactggcacctgtaatcccagctgctcgggaggctgaggcaggagaaacgcttgaacccgggaggtggatgttgcagtgagccgagatcgcgccactgtactccagcctgggtgacatgagtgaaactctgtctcaaaaaaaaaaaaaaaaaaccccacaaaaattagccaggcgtggtggtgggtgcctgtaatcccagctactactcggcaggctgaggtgggagaatcgcttgaactcaggaggcggaggttgtggtgagccgagattgcgtcactgcagtccagcctggtgacagagcaagactccgtctccaaaaaaaaaaaaaaaaagctccaggggcactggggagaagggagaagtacacatcctgaagtctcccttccctgtgagatgaagattctcctgggaagggggctggggagctccttgtgaagtaccctgatgatttttatgggaaactactcactgtcatttcatgaagtgcctcagaagaccttaccccaaaactgtcaggcgtggggaagcaccgagttagccaaggctgaagcagtgtgtttcagacttctcaggggcaggtcccctccaggaggtttgctggagccagaggttcccaggctggctcctgggtctctgtaccctgagctcactgtgggaatctccagtctggcaccgttcacctgaggcctcactggagccccctcatgcaggagggagacatggcaggggcaccaggtcgtcagcccagcccagttctacctgctgttgctaccttttgccaaattccttctcaaaagaagccttttcagatttcttgcctctggctgctggtttgcccggagtgtatagaaaggagctagttttgcacaagagacattcctgggaccgatctggccagatagacacttgtggcgttttcctcagcagtttacgctgcaaacccatggactcctcagcaaccattcttattagcctggggtcactctgggcgctcttggagcccaagccagaaactgggactctgggtttgttcaggcggcctgctgtgctttggcagggctgtgttgcttcctctctgcccccttgtacattcatggctcatgccagatctcagaggatcctgagaacctaccatgggggtcaggcactattgcagatgggataactaccctccaggatggctgaggggtctccatttgctagatgagggccctgagactcagggagaggccaggtgctgtgagcagcacagcttggattcaccctcagggatgggtgactcctgaaaccatgctgtttccactccgccaggttgcctttgtcttcaacacagcatccagctgccgtcgatcgatgtcaggaaaatcaaggagttctgttctttttttttttgagatggagtttcgctattgtcacccaggccggagtgcaaggtgtgatctttgttcactgcaacctccacctcagcctccccagtagctgggattacaggcacccaccatcacacccagcgaatttttgtatttttagtggagaagatggggtttcaccatgttggccaggctagtctcaaactcctgacctcaggtgatctgctcaacttggcctcacaaaatgctgggattacaagtgtgagcgaccgcgccctgcctcaaggggttcttttctgagcatcctttgtgtgcagttgttgggcccaggaggatagtgcatggtggagatggcagtgaagttggagcatgagacttgtcctgagcctctgccctcccaactgtaaggtgggtgcagtgcacccgccctagggccaaatgataggattccccctccacccaagaggccacctcacctgccctcctacccgcccaaggcagggcctggggcctctgacacatctctgctgggagctgccacccatctttttctgggggatcctccagtggtcagcttgctgcttcctgggcagggcggggcatggtagatgggtgcagagagaaccctcctgtggcagtttcactttcatttctgcctcacaccctgtttccatccaacagtcaagggctgggctgcggaggtgaggaaacatccggtctccaccctggggtacttgtcctagtgcaggttcccaggcctccccctcccctggaatgaatctggggtgggccgtggcatcttctttttaaaaaacaccccattcattcctttatgcacttacatgccacatacttactgagtgcctgctgtatgctgggcactcctgggttctggggattgatacagcagtgagcaccacagtctcctggagccccagggtcagtcttagggagagcttcagggcagttgtctcaccactgggagctcttgcccacagtgtgctgggtcacgtacctctcagggtcctgggctcgtgagtttcttcttcttcttattttttttttgagatggagacggagtcttgctctattgcccaggctggagtgcagtggtgcaatctcactgcaacctctgcctcccgggttcaagcgattctcctgcctcagcctcctgagtagctgggattacaagcacgcgccaccacgcccggctaatttttgtatttttagtagagatggggtttcactgtgttggtcaggctggtcttgaactcgtgatctgcccgtctcagcctcccaaagtgctgggattacaggcgtaagccaccatgcccggccctatttttctttttttctttctttctttctttttttttttttttttttgagatggagtcttgctttgtcgcccaggctggagtgcagtggcgcgatcttggctcactgcaagctccgcctcccaggttcatgccattcttctgcctcagcctcccgagtagctgggactacaggcgcctgccaccatgcccggctaattttttgtatttttagtagagacagggtttcaccgtgttagccaggatggtctcgatctcctgaccttgtgatccgcccacctcggcctcccaaagtgctgggatgacaggcgtgagccaccactcccagacttgtttctgtcttttttgccgttgttgtagagacagggtttcactgtgttggccaggtttggctgtaactcctgagcttgatcgatcgcccgtctcagcctcccgaagtgttgggattataggcttgagccactgtgcctagccagcctattttctttttcttttttgttagtcttgctctgtcatccaggttggagtgcagtggtgtgatcttggctcactgcaacctccacctcccaggtttaagtgattctcggacctcaggtgatccttccacctcagcctcccaaagagttgggattacaggtgtgagccaccacgcccagcccagcctattttctttaagattttaaagtcctaacattcgtcatgggatccttgaaaagaaaaggaattatggccttgccactagaggcctttgccgcctccctgcaggaaggtgtgtcccgcggcattgggatcgtgttggagaaaggttttgcttcctgcacagtcagctcccaagcaccctttttatcaccttgacctgggcgcagccaagccgtggcctgtgcttgcggagatttgggtgccccatcctctcgctgctctggggaagcctgtagctgtggagaggccagtccaggccccagcttctgacctttgtctacatatcaggaggagccctcctggtgaggaatgtgcctcgttcttttgggggagctgacgaggtgcctgtagtgtggagggttaggggcaggggagtccctccagaaatgcacttaagcttgcagagtcaccctgccctgcattgttaagtggtataaggacagttagctccagaaacagcagtggctcctgtctctggagctctagcttcatgcctgacatggtgctgagcgctaacatgtggctctttgaagctgtcagtccgtatgtggagactgaggctcagagagggtaagtgactttcccggggtttcatagccgatcaccctgggggtggggttcaaacatcagtttgcacagtgccgcgatctcaggtcactgcaacctccacctcctggattcaagcgattctcctgcctcagccttccgagtagctggagtcacaagcgcacgcctccacgcccagctaattttttgtatttttagtagagatggggttttgccacattggccaggctggtctcgaactcctgacctcaaatgatccacttggcttggcttcccaaagtgctggcattacaggcgtgaaccaccgtgcccggcctcggcttcttactaggtggatgactgtgggtgtgtttcagctcctctctgggccttaatttccttgtcagtaagaggtgaccttgtgctcatgcataggagggggtcagcacatgcaaacttcccttctgtgcagggcagaggccatctctggaaggaagaagggggaaagtggccccttactcacctgtgtcaggtggtatcagagtaaacctccacagagtccagaggtacagagattcacgatcttagaggagtaacttttgaaaacctttgagccagaagaggcctttgcgtgtaagggtttgcagctcagagtggctggccttgcagggtcacacatgtagagctttgggctgacagcttcgcagcccagaagtacacctgtggcctccagggaacctctaggagtgtgaagaggcgagggtgtgttctgttctgggccatgattggtggaccccatcccggccaggatgagttatttttgttgatgggccctgtggtctctcctaaccttgctgggaatgtgacaggaaccaattctttggatttgggatgctctcctgggaaggatgggggagtgagtgggtgccccttccctgacgcagccatctgggacgtgggcagttctgtgagtgcttctgcatgtgcttcaggctgggaccccctggacagtgagacctatggagtgggccacatggctgcaaatctgtttccattgctgtgtgctccagtcctctcactctcaattaaccaacagatgtgatgagtcattggggtctcgtcagctaatgatctgagcagtaagtcgattgtatggctgattcctagagccacaggggtggatgggttctgacaggagcctcagtgctgagcgggttcggtaataaaggggatgtattggttcctgagtcagatccttggggcattctggcttcaggtgtaggtagactcaggcgacagtccaatagggcctggtctgtctgtctgtctgtctctctctctctctgtctctctctctctctctctccctcctctctccccccggccccctccctgcttccctggtctcttttacattggcttcattctcaggcccatgtggtgcaaggtgagtcctcaccctcaatccttattctcagccaggcactgtggcgttccttaggtgtgtgatctcatttgatccgcattaacagccctgggagggtggtggttttagcattcctgtttctcatagaagggctaagtaacttgcctggggtcacacagctggtaggggcagagctgggattcagagctggttgggttggctccagggtcccccatccctcatgctccaggtccacagggacagggattccttctgttggcctctgatttgtcatcctgggccacatacctgtctctgaaccagtctctggggctggggaatgcagcgcctcattcccttctacatggcctgagtgtgggcagggtggatccccaaaaggatgctgcaggggcactgtttcccagaggcaggggagggatgtttggcagctgaggtgggagtggacgtgctccctgtttctgggcttcagtggctggccagagtgaggctgggggctgctctccctcagcttccagctctggacccagcttgcaaagacttggacgggggcctgagggttcgcacacagagtccagggctaggacgttgttcccaagaagggagtggagagtacctacccccacaagtctgagccccaggctggcctaccctgtgctgggcacctctgcttggggttccagaattctcggaggcagctgggtgggagtgctggtgggaagctccggaagggaggctgctcggggcctccctgtggctgtggctgcatgggcagccccgaagcggcttcctggaccccaccttgtgcctcagttaaacctgaatctggcttattcccacggccagcccgacacaggcagattctgagagtcctggctgcgcccagcagccagctgggtgggtggacatactggagggctgatgtcctatttgtgggctggggtttttccgggccttgggaaatgctgcctgagttcctggagaaggatgacatctttcctgccccactgtcgctgtcgctgtgcagaaccttggtgttttgacactgatgtgttctggagctaaacaatctcgtgttatgtaaacacaattagcctgttgctgtttgaccctgtcctgcttggggagggttgagaaggtgtctttttgctggatcctgggaattctgagagcctggagcagctgtgaactagtggctgggggttgtcggagctggaggggagtgttggtctggggagggccactcctgtccaggacactccgctccgatatactaagccagaccctggccccccacagctgagcaggcctggtggaactgcggggaggacatgctggactatttccacccggaaggggagaggaaatgaacggtgagtggctggtggccacaaacccaggatgttccatatatcagggccccagttccgagggccccgggcaaaggggctgggctggaggttgggagaagtgcagggtgacaggccctggttagagtatgggtcccttatggttcctttctgaaacgagtggggcaggtgagggcaaggcctgctcagagccccttgccccgggcctgcttaactgctgtgggtgcctctgcttggtgttccagaattttcagaggcggctgcatgggagtgctggagggaagctcgggaagggaagccgttctgccctgccttggttgcggccgtgtggacagccctgaagtagcttcatgggcctttcggtgctgcacaaggtggcagaagctgggaccagcgctcagacccctgctttgccgctgagctgtgcggccctgcaccatggtctctatttgagggccctcagctcaaaggctctgggaaatgagtttgggacccattgcttctggtttagctggtggggctggtggacctgtcaggttggacaagcaattcttgtgccttagcctcccaagtagctggggttacaggcgcccaccaccacgcccggctaatttttgtgtgttttttttttttgagacggaatctcgctctgtcgcccaggttggagtgcggcagcgtgatctcggctcactacaagctccgcctcccgggttcacgccattctcctgcctcaaccttccgagtagctgggactacaggtgcccgccaccatgcccggctactttttttgtagttttagtagagacggggtttcactgtgttagccaggatggtctcgatctcctgacctcgtgatctgcctgtcttggcctcccaaagtgctgggattacaggcatgaaccaccgcacccggccattaatttttgcatttttagtagagacagggtttcaccatgttggtcaggctggtctcaaactcctgacctcaagtgatctgcctgccttggcctcccaaagtggtgggattatatgcatgagccacctggcccagcccacacttggctaattttcttttttttgagatggagttttgctcttgtcgcccaggctggagtgcattggcggcaatcttggctcactgcaacctctgcctcccaggttcaagtgattctcctgcctcagcctcctgagtagttgggattacaggcacctgccaccatgcctggctaatttttgtacttgtagtagagacagggtttcaccatgttggccaggctgttctctaacctctgacccaaagtgatccgcccaccttggccttccaaaatgctgggattacaggcatgaatcactgtgcctggccgatttttcccattttcttgctgttgtaggtacagctgcattgggcatctttgtgaatataaatgtcttccttccctttctgattccgttacgtgtaggtaaaagtttttatcagttattgatgcataacaacccatcctaaaaactactggctttaagcaataagcattttttcatcccacagttctgtgggctttgctgcgtagctctggtcttgctaggaatcccttgcgtgtgtgtggtcagcttgcagtctggtaaggggtctctgccctggggcttgacctttggctaaccgaaggcgctgggcatgacctggcctccttcttggctttcctcaggctgctgggcttgttcctgacactaacagtggatgtttccaaggcctctggaggcccgtttgtgtctctacagtttgttggccaaaacaagacccaaggccagctaacattcaaggggtaagaaaataaactttaccccttggcggaggtgtcaaagtcattgcaaagggcctggatacagggagggtcaagccctgggaacatgtctgcacacagagtgtgtgatccgggtctgcgcgttggccggcagcccatagacctttcccaaattagtacctggcaggtgcccagctggtgctgggctgggtatggggaggggcggagaagtcgggttcataaggaacaactgtcatcattcagaaagcttttcgaagtgtccgctgtgtgcccagctctaccgacccaggtattgtcagtcctggttcttcaggaacttggcttttgcttacagagggaaggctctgtgggtgactgaccaagggactcggtgacgtcagtgtcctgtgtggtggtgggaagttttgttcctggattggggcctggtgttatctttgtggcaatcccccacctccatgatgaagttcatttttctcagctggaagaggaggttagaacattggagcccctacattctagaacattcgagcccctacattcttgaacattccaactgggagagcccttgggattttcagtggggaaaccagcggtgaatctgcagccaggactagctcctgcgctctctccttctccttgtgctgctgggtgcctgtgttgtttccagattgcatccagacccaggatttcctgttgttgttcttcgtgtgtgtttcttcattagaacaactcctgcatcctctgcagagctgtttacaggcatctattggcctccctccgtgccaggcctcgtggtgcatgtggccaagtgatggccaagatggacaaggtcttgtcatttggagctttagtctgtgagggctatagggagggtacagacatgtcaaccagtgagttacagggatgattttatctgggatcggaaaatgaagtgatgacagtgatatgaaggggtctggggactgtcctcacatagtcagagaagacctttcccaaggagagagctgtggctgctgctgacaggtcagaaaggagtcagtcgcagaaagctggggctgcggcatctcaggcaggggaagcgggtttagcaagtgcagaggccccaggggcacaggagggagccggagcttggtgtgttggtgagctgtggttggaggacgtggccggggcaaggcctgggaggacagggccgtgaggaagcaggcagggccaggtttctcagcgctttccaggccccagcatgcagtttgagattattttacaggaggtagaaggcaaaggctctcatcaaattaccccacaacatagtccgtgaaatactactcagccatgaaaaagaacacaaccccatcctttgcagcaacatggatgcagctggaggccattatcctaagcaaattaacgcaggaacagaaaaccaaatgtttcatgttcttacttatagatgggaactaaaccttgggtatatatggacacaaagatgggaagagtcaacactggggactactagagggggaaatgggagaggggggcaagggctgaaaaactacccattgggtactatgctcagtacctgggtgatgagatcattcatactccaaacctcagtgtcacacattatacttgtaacaaacctgcacatgtacccctgaatctaagataaaagttgaatttattaaaaaaaaaaaaaaaaaacctagtccgtgactctaggtgacccttttaaaagctttgggtggtgctgataagtgtgactgtgtcctggagcggcttcattacttcccatccctccagctgcctgccacagggcccagaagctggctttggaattggagggactgggtcaaacttgcttctgctcctgtctagcaagttagcgagcttctctgagcctgtttctttgtctgtaggataaaaaaagcacttcttaacttctgtggttggtgtgtcagttgaaataattattaatggtataaagttccatagttcactgcctgctagatttatttacaattactacaaataactcatcgtaggccccaatcagcggtagatggtattactgtggtggtggtggtggtatgtaggtggtgctgtggtctgggtttcagacaccatgcggggtgctggagcaccgagttcctcctgcaccccgggagcccagttggtgcggagacagagacaggaggtgaagtgttagatgaactctgctcgaggaacagagcaagtttctctatctgggaagatggaagaaagctttccacaggtggtgacccttgagaggtatgtttgagggcgcagggagctcgctcacggacaggtatggatggaaggtagtggagaaagcgggcaagcctgtgccaaggcgtgacgctgtggagccaggagtccttcaacacggactctgggcatgtagggccggtgcagatgggtggctgtggggagcccctggaagcctgggctgagagcctctaggaagcagtgggctggctgtgggaggaacacccctgcctctccctgtgcctgcagtgggtcccgtccccacgctgtgactgccaggtgtggacacatgctcgtcaagtggtgaagaacgtggagccggtgggctcaccggcttggggcctggctgcctcactgggaagcttggtggccctgggaggtcattgagtgtccctaagcttccgccagggagatgatcgtagggctggtgtgaggggagatgaggagtctgtgtctagcacccagcacagggcatgcactgataaaatgatggcttcacccggctcccaggggccacgtccagctgacagctccttggtgacttagctgtatgggtggtgtgcagctggcactgcttgctggtctgggggagacatcctaggctggcctgtggaggacgttccctctcagcctcctctgagccatgggcataggtgagttttcagaaaagcccataccgacggtgattcagctctgcttcttgcttccttctgtcttattcttaagtcacccacagggcagccacctgccagtgtctgtcctccaatcccctgctccaaggaactgctctaggcagggaagagagaggaggaggaggccccgcatatcctcgggtagaacggaggaggaaactgaggctcctcacagaggttaactaacctctgctagaccacccaggtgtaagagctgggatgcccccagaccctcccttctcccgggagcggtggagccgaggcggtgggggcctggctggagcgccccaggagctgagagaagtttagtccacctggagcttggcaatcggggtgaggatccctttgaggccgggttgcacaggatcctataagccatcattgtacacgcttgggctttgccctgaaggctgggggagccatagcagttgtgtgaggttggctgctgggtggaagccaggggcttgtgggattggagggggaggctgctgcgattgtccaggcagtggtggtctagatcgtgcagtggtggtggatatcaactcttcagagtccatccaggtctgaggactcattagcaacctcggctattcctcgactactcaggatgttgtctgtatggggccggtggcctcagcactcctggttcctcagcatcgccacgccctctgtatccacggactcagaatctgtgttttaacaagacccccaagaggtgccagtacacacggcacattcatgtttgcaaacactggtttagggaacctgttgacctcagcgcagggctgaggggggaagaaaggactgaggtcaaggcctgacttcatgaggaaggggaggttggggagcgggggaagaggagatgatgtcggagcactcagacttctgactgggaggagggctacatcaccccacgccaggggcggcttgaggactagtgcagttataacacaaagggccgaaacggcctggccgctggggcagggcagagagctgggctccacagggcagcctgcacaccccatctctgcccttggaggccctagaaccctgtggaccctgtcctttgtcctttctgccgtgtccatgtaggtgtgggtcgtgtctgccccacaggttgggtatttgccgttgtgctgtcagcagatgggtgttgagcccatgcaggcctggacttggtcacagaacggcatcctgcttgttgagtagccatcctggtcatgaggggtcatgtggtaatgagtgtatggagagctgggggcgtcattgtgaagaccaagtgaagcagcagtcggatctgggacagaggttcctctagggaaagactattatggtctggggcaccctggaggcacgcgccgtggctggagggtgggtgagtctgtggctggtgggttcggctgaggcaggggagtgcgctcttcagcccagccccctggcctgggccctgccgtgctggagtctcctggtgcctggaggctgagtcgaatgcagtggggctgggcagagggtgccctggctgtcgtggggtggaagcttggctgacccagtggacatcagccaggaccacattaggcccagctttggctgggttccccacagctgtgcccaacggcatccctggcctccacctactggatgccagtactactctcgtcttccaagaatgtctgcaggtacttccagatgtcctctgggtggggggtaaaattgctccgttgagggccagtgctggctgagggttcttcatcattcccttctggtcccagcctggctgcactgccacctggcgagctctgtttccaggcagtgggtcaggcctgctttgggggctggcatgctgtcctccctcacccatgtcaaggcccgtgtggccatgtgctgacatgtgcttgatgtgacctgggagtcagagcgcctggcttcctgctccaggcttccgtggtgccgtaaggacctcaggtctgggggtcaggaggcctggatggaaaatcctggcactctggtccttgtaggggaccctgagcctcgattttgcatctttggcgtggggctgtggtagcctttccatgggtgctggtggaggctgcgaatgccagtgtgcccaccctccccatgctgggcttagcgtgggtgcctggtgacagtgtgttaatctccccttgacttctctgtgacctcagataagtccctctcagttctgggccttgcttataaaagggttcttgggctctcttctgtgtaaaaagtggggaatgaggtggagagcctgggggacaggggagtcatggggttggacaccgtgccagagcctgtggtgctttaaaatcaaggctcaaacccagggtcctgaagagggccgagcagcagctgaggtccgagtgcacccggcctgccagtgctgcccaggagtggcacctcccgtcatccctcacgcccagcaaggacccagtgtgacaagagcatggagtctggacctggcagagctaggtttgcctccttgctcttctatgactagctgcatggctcctggagcctgtctgagcttcaggtgccacacctgaagactgaggttaaatgggaggcggggaggagctggtgacactgactggatgccactatgtgccagcctcattcattccaccctctggcagtgtcctgagttacatgcccagccaccgtgctattttccaggccggaaaaccgaggtgtagagcccagcactcggcgtaggaggcacacagcaagtgaagccatccttgttgacatgagctggttgctcttggcatttgagtctgaatatcaaaggccctgaagattaaaaagagagaatgaagaatgatgtgcctggtgccttcttgggaagagcccgaggccagctgtggaggggagcaagactggttctgggctgggcttcctggcctggtgctttcctgggcagctggaagtgcttctgtgggagctgtctggccctggcgccgttgttggcttcattattttttgcctgcaggggcctgagtattctgtactgacgggaaaacatttgttgggctgacgctgtaatcacaccacaagggacacttgaaattatatctgtatttgggaagctaattttaaagaactttttctcttcataattatatgcaatcagccagctagtgttattggggattctctttttccctcttcagctgagaggccatctgccttcctcttcctgcctttccttccagcacacggtgagccatctccctgggagagggaccactggcccttggctgcctgcaagccccagggaaacctttccatggtgattgcggaggaagggatgaggaggaagagcaggggaggatgatgggggcctctggcttggctacaggatgagtccgttttcaagactggaggcgcaggttggtgatggaaatgatggagtgtagcgtttcgatttggacattgaagcagccagggctcttgtgaatgcaagtggcagaaaatccaattcagatgagtttaagcaaaaagaaaaaaaaaatacatttcttggcccaggtaaccaaactggcacaggaatagtcttatccctcaggtccccagacattcctcctgtccctggagttttattcctcatcaggaggaatttagttccagaaaacgctggccaaaaaaagaaaagaaaagcccccgttgcccaccccctgcaaatggggctcattcctctctatcttgagctctgatcctgacaagtagggtttctccaggatggtggctagcacaccagtcagggatacgggctggacatttagggttggcacgaagtggactctgtggattgtccttcacacgggaggcattcaggtcaggagaatataccatgtgctggcccttcaggtctcgatctgaccaccctttccaacaccctgggttcctctgtgtccttcctcttggaccgccctctgagaggatggtgcgaggaagaggcttccgtgttgtgcatggtaggcagggatgggggcgttccaggggcggacagcatgggcaggtggtcagaagtgtgaaagaaccgacctgtggggcacggcaggaagcccggtgtgctaggaacagatggggcgagacttgctgggtgaggaggtgtgcacctgctgcagaggcccaagtggtgggggtgagggaagcccagggggtgagtctgggcaggggctggggggtgatgagccatgtttcagatgcagaaggtgcagagtgtgtgtgcagggacagcagggagaccgcctggtggcctgcaccgcagagctgtgtgtctcagggagtgggaagccctgcctgtgctggcctcagttcttccgctcttctggaattctgcatccttcttttgacatttctctctaatgcccagggtcctggctcttggctttggcttggtggcagctgtgaccccctgcatggggctctgagggattattccagctgtttggggactgtagccatggctcccagctgcagagcctgacaggcctggaggccggcaggaagaagatgggggctgtgcccgcctgccgagagctggctctgagactgactcttggcactggggtcctctgaggccccaggctcattctcacctcctccagagacccagctgacataccattctcatgagctgcagtcctgtgacccagctgatttctgtctcattggtggaaccctttagaggtggggtagggctcctaaaacattagccctactgccttccccacagattggcctctcttccctgcctgtgggcatctggcatctgcttgaatccttcttgtcacggggtgctcatcacctcttgactgccttcctatggaagccagcaacctcttcctatggttgagctgaaatctacttcataggaagggttccttctgcctggaaggtttgatattggacaggactgtcaaccgtgtggagaggggaggaacagggtgctggctcccccggcttctgggctggattgacccagggcgtgtctaccccacagcatcctgacatgccagaggctggaccttaggaagtgccttccgggcccttcactgcaggcctgctcaggggctgctcctcaggtcttggggcccctggggcaatggcatccatccttttggcctcctggggtcaaggttctgagggaggattagggcagcaggtggttgggtggagaggcagctctgtccagaacaaccctgttccagaaatcccagagcctcatccccaacagacccggtgggccccccaccatcacacaggtcccctttctccccaggaagtcacacagtgctgtgggatgaggagggtttcctgacagatttggggagagcgggcctgggtggggagtaagggagcctgggaattactggtatttggatgggtttagattgtggttctgcttcttacctgctgtgagtctttggtcaggatactgaactgctctgaatttccccacttgaaaagaggtgacaggccaggcgcggtggctcacatctgtaatcccagcactctgggaggccaaggcgggaggattgcttgagcctgggagtttgagaccagcaacctactgggcaacatagtgagaccctgtctctacaaaaaataaaaaaagaggcctggtgcagaggctcatgcctgtaatcctagcactttggggggccaaggcaggcagatcacttgatgttgggagttcgagaccagcctggtcaccatggcaaaaccccgtctctcctaaaaacacaaaaattaacagagtatggtggcgcacgactgtagtcccagctacttgggtggccaagtagctcctgcttgaacgcgggagaattgcttgaacccaggaggtcaaggctgcaatgagccgaaatcgtgtcactgcactctagcctgggtgacagagggagaccctgtctcaaaaaaaaaaaaaaaacaaaacaaaaccaaaaaagaaaagatgcaaccattgtacccacccagtggttgctgagatccagtgtgagggggacgaagtgcctggcactcacaaatcctgccccgccactgcctcgtctgtccctgtttctgcctgggacagggagagcaggcctgggtggggaacgagagagctcggggattactggtgttagcctctcatttatttgggtcgtgctcaggcccctggaatcctctctgaaactggagagtctctcgggtagccgatgaagcgctgcctgttttagggtcaggtgcctgggcacctctgatggacctcaggatgagcccaagtgtcagtaattatcacccagctccccggtttgcagccaaggcttccaggcctggagcctttggtctccagcacccagttcccccacatcccttccctgggcttctttcccgccattcccatcagggacccctgcggccatgctgggctgtacccagtgccccttgggaatctgcgggtaccgtgcaaagctgtgctgtgctcctccccatcaactcctcattgactgttgaaggcccctacaaactcctgacaggtcctcattcattcctgcctgacacatgaatgcttccaggcgatgtctgagaatcctgggatggcagagctgtgggagccttggggttgtggtgggcaaagtaaggcccctgccactccccaccaaagacagcaggttctaatcctcagagcctgtgagtgtgctgccttacatggtaaaagggtatgacatgactacagatgggatttttaaatttttatttttcagagatgggggtctcactgtgtcacccaggctggagtgcagtggctattcacaggtctgatcataacgcactgcagcatcaaactcacggcctcaagtgatcctctcgccttagcctcccaagtagctgggattataggcatgtgccactgctcttggcttacagatgtgaaggagtgaggcatcttgaaatagaaaatgttcctgcattacctgggtgggcctggtgtaattacaaggaggcaggagggccagaggagatgtgacagtggaagcagaggttggggtgttgtggccacaagccaaggaatgtggacagcctttagaactagagaaagcggaggaatcgatttctccctggagcctccaaaaggaagcctgcctctgacctcagaaccctaagagaataatacatttgtgttgtttttagccactactgttgtgatttgttacagcagcaatgggaagtgaatacagttttctcctaccctgctcttcttagggcttgtgggtgaatctgtgactgagaagggagggactgggtcagggtcaaggtcaaggccagagcccatgtgacccgacaccttgggactttcctttgacctgccatcccgaaaatatctgaggggccagggagatactccagtaaggtgccttgtggtttaagttttctgagatggggtcagggctgactcatgcctgtggctggggggccccaggaaaccccagtgcccatgacctggtctttgcctttgcttctcctggtgcttagcaggccttctctagcgtgccctggcagcctccctctccctcccctccagggcctggctcacacagcagctctactgaaacttccctgtgcctcctgctgtcccccaggtgtttgtgctatttaagggcctgtggcacacccgccagagggcatggcatgtagcccactggtctgccctgtggcagctagcatctcggggcagggtttgcggtctggggtccccctctggtcccaggccagcccagtgcgtgacagagaagcccagcaaatgtttgaccaaaatcagaccaggaaactctcgctgcctgtggttggaggtgcagcagcagggcaaagacaactaaactttaagggcttgggatccagggaccaggagctgcccccagccctcaggccaggtaaggagtgttggcagcagaatttgggtgaagtctttcggtctcctctggaacacagcctttcaaagagtgtcagcatccaggacacaggctggggacacacacacttatgctgctattttaggagtgtggggtaccttgaggataggtgctagaacaattcaggctttcctgagcaggcttctccctcccccagtgagtccaagggagggaaatgtcacgggaatttctgcctcccttcctgcagtagcctaccttgctcattaggctgatactaaatgactttgcattcttgggattaagaagctgctgtgaagagaaccaactgaatcattagccctgaggctggctggctgacggaggagggggagtgggggtagcggggaggggaggaggtgctagaaccaagcctgccagcaccccccactacctccctctcccagcagccaactcccctgcttcccacaatttaggtcccatccctaattaggggaaagaaaaattaccgcacctgcaaggggatagtaaaagactcaaaaacaatttcaagtcgagaatttccacactaaaaagcggggatgtcgagagccattaagggaatagatttaacgtttgtgatcagcaagaagtcaggatgattcctgatctgaagtggtggccccttggatgtggcagaacactgccttgcgtgatctcctgccctcgcctcacttcctccttcctgaaaattgaactgaggaggggagtctcaaaggcacctcagttcctgtgctgctttcagcccctgcagctctgatgacctctccgggaggtgccaaaggtgggtcacccactctgtctctctcttgtgcctgttcactgggaaaagctgcttccaggcacccctggaagctgttctgggtctgagggagtgtactgactcaggctgctgtgcctgcactgaggggcgcccggactttggggccggcctgcctcccctgggtggggcacccggtcggggggagggtcttcaggtaaggtggttggtgactccccagtcaaaggaaagatgcccccactcaataaaaaagacacatggcagcttccagtttatctggttcttccctagagctgtccagacaattcaaatgtttgtactggctttaaaattctgttcgtatgttgtctttatatcgggccatttcagtttctggcactgttaataggaggaaaatccaaattaccaaacaatcagcaagtaaaccaagatgccgcagggcaggcgggcaggggtgacacggggctggagcctggcccaggaacccggcagcactcggggagtgtttgcagagagcctgccaggcccagggtctgcagggggcacagggatgctgaaataaagagccatctttggcctcgaggggctcatggtctgatgctgagcatggagcaggcttcagtggaagccattattcctgcctcttgatgaggaaggcacttgagctgctcttggtgggtgggcaggagtttgccagctgaggaagggtgcctggcagggggatcagtttgtgcaaaggcagacttaggtcaagccttggcatttggagattggggtccctcctgggagggtttgagaggctgctgctgcctccccctcgtgtcttctgagctgcacctccaaatgcccatgtggcaggtgttttgctaagaatttggggctgtggacacagggcacaagctgtgtccctgaaagagtgcttgttagtcaggataggccaggttaggctgcagtgacaagtagtgtcgaaaggctggcggaaataggtttactcacaactcattcagcatgcactctggatccagagactctcgggggctgtggtctgccctgcagtggctcagtgtgtatcccacttcttaagttcagcactgtggaccttttgtgctggataattctttgttttagggggctgtcctctgcattacaggggccctttcctcactggattctagtagcactttcctcggtgtgacaatcaaaaagctcttcaggtgttgctaaatctccttgtgggggacacacagttgcccatagttgggaaccagcgctagctggaggtcctcttcatcagttgtttctttctggttcccagcctggcttcgtcgccactcagcccgcgttgtttccaggtggcgggtctggctggctctgctggtgggtggcagcctcatgtgcttccttgtttctgaggtcagggaggcctcggtgctggcagtggaatgctttttccaggaggggacatggtcacctctgttcacatctcattgcccaaggcaagtcctgtggccatgcctgactgggggcagggacaacacagtggcactgagtgtccaggagggaaattgccggctttgatggccaccattgatgttcaccaccgagcattagcctggtggggtcagtgcaatggagtccagcagcctttctctctgcccagtgctgggtgtgggcagcttggggcagtggggcctgaggagggtgggagccaaggcaggtttctccagaggagctgacctggggggtcaggtggtgatgtggggatggcatttgaggaagggaacagtgtggccatcaacacacatgggtgacggggcttagtcatctgtttaggagccccaagtcctggggagacatcctgggcttctgtggggtacggtgtgggccctgccctctgcaggcagggaaaggggaccataacttggggctttttccccagtgcctggtacctggaggtgccaaagggtcttgttatttggggtgcctgaaatcagtagttactgaactgtgccacacgttgcttggatgaggatgtgcctggcttcccacttccccgagttgttctccgtagaaccttcctcccttgcttcttcaccatttcatgtacttcacttgctgcagcgctcaggtccccaccctgccctggggagggcctcttgggtgggaaaggtcatatccttttaacggatatgaaagctgagaccccgagcggctcagcagcacatcccatgcctgctgctggtcatggtccctgagccttttgtgccctgctgtgctgtgtggcaggcctgctgctggatggggtctgtcatcccagagtgtcttgtgttaacctcctgacgccacacctggtactgtgctgcagtggcttggtggtggcgtggatgccgtggacgtgtctctgctcctcatcactcttttctacttctgccctgatcatctttattgttttcccttatcatcccctctccctcagtgctgggtcatccagagtaattttcatcatcttcagaagtggtaaccactgtcactcacagggtccctgctgctcagcggccagcgacagaaagctttagctggcttgagcagaaatctgcagctgaaggtctagagaggacgagccccactgcggccgggtctggccggggaatttgccctcctggagccctcttggccctttctcctggttggcctctggctcatctggattctcgccacatagaagcaatggtgtcctccagcatttccaggcagtgccatttgtactgcagacagtcccccaggacccgtccggtaaaggaccaggaccggcttggcttgggtcctgctcccatgctgctgctaagtgaggtgacaggtcatgtgcccacccctggagtgggcgtgccgcccccagtcatgtggactggaggaggcagttctggaagggtaggaaggcagggtggcagggcagagtgcaggtcacaagacccccatccctggcatgagccaggtactgtgccaggcctggactctgtttcccttaaagcccgtgtgggatgagttctaggattctcccattttacagataagaaaacagaggcacaaggtacaggggggtctggttccatgttctgctctcaggggctcacccacctcttccgctcccgcctacgcccccgaattgtgttcatctaagcctctgaatgctgcgaagctcagtcctgggcttctaaccacttcctggcaccaccacggttgaaaagtggactgctgctgccttcttgcagtgttctctcgtctcctgggcctggcgcagggcctcagtctgctccttccagactgtgagcgtcacaactatttctggttcttaggtttcctttacccttttcccaagacctgcaagggctgccccccaccccacccctgctatgtcctcccctagcaaatcagatcctgcttccactggtcacagagaagcacatggagtcgctcttgtggacaagcagctgtccccatacccagctgctcctgagcaacacccggagtgcgatgaaccctgaatccttcccaggccctgccctaggcctcctggatcagaggcctcagggtgggcctcgaatgaggatttttgacacgctccagtggtggttctcaggttatctgccctggcatttgggacccactggcccataggtaaaggctgggccacagggtgacatcctgggcctctgaggcgtgccccacctttatcctctgtcctgcgtctcagcccccgccccctgagagggctttaagcttccagagccccagacaccctttggggagggcgcaggactcaccttactcctctctaagtactcttctcagcaccggtctgtagttacccttcagttgctctgccagatggcaaatgctgcctcctctttgaagccttcctttattgccagcctcctcctctgaaaggatcgaatcattttgtgagtattttcacttcctgaagggttcgtgctccttggacttctggggacaggcttccctgtgcaaagcggatcatccctttgttaataatccagcttttggaaaagcatgtttatacttagctattcctattttattaatattcatattaatatattgtatttatatattagtgtaatatttatcaatacaatgacagtttagagcctgtaaaattattcgcaggtgcaggttttgtgttttttttgagacggcatctcgctctgttgcccaggctggagtgcagtggcacgatcttggctcactgcaacccccgcctcctgggttaaagcaattctcctgcctcagcctcccaagtagctgggattacaggcacctgctgttatgcccagctaatttttatattcttatagagacgaggttttaccatgttggccaggctggtctcgaactcctgacctcaggtgatttgggaggcccacctcggcctcccaaagtgctgggattacaggcgtgagccaccatgcccggctgcaggtttttaatgaaacttaaaaattattaaattgtaggctgggtgcagtggctcagcctgtaatcccagcacttttgaggtcaggagttcaagaccagcctggccaacatggtgaaaccttgtctctactaaaaatacaaaaattggctggcatcatggcaaatgcctgtagtcccagctactcgggaggccgaagcaggagaattgcttgaacccaggaggcggaggttgcagtgagctgagatcatgccactgtactccagcctgggcgatagagccagactctgtctcaaaaaaaaaaaatgtaacttttattgttactttccctatagttttgagggtagcgtatatgttcattgtagaaaatctggaaaacacagggaagtatgaaggaaaaaccacagccccgtggccacagttaacactgcagcacacgcacctcagtctgttttccaggtatcggaatgtttccacgggcttagaacccatagcgagtgctgcagcctggtggtccccactgcaggcatcatttcagctcctctttgggacagcacttggaagcttttcatgatacatcctgagctctgctgtcttgtgtcctccattgatcgattgcttcgtgcttttatcaagcatctatttaagaaacaattaaaaaatatattttccagtttttgataacatgttataggcacatggcacaacattgaagcaatgtatgaggggacacagtgaaaaggaagtccctcggccaccccagctgcccttgcccttgaccaggggccctgccatgattgttttcctgtagcgccctcaggttcactctgtgtgtacacaagcacacatgcttgtcctggatgttgttcttaacacagataattatctacagcacacagggttttgcatcttacctgtttcacacagcaacgtcttggagataattcctcgtgggtgcatggaggccttctgtgttcttttttactgctgcatactattcctttgactgtgtgtggtttgttaatgtcccctcttgggggaagtttaatttgctgctagtgttttgctatcacatacagtttggtaattaacagggcagagccggaaacatattgcacacttgagcctgtctgtggggtgatgaggtgggatcatggagccagggttttcaggaggaacagtcacttgacaaccaatgctctgatttgtgttccctcctcctgtctcccatgtcccttccttctccctcttcccctttggcttcatcattcaatttctgaactttctggttatggcaggactttaggaacttgcttcttggggaatcgaggttgttggtgcctttgctctgcacgagtttcccagtgaaaaatgagccccgacaggttgttttattttcccgagaggctgtggtggtgcatgtgggattccaccaccagaggggatgcagttttccgctgccacctcctggtccttccattgcactgaggccctggaggctggagaccaggccttccagcttggtgccacccttgcccacggtggtgcacctggtggtgaacacgtgggtgtggggagagccctgttccgggccagctcctgcacttcctgagtctcccaggcctcggcctgctctgcaggtaatggggtaaccactgtcccaccctcatgaggctgcagaaggtattggtgagtggtgagcttcaaggggtgtgtagcatacgtgggtggccccctcttttctgccactgttgcaacttatcctttttttggagctctgagcgacagaggaactgctgtggctcctgggagatcaaccccacttaagattgcagccgatcttttctctagattacttttttgttgctttcttattttatgtgttccatctgttttcagtgagagactgtttttttaggactaagggagggagagctgcctgggatgatgtaaaatgtggactgattggaattgacctcagtaaagagaggagagtcacacgctgggataacccagatgccagcagggttgactcagagggaaaccgaggccctggcccagagcccagtggaagtctgcgctcctctgtcaccggcctttcccattgtgcggttcacagtctcggtgatttgggacttgagttttctgtcctggagcagggccgctggagtttgggctggctcctcaaggtcctctgctgtgtgtcctgggtcaggttcccgtcagtgacgcttccttcagttttctcgtccctgcggggggaggggcaggatgattgggaatgaggcaggggctgaggtgtccacaggtgctcagaaacggtgcaggttgtgagcgggtggttgggtgtagcacaggttcctcatgatgctatctgtcactgtgctgtgggctgtggtggcccagggctatgctgttgtgtatctcccctgtccctcatgaaaccgtggaagcagatggatattggccaccattcctacaggaactgcagacaagctaagagacactgagggtccctgaatgcctcaaccagggtggttctcaaactggattcctcggggcccaggtttctgttgaggtgtcgggggtttgagggaaggtgggctgggtgcttcccacagtgggacctggtcagctctccttggcctctgtcttcctgtctcatggagtggctcctttgtgaggttccgctcagtgccttgctatcagaaggtgttgaggaagccctcactgaatgagctgacaaacagatgtaggaattggtgggcggcgcctcagctgtgccatgaaacaagggagcaagggtgcccaaaggttcctgtggggcttgtgcccatctcctccctaagaccttgagcctctcaagggcccagactgtggaggttgcatttgttgtaccctccgagtgctgggcccaggagctgagctaaattgttacacatttacaccttcatctgccagcagccgttgaggagtgtctgtgtgccaggtgggcatcataattgggcacgggcacacatagctttaaagtttggcatagtccctgctccaaggagcttgggtgagtaaaccacacattcctgaccttgcctggctgcagccatctttgagcatctgctggaggcctttcttcccagcacaatgtgcacagtatgctgtcttgggtgcctcggtccctgcaggtcctggtggccctacaccagtgcttgtccctggctcgtagcaatcaataccccagaacaaagggccgagacagtggtagccttaagttcttccaggttaggaggcgtcctggagaggctatgctgagccgaatcctcaaggctggggtgggaggtgggcaccagggccagggaggagaaagccctgtgtgccagagctgcacaggtgggcacttcctgggcccacagtaagaaatgtgggatgggggaggctggacgtggtggctcgcgcctgtaatcccagcactttgggaggctgaggcaggcggatcacctgaggtcaggagtttgagaccagcctggccaacatggtgaaaccccatctctactaaaaatacaaaaattagccgggcgtggtggtgggtgcctgtagtcccagctacttgggaggctgaggcaggagaatcgcttgaacccgggaggcggaggttgtagtgagctgagatcgtaacattccactccagcctaggcaacagagtgagactctgtctcaaaaaaaaagaaatgggtcaggaagagaagggtaggagtcaacagaaagcctttgtgtgttctgggcaaaccccgacccaggccatgaggctcctaaaattgggtggcaagagtcaggttacgtggtggccgtgggactgcatgtgagcggggaagatgtagaggacatgagtgcagcttggaggctgttggcgaggccagggcaggcatcagtggagcattgggaaggcagcgggcaggactgtgtgggcctcccgtgtgtggcagtggatgggttggggcatgactggctgtggcaggtcctggggcgagacctgatggggaggacatggggacctatgggggttgagctcggcagggacggcaggtggtgaggatggtggtgaacttggtggcaggggccttgggacgacccaggctggagctcggctgacagaggcccggcccaggagtggagggaggtggctggcgtggggcctccagaggactccagcaagtccctctgcagagccagccctctcagtgggaaggtggtttgaggagtggctgggagtggaaggcatggctgttctgggacagtagcaggagaggcgcagctgccggctccctcctgaaaccctctcatggtcctgccctcagccggctgtcgggaaccttcggaaaggacgtgtccagcctgctggagtaacgcttgttttctttgtttttctccacaggaagcgagggatggaggttgtgcaggtgagtacagaccgcgtccccgtggttctttgggtagtggggcccttggtgcccacctctctgtctctccttctctcctccagcattgggcacggctttctctcttcttcacgtgcagcttgtttttagctcccctgtggatttgatgtggtttctgccctggcctgggcagactccgacaggggcttctcgggtttggagggttgctgtggctttgtcagtggggagagggttggtttgggagtcctgaggggggtgtgcatggcagtggtcaggttagggtgggtgtgggaagggtgagggggcagtaggcacccagctagatgtccagttgtcttgtgctctgtgtagcctcaccctgggtggacttggttcaggtgctcattaactagaaaaagaaggatggatggaagaagaaggaagaatggatggagggggaaggaaggatcttggagggaggggaaaggtggacagatggagggagaaggaaggatggagggagaaggaaggatggatggaggggaggaaggatagaaggatggatggagagaagagggaaggatggatggagggggaagaaggaaacatcaaaatactctcagactctatgtgaggggcaggctgtgttatttgcactaaaggctgtacctggcacctaatgggtacttggtaaacctgatggtggcctggccatgtcctctgttccccacgctgtccccgtggagggtgactgtggtctgtgcagctgggctggcatcccatctccttgtcttacgggcctcatctgcctgtagctgcagagaggggaactcaagctggggactagatcagggcagtggaggtgctggcccctgctagaatatctaaggggctttcaaaaagcccactggggagctcttccagcccacccctgttaacttcagctccaggccttccctcagcggtcataggagagcagcgtccccattcctgcaggttcagcattgcaggccccaggtttcccctgctcctgggaccagactggggctggttgacgggtggggctggtaaaggatcctcctgacctccctcctggtagtttgtgggttgaacttgtcactggaagactgagatttgttttggggtaaggaggtagtttctggaagcctctcagcagctctaggtttttgtccaggctcttcttggctctggagaattgcatgttctgcactagatttttcttttttctcttcctttttttttttttttttttttttttttttttttgagaaggagtctcgctctggagtggaggctggaatgcagtggagctatctcagctcactgcaacctctgcctcctgggttcaagtgattctcgtgcctcagcctcctgagtagctgggattagaggcgtgtgccaccacacccagctggtttttgtgtttttagtagagatggggtttcaccatgttcctcaggctgatcttgaactcccgacctcaggtgatccacccacctcggccttccaaaagtgctgggattacaggtgtgagccaccgcgcccaacctgcattgaatttttctgtgggctttaatttctccatcatcaagtgggggatactggaattcaggaatggcttaggggtgtgtgttcagggaccatttctgtttgattggttttggcagcctggaggatcctaaatctgtgagtgggtgggaacaggggttgatctgtagtgcctgccaggggtacaggcgtggaaagaggaggtgtggttattcatctcatcacggggttagatggtctctaaccattgcacctctaggatgcggtggcttctatttcccttttagccctctatgatggttcactgggaaatccacggatcctttacagatgctgctttacccacaataagcctgagactgacagctggggctcactgtgctcaggaaggccccgggttgccctgtggttccgcccagccacttgggagggtccatgggggaactgctgtgggagccattttcagaggaagtgagttcaggcgctccccagcaaacacactgcctgagagggcaagacagccttcccccatgcctgatcctgtccatacgcgacctcaaactgtcacacagtgggtgtcacccccaccgctcgaggagaggatgagagatggacaggggtcggcgggtttcatttatgtggcattctgggaagatttagactaaaatctttaatccgctcggtctgtgggaggaacaggagactggagccattgtgtcagaatgtccggggcagaagaagcattgcgaaatctttctagacatgtatgctgttcatttaggtggtggcttgggggaggaagtggtggctggggaccagaacgaagccaaactggacactttacacttcagcatctaaaaataaaacctaccacgatacctctctgttcacctcctcctggcatccctgcatttggagaacttttagattttaagacattgagaaagactctgcaaaaacaggaagccaagccacttggctggcttttcaaaatcagctgggcttctgtgcgcaggatctccaggctgctgggccctgggagctgggggtgtttgcagtcctctgggttcaggtgctggtgactgaagaggacacacgtccccttgctgccagccgtcttcctgtgtttcctgtgtctggtccctgaggggcgtctcccgttctgtgcagccacccagggatgatgtggtgttaagtacccttttgaggtggggaaactgaggctcagaatgctgtgctttctcttggggatttcagctggccgtggtggagttgggatttgagtgcaggtctgtctgtctcaaaagcctgtggcccatggttttctgctgaacggtctcctctgcatgttcataggttctccatttactaaatgcttctgttcctcttattacctggactttggctgctatctaaaaaaaaggatgttggggccaagggtcaggactcaagactgcaaaacgctggtgaccggaggtcggttggtcatgggagttgtttctcttcctgttatttaatggcaacagtaacagtccttttattgaggactccagtgtaccaggcatcatgggtttactttaaggaagcatttgtgtgtaaccttcccgaggtgggtgtgggagcatatttaagaaagtggattttgcagatctcagtgtcctcaggtgcctgtgctggaggctgaggagctcgggagcccttcttccctgccacccctgtgcctcttcacctcgttcctcctcccacctctgcagaggattgtgcactctgtgaggcgcagggccgcctggggtcaggttcctgtctgtgtgaccttgggccagttgcttaacgacgctgtgtctttctgctcatctgtaaaatggggataatcatggtgctggtcccctggcaccattgtgaggactgagttactttgggtgaagtaattggcactgggcctggcacactggaagctggctgtctgcaggagaactgtacactatccacaggcagacctgaccgagtgtgagacctcagggcataaaaccctcctggtggtcaagtacagtggccagtcattgtcatcctggggccagggaggtatttccagttccctgcttgcagcaaaattcaaagagtacctgatggtgtcgtcagctgatagcacattaagaatgacctttgttttgggtggctgaggtgggtggattgcttgagctcatgagtttgagatctgcctgggcaacatggcaaaacctcgtctgagggttcccccccaaccacaaatacaaaaaattagttgggtgtggtggtgtatgaccgcttggggctgaggtgggaggatcacttgaacccaggaggtcgaggctgcagtgaactgagatcgtgccactgcacttcagcctgggtgacaaagtaagacactgtctcaaaaaaaaaaaaaaaaagaataatatttgataagagatgactagattactgtaattcttggcaaataattataaaggaatccaaagaatttgctgtggtaaatctctttccattctattttttaaatttgaataagtggtttctgttctcacatctgtaaaaattaaaaaatggagatgaaattgataaaccctgtcttattctagcaacaggcaatattcatctgagaattcatgaaataatttttcaaaaaattcccattcattgtatagatgtatttttaataagatttatttattaaattttacttatttaattttttttttttttgagatggagtctcgctcttgtcgcccaggctggagtgcagaggcatgatcttggcccactgcaacctccgcctcccaggttcaagcgattttcctgcctcagcctcccaagtagctgaggttacaggtgcctgccaccatgcccagctaatttttttttttttttttttttaagtagagatggggtttcaccagttgaccaggctggtcttgaactgctgacctcaggtgatctgcccacctcggcctcccaaagtgctgggattacaggcgtgaaccactgcgcctggcctaattaagtttatttttaaaggttatttcttatacaattttgcaatatatttctgtcttattgatcaattgtatacttatagtaattgttataataattcagtccaggagaaaacttctgacagagctttatgatcacaggaaatcacaggaaattaaaaaaaattaaaacattgatttttgtattttttggccctatagtatataataggataatcagtataaggctttcaagcataaaatacactgtgatagtataaacatctctgagggagatcagagtttgtggaggaaaaaaggaacactgttaaatttccaatggttaaagaagagcttgattatgtaatttaaaaatggatgatggcgaatctctaatcgccgtggtatttagataccattggatccatttaaaagagaaacattaacagttttatttttaaatgttaatatttacagtatgttggaaattacatcctctacaagtatttagacttatgatgagaaatttttcatatcaacttaaaaatgtgcaaatagatatgtagttttaaacatttattttgtgggggtttggtttgaagtccactgcttcagaacattaccctgtttacttctcagaaccaggcctgaggcaaatccttcctcggagagggacagcacgaggccttgctctcaggctgtccagaggccctgatggggctgggctggactgggctgactctggggcccagaactgtgctccgagacttgcttggcagtggacttgtctgcagacctggtctgttgggccacgtgatgatgatcatgaaagacacagcactgtctgctcagggctgctcaggcaggaaaggaagttgcaggggagccaggacccaggtagctcagaagaagaggatgtcctactttgtgtttagagcagggagttgggctgcaggacaagggaagagtgtagtaagggtcgtgggaccagatgctctctacctcctgtcttgagaggctacttgtcatgatggtgatggtggcaagtgcctgtttcctcagccccgtgctctgtagtatggtaatgggaatgctggacgcacgggccaccctgactccaccatttcagtgttgagttggtctcactgagtgctgagctgagggcccctcatagccaggccgtgcagatgggacgcagtaacatgcagcagtttccccgacacttgctatggataggccccaggtgctgggggctcacacaggcccaagccaggccccttcaactctctgtgatgtctgcagacagtggccaaggtaggcagggacaccagacaggcacagaggagggccctcacgcagcctggtaaatcaggaaggctccctggaagacgagtctggttagtggcaatgagcccatctacccaacagatcctaactgagaggcaaggcctgacagagctcaacccagttcctaggtccttgtgcttccttctaaaacacctagttgctaaaatgaccaagtgccaagcacggcactatgattacttcccccgtacacaggagccttggtcgtctgtgatctggggagtggggctggggctctcctgtgggccaggcagaaggcctgcatcagccttgctaggtgctgtcacctgggggcaccttccactccgatccaatctgtggggaaggctcaggaggagcggtttccccatccagggactcactgcctctttctggaatagtcctgaatttggtggaggaagaccctgaaagaaagacccacctgctgccgggccccctccagcctggacgtccttagggaagcatgttttgcagcctgacctctgccctggcctgttctctgggctgcctttccccagttactgtaaaagatcggggagaaggtgactgctggcatgaggggactcgaggtttgactttaaagtgcgaatgagcaagctgtaagtgtgagaagtgcagcagccagttagagattcactgtcctccatccacattccttgagaattcagacactatgaaacccagtctctggtgcggcggctgtttctcaagcaggcaaggaagtaagtaagttctcccggcttgcgaatgagtgaatggtgggcatacgtctttctgtccgtgttttctccagagctggtgctggctggcttgctggtgacctttgtatatgtgtttttaccccttcctgcaccagactttcagggaaggaggttgggtgggtgaccatcaaaccaccaagaaaaggcaagtctgagaaagagacactaagacccaagggaaggtccatgtgcctggggccgaggcagaactgggtgctgggcctctggaggcgaaggaactgtggggatgcccactggcagggaaaccgtggggatgcccaagcccaggggcagggcaggcctgtctgagctgtgggggagtggtgaggacgcaaggctgggcatgtaaggaggagtgggccatcaggggatggaggccatacctcctgacatggaataaactgggcgtaggggctggcaggaggcgaggtgttagaatggccttacagacaaggagcatggccagggccacacacagcagctggggaagggggtcctttggctgccaatggcttggaaaggctacagccccaggcttgagggggctagtgagagaccaggctggagagagtagcggtgccaggtgagttgttcatggggtgctgtgtcgggggcatggaggggcttctgcaggcgaaagctgggtgctccaacctgaggctatgggggaagagccatggggaggatacatggagggtgattagacagggctgcactggaaagcagacagcagggttttctgagaggggctgtggctgcagcctagtgaggggtgatgtgctctccaggggctcctgcagtgacagagggcagcaggagacagatggcagggtgtggtacctgggtagatgtgggaggtgagagggggaggatcagtccccagactcctcccttgtttctggccggagtgcctgggcatgggggtgcaggaggagcagccgccagggagggaaagcccatgccagcactggcgctttccgataggtgtgctgagtgcaggcagcggaggcctgtgttggtagctgctctcggaattcagagccagaggggactcacgtggttgcgtggtgtgcatctctggaaggattataggtgctaaattctccatctcagcattaaaaatgtacttgttatttaggttatatttttacatggtaccaacatttttttaaaaggtatgctgaacacagtgtcaaatgatcaatccacagcggggttccctctgccacccatactctccagcgtaccccagctggctgaccccggtgctcttgatggattttatttccaggtcactggggcataggtaggggtggacacctgtgaacatccttccttctgtcgattttctctgccgtgtgctgtggagccaagcgtaaagggctttgggaataacaatcgctgtggggttctgacgtctttggagctgggacagcccatggtagacttgcggtccacccatatcctgggcagtggctttctgaagttcacgtgagcctgactctgacctctccccagaccccatcatctccaaggaggaccgccacgggcttggggggctggctctgcacacagtgtttccatgtggtcatttgaggccagtaatggacacagattgctcttggctgtgcctcacttccctgtggggtccagagacctgggtttgagtttctgagtctgtttcctggctgtggatcttttccttcctctttaaagggatgacagcgcacaggattgaagacacctaagagatgctgaaggaatattaattgatttttactcatctgttgttatgattaatggtggcatttcagtggggaaaatacagctacagatgaaactgggctgttgagaaagatacattgtttcagtgtggagaatatagtattttttttttttttttgcctcccctctgtatcacttttgggtttctaacaattgtggattccagcttactccttccttttttaaaagatagattttatggtttttttaaaaaatttgaaatgcaggtatttttttccccctaaacattgacaattattttcattctccatcatttactatttgcttaggctatgtagataacaaataagacaaagttatgtgaaagcatgatccccatagtgttttttaataatgatgatacatgaggtgctgggaagggttatataaatgaggtctgctcatagcagttctccaatgtggccattaaaaaaaaatcacatttttcacattttggaagacagcgtggggaaatgctcgtgagttgctttgagtactgtcgtcatactctgagtggtttcatttctatccgttttattttggttcctgagctttttaggtttgctgttagaaatagaagctgtcaccgtgttgcagtcttgtgcagcttccgaagcctgtggcactcagttctagggtgattctttctccagcctttgatgcactgagtcaatttgagcaaatcctttaaaaaaaaaaaaaagttcccacatcccatgtcaagacaacagagctctgccagggcaggtggggctccctgtgctccagggtgcctgggtgccttcttgcaggcaggcttccagaaccccaggccctcctcaccacaccacgcagggttgggactggatctccctggtacctgccacccttgcttggctgtcaaatgtcaagaattccgtggcctcagtggagcgtgccaggtaagcattttacgtaaaagcaaagaaaagagatggaatgaagtacacaggggaaataggaagggatggaacgggggttttagaaagggccagaagcaagattctgctcttaaagtagctgactgtcctggcattctggggtgaaggtatccatagcattgctactcagagtgtgatcctagggaatctgggtgcagatggagaaactcggatgcaaacactggattcctcagcagtcggttcccgtttggcctggtgcagggctgagactctgaggaggaggcatcttgacctgagggccctggactgtgctccttgtccagctgggcgcagaaccatcgtagtcaaagccaggaatggagatgcattgcctcaggtcagttccaaagaccaggaagcgtccctgagtatttcagttgagtaaggacctggcatctccctcttcagccccttccctgctctcatatttttattcatgcttttagaactgctaaatgtcaggtgggtgcagtggctcacacctgtaatcccagcactttgggaggccgaggcgggtggatcatgaggtcaggagatcgagaccatcctggctaacacggtgaaaccctgtctctactaaaaatacaaaaaattagctgggcgtggtggcaggtgcctgtagtcccagctactcaggaggctgaggcaggagaatggcgcgaacgcgggaggcggagcttgcagtgagccgagatcgcgccactgaactctagcctgtgacagagcaagactccgtctcaaaaaaaaaaaaaaaaagaattgctaaatgtcaccttggcagtgacacctaccctgctttcccagcagacgcctctgccccctacacacacacacacacacacatacacacacacacatgcacgcgcacacacgcacgcacaccaagctgagctgcctgttggtgtgtcctcctgaggctgggacttgctggtctctgaggagcacgtggtctggccctgatgtgcgctgtgtctactgggtgagtgaattaaggactgaggtattgtgctacacaggatgtggccaggcctcgagggtctgtgcttgctaaaaataactctagattattcttttgctcattaagtaatatgtacttgtggaaatcttgggaagtcaagataggctcacaaatgaaaacccagagataattattgaagcaatttttacataaaatatgctcctttttctatatgatgtgcattcaggttaggcttttctgtgtccctagttttgccacttgcatttgggggaacagttgagcatttgcctgtgccatttaaacaccttggaaattgctgttagagtggctgcaccagcttcccaccatccctatgtcccagcatctagaaccatttctctgctccagagtctcaagttctaggttatttctggtttgctgttactaacagtcctgccctgggtgtctctggacctaaatctttggggacctaagtcacatctcaggctgtttcattgggttatggtctagaagtgacttcaggattttgttgctaaagaagaaggggagaatgggggacaggttgggctgcagctagtcagctgtgtccagcacacttgggccctggacttagaactggacaggttacttgccccctctaagcctcagtttattcttctgtaaaatggaaataataatggacccagtctcatagagttccaggagtgaggtcatgcagataaggaacagcacagaacctgtttacctagtttgtcctcagaaggagctgtttgtgattatttactggtgccacctccaccaccatcattgtcatcctcagtggcccagggaagcgtgagtctgaatgaggtgtgttgtgtagttaaatgatgcgatgggtagatgagccaaaatgaaaggatctcttctgtttgatttattttcatgagtaaaaaagccagaaatgtctgtagcataagttatgtctgtttggtttggctaaagcagggctgaccagggatgagtctcctgctgtgagtgagtgaggtcccagcttgtcctctggggttagagcagattttgctctggctggggtgcatttgggggcatgggctgatttatgttttccttctttctggatctccccaggtctagccatgatggggtgaaggcatcacccccagggagtgctgacccctgaccctagccccatgaccccctcccgtgctagttcattatgggcaggggaggtcccagggattccccgcacactcatcgtgacttttccaaaagctgtgtaaatccagagttgtaacttggctctgtctttctccttccccttgatccaccctcagctcaagaactcccctgggaagcacagtggctcccgtctttgcctcaagttctctgatgttctgcacaaatggtaggcagagacagccctttcagggacctgattgccctggtgtctagttctcctttcacaggcctgttttccagctcgactgtcaatctgagtctttctctttttgagctttatgcaatggccttagagtataccctataaggagatcccggcttgctggtgcccggccctgcagctgtgtcccagaaacttggcggtggtgcatggggctcactcagcacttctacagaagccgcctggggtggctcccagggttccggtgggaatggggtacagaggcctgagagggggctttgatcaggtgtcctgggggaacatttagagctcctggattctctgcaggaaggccaccagcagccaggcatgatggcctgtgtctgtaatcccaacactttgagaggccaaggcaggagaattgcttgaagcctggagttcaagaccagcctgggcgacatagtgagaccccatctctacgaaaattttaatttttattttttgagatggagtctcgctctgtcgcccaggctggagtgcagtggcgcgacctcggctcactgcaagctctgcctcccacgttcacgccattcttctgcctcagcctcccaagtagctgggactacaggtgcccgccaccacgcccggctaattttttgtatttttggtagagacagggtttcaccatgttagccaggatggtctcaatctcctgacctcgtgatccacccaccttggcctcccaaagtgctgggattacaggtgtgagccaccatgcccggccaattttttttttttaaaggtcaccagccctgttgtctgggcagtaagcacctagtaggattgcttcagagttctagaatgcgcatgtaaaaattccaaagtgcgtttggcgtctgggctgggcttctatgagcagcccaggcagcagcagtgagaactcctgtgtgtgcctcgtctactgagtgccagggttagtgccccacttgccaggtgagaggactgaggctcacacaggtgggcttgtcacagcctagcatgtgagctgtggagctgggattggattctagaggtgtgatggcatagccagtgcctcttctgctccgaagactgcctgcctggtgagagtccagtgactcctccctagttccagctccatccctccaaggctgtgcagtcctgggtagtggcacaacctctctgaggcccatctaccagatggtgatgagatggatgattgagacgaggggagggcaagtgagaaggccttctaaaactcaggccctcgtaggagaagcgtgggtagcctgaggtcagggacagggcttagtgtgctgtgtggggctgtggggagtgggaagctcactggttttctggctcctgagatgactcgaggggtcttgtgaagctcacacccctgtctcactgggcaggagtttggcctccactgtgggtctctgccatctcaggtgggtgggggaccaggggtccctgggcaggagggtgtgggtcctggcttggaggcagaccttggctcactcccttccttgcccaggcagtatttttgccgcaggccctgccaagtagaaataagttatttacagtgttttgacaggatcatcggcagccgggatgggcaaggatgcctttgggactgagctaatggccaaggagtggggcttggagaagggtctggcgtgggagagagatgggagatgggggtggggtgggggcgcacatttactgaacttgttaaatcttgacaaatgccaggcctggccctcccttaagccagggctttggggcctggtgagggcaggacttgatgagttttcctgtcgaccaaatattccgccggatcgctcaggaccctcggttatttttgctgtctgagccctcagtgccttcctttgtccatcagggacaaggacccctgcccacccagtatatcttcttggggagaagatgaaacgccttggtgtatggtaggccaggccctggccttgactgtgagcctggcagcccctgcagcccctcacactgggccaccattgacctgctttacgacttcaaatagcacagacctgccgtgggaccagggcctcctgctagtgcctgacctctgtcctgcatgatgttctgaccctccagaagcaggtttgaaagtgcctttcaggaaggtctggagagcctcctgtgtagcttgtgggaacaaaatgtgttactccctagccgaaggataaccagcacactaaaatgtgaataaagtgtgactttattcatgtcctttgagcataaaaatggcacacacactgatgcattaaaaaaacttttttttttaattaaactttttttagagatggggttttgctctgtcactcaggctggagtgtagtggtgcgatcatagcttgctgcagctttgaactcctgggctcaagcaatcctcccacctcagccttcttagtagctgggaccatggtgtgcaccaacatctttgatgcagttttttttttgagatggaatctcgctctgtcgcccaggctggagtgcaatggctcgatcttggctcgctgcaacctccgcctcccaggttcaagcgattttcctgtctcagaccccagagtaactgagattacaggcacgcgccaccatgcctggctaatttttgtatttttagtagtgatggggtttcaccgtgttggccagggtggtcttgaactcctgacctcaagtgatctgcccgcctcggcttctaaaagtgttgggattacaggcgcgagccaccagccttgacatagttgtaaacaaagttgtggttctgttgtaatctgttcccacaaacacacttagcattctcttagagcttccccctttgttaaatgtctacttaggcttgctttttaaatgactgcataatattatctgattgtaactgaagttctttgattcccttggttgatgctgaccatggttctggtctgtcacctttataaatagtattgtgataaacatccacttttgatactgtttgggcaagcctgtgatgattatttctttgggttacataagtaagttgtatatattgtttttgtagtctgtaggaggaatatgtacttcttggtgaaataaacaaacccctgcattttggggaattacagaaagggaaggtcttgtgggagtttgtgcttctagatttgaatgctgtgttatcacctgtgcaccaggcacgcatacagcaactcatttctctctcatgtgccctccctcccctcctttctcactcctgccccagacccactctctctgcccatgaggctgggggctgtagcctagccgcagctgtgcccatggacttttctccccttgcaattgttcctcaccccagggagaggaggaaggagtggtgggctctggaggaggtgggtggtccccgggtggcctctggtcttgcttcttcccagcaccgagggtgcttcagcctccttgcctggaaaaaggggttgtcgtaacaccaacctctaaggttaagaagggtaattgagatacagtgtcaaagtacttatcacacagcctggccccagatctgtgttgaggaatctgcagctagtggtggagggttaggagtcatttggggaattgcagtccggaaagttaatttctgaagagtatcaaacaccagcttgcatgttaagttgtcttttggagtgatccctccagtgattccctagtggtatggagccagtccagatttggagtggaacttttgttgtgggtgtgggtcactgttccagggaaccccagctacctgaccttgaaccaaaatccttgtcattgtggagcctgtgtccccctctgccttggacttttttacttttatcttcctagttctcataatagctctgtgagatgggatctatttattattctccctattttgcagatgaggaaactgaggctcagatctgtcacctgcttctgtgatatttctagtcacagagctccaagcaccaatcactctgggtctttgaactcagatctgctgttgcctatggcctaggctctttctactctgactcttccatcccctgccccttccccagtgctaaccagacctctctggttcctcataaaaacctcccgtggccttcctgaattttccaaggctaccacacaatcagccccctaataccttgcaagcatgggccttttgcagcagagcagggtcccctccattcctgagcttgtttcactgtccccatgctgatactcgcctgttccagactgtgtaccctcagcctggcctctctcctggtcagggtgcatgcctggcccacgtagcctggtggttctgtgctcgtctctgtggctcaaatttgctccctgtcttctgaccctgtatgtgtggtgacccagaacgtgttcctcttcatattagccagggagcttgcaggaagcagagctcaccctcagtggttcaaagagagccttgaaagcaggggctgtttgttgagctgtgggcagggttaagggagcagcgggggctggtgaggcacctagagcctggcagcagagaggagctgttctgcttcttgggccgcaggtaaggtgaagaaagtgtcgcagaagctctgtgatggtagtcatagcaagccacagccactgcccaggcatgtcactgaagcagggagagagaggggactaaataccccacccccctcctcctgccctctggtctcctgccagtgacccctcttggccaagtgcaactggaagccctggatcttgaatgctgcgttctacggcagtcagcctcccaggctcagagccaggcagtgtggatgggggtgagcagggagtgaccagcaccccccacccctgcctcatgacctgcaccccctccacccctgcctcgtgacttgcaccccctccactcctgcttcgggaccctcaccccctccacccctgcctcgggacccccaccccctccacccctgcctcacgacctgcaccccctccacccctgcctcgtgacccgcaccccctccaccctgcctcgtgaccagcacccacccccgccttgtaacccgcaccgcttccaccccgcctcgtgactcacaccccctccaccccgcctcgtgacccgcaccccctccaccctgcctcgtgacccgcaccccctccaccccgcctcgtgacccgcaccccctcaacccctgcctcgtgacccgcaccccctccacccctgtgttgcgacctacaccccctccacccctgccttatgaccctgtggacctcaaggcagagcagcaatgtgtcccgtggcctctgtgagagcggacccagttcttctgtccctacccagagtcccgcatggccactctggcttcgaccttccagactggccctcccagatgcccctgtggccatcaccccatggctcatttctgtcatcaatttatgattgatcctttaagggagctgatgggcttgcaggcccagggccctaacaggggctcagcccttcattccttctgttgctgggtgctcacccaggccccagtggcaggtcccctgctgccctctagggactctaagatgaccaagtctttgacctcttctgcgtcagtagctcagggagacagacaaccatggggccgcctgggaagatcgggccagggagctggggagggctctcgccgagctgatgggtttctcccacctgtcagtaggtagccccttgagagacagcatgtggtgatgccagaatcgtgggtcatgatcctttttctctccatcaaggtgcctagcgccaccaagcatggtgagaatgaccaggagggtgcctggtgggtgagccctgagtcgtgtggcccccatgggagagcatgaagccacggctgcctgtgctgcaggctggggccgcaggagactggggtccctgctggttctgcctctcctccctgcatggcctcggccgggctctgcttctttctctgtctgacagctgataggatctcatgggtcccgtttcactctcaccttctgtaaatccctgattcttcagaaaacggggctagaaaatctcccaggtgtactcgcacgtctgtttcctttcttagcctttcatcttgaagtcagcttggtgaggttgccctgttcatactgcagaatccagggatctgaggcctctcgccccctgggcagcaagtgagtaggagtgagcaagtgtgtgtgagtgagtgaatgtgtgagtgagtgtgcatgtgggagaatttgtcgatctgcttgaagcaggctctttgggtgctgtttcagcaggacagatttcgagagaacacagctagctctccacgttggacctcgcctgggtgcagtgtttctgtgtatagcaaatgcacacatggctgcctgtgtatgcgtggtggatttggagtctgggtgatgggtttgcacgctgcctctgaccttgaccagccttgtgaccctggggagtcactgtgctctgggcaagtcgcctgtgaggctcataatcctgacagcattactcatcctcggcctatggtctcccgggtggcatttgggagcacccagagggtgagccaggcgctttctaagctgtaaaagtgccctgtgatgtgagcagttatgtgatgtgctctcccagcagcacccagttttggaggctcaggaagcattcccagcagggcctgtttttagccttgaaacatcatgcttgaaaaatgcttgcatggggtttatttaactttaagtggggcaaattctgaaatgggttgtttattgtccaagttgaatttttaatttctcataaattccccacaaattgctatagtacatctttatttgttgaatctgtcagagttgtttatggcactgaagcctgggctccccctgtttgtggactgttgccatggcaacaccaggctctggaggaggggcactgctctgaggtggtatagaaggttctggaatgggctggtggtgtgaagtagagctgtggctgctgcactgagacccagccgtgggtggactgagctgcttaagaccctggttcctcttcaacatcactgcacccctcttggtccctcttcccttgggggtgcactgctgaggtctcctaattctgcttccctaagcccttgctgctcccagtgtggtctgggaaccagtggcagctgcactgatggggcgcccatgaaaaatgcagactcccttgcccccagacctgctgagtcagtctgcagttcaccaagctttcaggcaccttctcagcatgggtaagctgcagaagccctcacatgccacactgcccttgggtgaccccagaggccttggcctggcggttcttggtgtttgccaccgtcctccctgtgatctttctgactccttccccgacagttccctctgcttggccaggagtgggctttgcctctcaaccctgctgcacccaggccactctcctgctttgcacacaccagtctctactcacacagtcaccccagccttctctatctggggaactctggacatcttggaagaggcaactcttgagacacctcctctgtgaagccctccctcctttccccagaccgggtgatgttcagtttcactggagctctcctgtggcctaaacacctcacctgccccagcctcatcaggctgcctgattcacctccctagccgtgacctcactgggtgccccggctgctcctcccgtctgctgggtgctcagaccccagccagcgctcaggaaggtctgtggagtcattgccactccagtcagctggcttcacaaggctgagacttgagtctggacttcttccaagagcctgtactctctgcccggggagtggtagggaccgctgggcaccttcagtttctacctgaggcctgactggcagttggggctaggaccggataaggatgggtccttggactttggaaaggcgctgtgggagggaggcatgggaggggacagctgagaggagtcccgagctcatgcgcaggtgagtgcagaagttcaggtggcatttgtatgtcccttgagtatctgttctgggccaggcagcaccgaggctcgggagagtcccagtaaacaaaccccaaatccctctgccttcgtggagcacttgtgtctaggttgagagactgaaaacagaaagaagtgtgggtggcgagtgaggtgggggagggggactgggagaaaaatgaaggagagtaaggggctgagggctggtgtgggatttgggaacatggcttggttaaagctgaggagatgctgaccctttggccctgcaaatcctccatggcatgtacccaagagaaaggagggctgtgtccaccaaaagacacgtgtagaatgaatgttcccagcagcagcattcctgatggcctcaaagaggagacagcacgcatgcccattggctgtagaatgggtacgtacatgacctgtgttatcatctggccatggagttgtatcgaatacagcagtgagaatgaaccatggatgagtcccataggcatgaaacgtggccaaagatgccaggtgcagaggcgtattcagtgtctgattccatttacatgaagatcttgaccaggccaagctactctctggggacaggaggcaggctggcggtcacctttggggacaaggtgccgggtgggaatgtgaggagcctgctggtgtcttgcaactgtcctctcctcagtcttcctcttgggtgccagtttgtgaaatattcaagctgttcacttatggcatgtccttcctttcttatgttatacttcagtgaaaggcttataaaagaaagaaacagaaggggaaaaaagccatgagaggcagagagagtgctgttttctgtaatatatgcccttagattctctagaacattggttctcaagccaccgtacatatcaggacatggccaccgcccctcctgaagctctccttgccaggagtgatgcaggctccgaggatgaaccacctggtgagaagccagtagccccagcggcatctttcttgctcttcactggactggagcctctctgtaatcaagggagtacatgttctgtaccccctggcccagtgtctagttagaatagacagtgagcatttacagattgaatggttttttgtttttttcccaatggttttagcttgtctttgggaatatagggtctgtttctgggcatggagaaacagggttccctcctgtgctttaagtctaacctccaagccagagaggtggtactggcaggagataagaccacccgttgtctggatgctgttttccatgcagcagacatgggctccagtttctgtcaatcagtttattaaaacctgcgtttattacttgtttgccctgtgccaggcactgggctgtgtcttagtccagccccacagtaccctgtttacagatgacgtcaaagcagctacacgtgggtgactggctcggttcacttgctagaagtggggactctacctctaagtggggtgaatcccaggctagcacttgacccactgacagggtggaggggatgtggggaaagaagatgttcagtcagggttggatgcatgaagtgctgggtgggctgccaggaagtgcttctaagcctttgctcttcgcttccttccccgaccccatctctccctacttcagtctgacttccctccatctagaatcttcccagatgactccacaactgggtagttttacctgctgtttctgaagcctggctgtcccgtctacctcccaaacatcagcccaggctccagagactactggaatcacagtcacctgggagattgatttttaatagactctattttagagcagttttgggttcacagcaaaattgagaggaaggtgcagagacttcccgtatctgccctaccctgacacacatgcagccccccttactgtcaacatcccacgctagcctggaacatttgctacaatcagtgaacctccctgggtgcatcaggatcacctgaagtccccagtgtgcatagggctcactcttggtgttgcacattctgtgggtttggacacatgcatagtgacctgcatctaccattaccataccatacagagcagcttcactaccgtgaaagtcctctgcaccgcctgttctttttaaagcacttctaaaaagaagtgctgatggggtggcatcaattatatccagatctctggggcagctcttgagcactggctgtcatgaggcccccaggacaacaggcagccgggagaggggcgggtggggaaccactggattgaagtaatggttctcaaactggagtgtgcactggaacccccagggagcacatcttcaaacaggtggctggccccattcccagggtctctgaaccagtaggtctgagggggctgagaatccacatctgtaacaggtatccaggtgatgttgaccctgcttgtgagcccctctgtctgagaaccactggtttttttttattattattttttattttatttttattttttattatactttaagttttagggtacatgtgcacaacatgcaggtttgttacatatgtatacatgtgccatgttggtgtgctgcacccattaactcgtcatttaacattaggtatatctcctaatgctatccctcccccttcccccctccccccaccccacaataggtcctggtgtgtgatgttccccttcctgtgtccatgtggagaaccactggttttaaacagtggtgacgaaaggtgtggttgggccagatgtgcctgctcagaaagccaccagagcgctttccaagtctttggggcatctgggagattgtgcccggcccctttcccagttctgagtgagggactgaaccctgggatgggagatgtagggctgtttcctgtaccaccagccccttggggacctgggtttggagggagggtggtggtgcgggcaggtattatattgaatatagagtgagccagaaggccggtgaggcttgggggcgaacttccagcccactgagtcactctcaggccgtctctggccccactgaaggatctcccgtccccctaccccactgggggttcctttggccctcacagaaggacagataaggcccccagggtaagaacaacccagaccaggcctccctgggtcagagagtcagccagggcctggtatcgagacttagaccttggagagcttgggattatgggagaatcaggctgttcttcagacaacaggccgccctagatgcctggcgtctgttgtaataaaagacctttagtggaaactaagtctgttgcctttggcctcctaggagcccagcaataaaatcagtgtaaatagagctaacatttgggagtggtttataaagcacttgaaaaaaatccctcatataaacccaaagacagtcctacaagctgcagggacaattaattatcctaccttttggatatggaaattgaagttgagaaaggttaaataacttgcccatggtcacagatcttttaaatggcagagctgggatttggcctggggactctgccacccaaatctctgtgctttctgctgtcttattccccttccaccacgtggcccctccaggcagagatgaaggcgctcccctggtgcaagctccagctacaaaagggtgaagatggtggtgccctcagagtggaatgtgctggaatttctcacaacagagttgttcttgaaataggtacttattcttggcatttcttagccaaaaactgcagaggtgagtaccccatagccataacagtggcagggattagggagtgagttagcgttacaatggaagggcttccgcccaatctgctgtcttccattccccatgctgagacatttggaggcacagggtggtttccggtctcattgaattggctttcacgcttggctatgaggcacccctaggggttccttgaaggggtacctgcttttcaagggggatgagttgctcaccactcccttcacctgagcagctctttcttttttttttttttcttttgagacagagtttcatccatcacccaggctggagtgcagtggcatgatctggactcactgcaatctccgcctcccaggctcaagcgattcccctgcctcagccacctgaatagctgggattacaggcatgcgccaccaagcctgcctggtttttgtatttttaggagagacagggtttcactatgttgcccaggctggtctcaaactcctgagttcaagcgatccgcccgccttggccttccaaagtgcagggattacaggtgtgagccacctttcccagccactctctcttgatctgtgtttgatctggggtctgcatgttagatttcatttcaggaaagacatttgaggtcagagagagtttgaaaaccatggtgtctggggcagaatcctgggatattcagctcccccatgcctgggaaattgaggcatgtgtatgtgcagagagctgtgggcctgccaggtgcgtgatgactgttggctgtcaggtcctgggggtggagtgtggccatcaccgtttgattggttccttgtccgtcaggtgtccttctgagtgcccaggcaggccgggccctgtgctgagcactgggcacatagctgagagcaaaactgccacatcccggtccttaaggagcttccagtttagtgggaagacagaatctgtcttggatggactttgagtctcttccagcaccgcaaggcgtgtttattaaagagctgggcattggactcgcctgcacaggtacctctgccagctctgcttgctgatgggccagtgacactcacttcctcccccacacgtgtgggcctacccgatgctggcgactggaggtctcggtaggtcagccatggggtcactgaggtcccgtgacttggctccctgggtctctaaccattcctcacctgaccccatctctccagaattactcttgtggacccccctcacatccagggcttggatttgtcacctttctgggtggagagaataaagggaggaaacacgaactgaggtggggtgcaggagccaaggcaggccctcaaagtgtgcatcgatgccttcaaaagccagctgcagtattcggccacctgcgatccctgggtgcccgccatcagcccttgctcctctctcttgccttggataggacagaagttgacacttgggggctcttggagaaccatttggagcacgtggaactcaagagtgaatcacttattttttgctgtgtggcagcagggcctccctagacaggacatattcgggggcttgcagccaggtaggggagtggaagtacctcctctcaccccacacacgggaattggagatgaggcagccgatcctgcctgcttgagtctcagctgtcattttccaggctggcagcaccagcaggagaacccgtgtgtccgccgggctttctttaaaatgcaccgagtgcaacccagtcctccttgtgtaaactttctccaactggccagatggtttgcttctatttaaggcagtgagagtatttcctacggcctgctgccccctggcctttgttttgccccgggaaggccattcctcgaaagggaagctgagcaggagttgcacttcccagcagcagggattgtcggcgcccacccccatggcaggcctagaacctttgccaagtgcctctgcctggagggaccgtgtttgtaacttgactccctctgtcccttccaaatctgcttgtgctgtgttttcttagatggtcatgaaggtctccccccatctcccaccccagctgccagcccggtgcctctgtccctccacatccacatcttttctgtttccaggttctgttgatttttccctctggatatttccttacccaccccccacccccgtccttctgttctgtgaccccggtcagtctcccagtcccccttacccattattgccaagcctctggctggcatccccagctctgggctctcccaccctcagtccagcccccacctggcagaatgatctttcatcgagaatatctgagtcactccactgatctaacctttcctggcctttcattgtctttaggttaaagtctaagccctggagaatggtttatgaggcccttcccagtttggtcctgccagccaggcagcctcaccccctgccattcccaactcagacaccagcaacacctgcgcactctctccctgcctctgcacttgctggtccgacctactccagccagatgtcacttgctggcagaagcattcctggcttcccctctgtcccctcacctcctctgagccgactgtgtttacctgtgggctcctcgcaggcactcaccttggtacttagcacagagccctgcatgcaggaggccttccacacaggattcttgtgtattgctgactttccccccaggtctacctagaagccacagaaggggttttgtagggcttttaaagggcaaatggaatctgttattctttagtatcattaatatctgcaaagtttccttctcagcagatcttcacttctcattgtctacactgtcccttttcctctgggtggcagtgatgattggcctgagcctgttatgagatgcttcattcccagcctcccttgcagtgggggtgcccatgttatgtgcacttctaaccagtaagacatgactggagagagtgtttcttttttttgagacagagtcttgccctgtcgtccaggctggagtgcagtggtgtgacctcggctcactgcaacctctggctcctgggttcaagcagttcttgtgcctcagtctcctgagtagctgggattacaggtgtgtgccaccatatctgggtaacttttgtatttttagtagagatggggtttcatggtgttggccaggctggtctcgaactcctgagcttaagcaatccacccaccttggcctcccaaagtgctgggattacaggcgtgagccaccgcgcccagctgggaaagagtgtttcttctctttcaaagggttggctatttcgccctggccccttcttccccgcttccagatattttgtgggagtatcaggagctttggcagctgtcttgtgagcgtgaggcgacaggcacgcggacaaaggtctaccatggcgagcatggcagaatagaaacttgaaaggagtatgggttcttgctgatgtcaacctgttgaaacaccctggagactccactccctcctaacgttccgtccttatgattaaagccatttttagtcaccacttaaaaccagacacatcttcactcatgattctgagcttgttggaattgttttttgttatacgaaaaccaaatgcacccttgacgtaaagactggccatcattgaaacaaagctttgaaggccgaaggcgcttgccaaagagaaggatgccagtgctttgagtgttactaccatcgatgtcagaaatgtaggtgcccaaaaggatgaccgttgggcaccctgttcatttggacatgttatgtcagaaaacaaatcataccatgttcaccatgttatgagaaaatgtaaagcctcttcaggttgtaagtagcagctgtcaatatgaaagaaaaatcttaaggaaatgtcaataaatagaatttattggcctgaatgtctcagaaggtccagagataggtctggcaggtttcaggccattaagaactcacatgtattgtcatcagaaatatttcttcacttttcatgctccttgtgaaagtcattttgggtgggcttgtgccaagtcatgtgaaactggttgcctgcagcttcatccccttggcttaacagccctgcaggaagcagatgtcgggctggctggtgctggctggctctggttggcctggcttgggtcacatacatatcatatttgcctgctaggaatgccataacaggtcactgcaaactgcgtggcttaggagaacagaaattcactctcagttctggaggctaggagttggactcaggatgtcagcagggcactgctccgtctgaagccccgaagggaggagccttccttgcctctgccagcttctcatagtcccaggcacgccttggcttgtgggagcatcgctgtagtctctgcctccatccccacttggccgtcctgcctgggtgtctgtgtcttcacctggctttctccttttcctataaggacactagtcatattgaatcagggccaaccctgatgacctcatcttaatttgattatatctgcaaagaccctgttttcaagtaagatcatgttcataggtaccagaggttaggacttcagcttatcttgttgggggacaaagttcaacccatgacacctgtccttgggctggatgacatgatactctagctggccaggactgtatcacttgcccaccccaaagtgagtgtgggtcaaccccctggagttacgtggcttaaacgtcggggaggaaggttcttcaagggaactaagttgagggcagtccacagatggaaacttggcaaaggcagtggtggtaatggttcaccagcagcccggcttggcctgagggccccagctttccagtccggagtggtccattggtctgattcttctctcccagttcggtcccctctttcctgacttccattctttaactctgcaggagggggcgcttagtttagttggaggtgaatggagagggaagggagacccaaagcagggaggcccttgtgatttccctaccagccgcctgctctgggctggagcatgggcctcagatagcctaggtgctgggctgcatgtgcggccttgtgggagttccaccgagcagagcttctgatgggggttcgcagcctgggtgggctagctagtgaccgagctttgatggtaatgaaccatcgtttgctgcttttattcattcactagtttttcatctgctgtgggagaaggctgtgggagtgtgcagtccgaaagaaatggaaaaacaccagtctcctgtttctgccctgtgctttccagttgaccactcatttggagatgtttctgtttgcttgtgttccccccgccgcccccccccgcccccggctgctgggccatccctgcttacctagcctttttctgaaggtcttgaagcccagagcacttaggaaagtctgagcactaaattgcgtcctgcccaatcaccatatcctgtgtgtatgtcttatctcctttatgacaggaacatggttcatagttgcctttatctggagcacatggggccatgtgggaaaggaagcttgagccaggccaaccctgtgcagaccctgctgtccccaccgtggggccccgggctagcgctgtttctctgagcctcagtttctacctcctcagaatagaaaatgggagtagcactaatggttgagatttctctcagccaagtgtctgtgagtgggtttgtgcatgcctgggacctgagcaatggccacaagaaagtcctgtttggagcttgtggtcagcctgggcgatgaggtcaagatgccctgagagtcaggagggaggggtgcggcttgactgccccagaccacactgggaggtttgcagaagaaaagagcgtggggtggggatggggtcaaaaaggactctgtgtgtgcctggtgagggcttgaggcccggctcacagaccactggtggacccgtcccgccagagcagtgaccgcttgggaggcagtgagctgtgagtgtggaaaggaagtcggaggcaacgtgggtcctcatttgggggcactggggagcgattgaaggtttttaggtagttgcagaggacagtttcagggaaggtattctggcagttctggcccagggtggattgggttgtgtccaggctagaaactggatcctgaaattagttctgaaagaataaaaaaaaaagtctgaattagagagtatagcttaattttaattactggtccttgttaattagttctctgattgcatgtaagccaaggtctctaattggattttcttagatagggtttcgctgtgttgcccaggctggagtacagtggctatttcacagatgcaatcatagcgcacttcagccttgaactcctgggctccagtgatcctcctctcacctcctcctcctgagtagctgggactacaggcacgtgccatctaattggtttttaagtgctgtcagtacgtttcagggagactctccacccactttgcgctaatcttcccccatcctggtgatttgctgtagagtctttgttatggggcaggggcagcatagcctacttccagcctctcagtctgcggcagtgctcttcagggtcaccaggggagttgaattaaaaggccactctgacctggcctctgtggtttcctggccggctgcatggaccagccctcaagcgctgcgggaggcagagctgctgactggcagggacaggggcctgaggtcttgcccagaggggtaactggcctctgcttatttgtgagaggtgaggcttggaggtttggtttgatcttgatgccctgtgcctgcaagggcaaggaaccagtgcctggtgacttggaactaaggcacagacttccatttcaggctcaaaagcagcatggcactgggctgcaaagtcagggatctggttctttaaggtagatcttacaggagggagaccttaaatgcccctttcttcctgatctgacagatcctagagccctggggcctgccctggccaggagtcctggtgctaaaccctgtcaggttggtggggaaagggcatttaaggcccttaccctgttaagatatatcctaaagaaccacaaccctgacttgcggcccacgctagtccgtcacggtgtcgggtttttcttgcttcttcctcttcctcctttgctagccttggtgcttgcggtggcccttctggccaggccatagacagaggccacacccttcttccctctctgccgtgttgctgtccgctgggccactgtcccacctcctctgagatctacagccccacagggttgggtgatggttgtcgccacattggtcagttctgcatctgggtcagtcccaggggcttgcatggctggctgtcagtcctttacctggggggccctgtggctcatccgtggccctcgagttccagagtttccatctgctgccaggccgagtgcagcatcctcaccagcttcacagccaagcagagggatgccagtgttcggcctaggcttcggtttaatttttatgctagactttctcagtaatcgccagcacaaacttattcatggtcccttccttgtgtctggatttcagctttcctatctctgcggagggggttggaccagattacacgtgggtgactcagatatacctgggcctgcatgcaatctgtttggcccacacaggaattttacattctttcctttgaatttgttgccagtgtttaagctggttgccccttaggccccaccattctctgttgtcccacaccaccagcctcatggtttacatttgccccatgggcgcttcagtttgtgaccctccatttgctcctaggaccccctcctcacctcccccccaacccctcccacctgaattcctcagtaccctctggctctgtcttcccagggtgatgggacagaagaggagggaggctagagcctagccatccacaagccgggttccagaatggttggatttgagaaatctggtgaaggggaaaagatttttcatttgcccagaactcagggtagtggacttggggcagtaaaggtctcaggaacagagttgaagccagaactgtaggaagatgtgtattggggccttcaggtgggcggcaggagaggaagggtggggctgtggtctgggaagggcctcctgcaggatgccagcctgccaccaatgaggggaaggagaacggtggcctgggcatgacgtgcgcttggaacagattcctggtgacaccacccccagccttggggcttaaagattgtggtgtaatccaagcttgttttaatcaagccacagataagaatgagccaggctgaggctggctacggcctgagtgcacattcctgcctggtgcactttgttcttcatgtaggtggggctgggcggggcagggaggctgccctgctgccttggacccaggatggcatttcccctgcttgacagggacacttggaatttcctgttggaagtagccccaaaggaaagagtgcctgatgggttgagccttggatgtgttcggtgctttctgcagtgactccacagagcactgggcttttgcagtctctactgtgctgtcttcggctttcccactggtatttcctgccctcagaaatccacctgccccacatctcttttctccccttctgtctgtgcacataaactggggtggatttcaatccgatctccttagctgtgtgatcttgggcaagttattttgcttctctgagccccagcttctggttctgtgtgtgctgtgaaaccacctgtggcccacgtggccaatcctgggtcaatatttttttaaccaatgacaagaagtttctaagggttttccccaaagtgtgggcctcggtggggagctggcagtagctggatgagaaagagtttggacttcaagtcaatttgtagagttaagattgaaacttttttttttgagacagtctcgctctgtcaccaggctggggtgcagtggtgcgatcttggctcactacaacctccgcctcctgggttcaagctattctcttgcctcagcctcccgagtagctgcgattgcaggtgcacgccaccatgcctgggtaattcttgagtttttagtagagatggggtttcaccatgttgctcaggttggtcttgaactcctgacctcaagtgatctgcccaccttggcctcccaaagtgctgggattacaggtgtgagccaccgcagccagccatgattgaaactttaatttccttctccttgtccgaggcccttctccctttctttgcccaccagtttctccctctgagcgctgcagccaccccacaagccccagtgccctgtcaggcccatcaggacatgcaggtggggcactggcctgagttttggatctttgcttcaaagccgtgttaagtccagctctgccttgtcccagttcccagccctgtcgctgttaggggtatccgatcagcaccctcaaaactagagagatcgcagcctcaaacaaatccttttggcaaatggctgcatgttaggagggttttggtgacccaaacatgtgccaggcatgttccaaaacccccagcatcaaggcccactcagggattagggtcgaagctgcttggctggggagagagggactgtttttgttcttagccactttctgttcacatatggctatcattcactgaatgaacgtttactagaacagcagggtggcggagtagagaaaacgtgtttccagtttgctgtacctgtgtcagaatcttggatttgttactgtgagattcagggcacttgagtcatttgttctctagaaggttaatttcctcaacttataaaataacttgatttgtacctcctgcagtgggtgttgtgaggactgggtgagaggaagtctgtgaggacccagcatgacacctgcacatggcagctgtgtggtaggcggtcactgctgttgtcatttagtaggtggcccttaggattagacaccgcgggggacacaggctgggtgagatagggtccttgctaccaggaacatatggttaacagggggctgcaggatagatttgctgtgttttgggagttcctagcatctgaaccccctctgagtttacatctgaggattctcttccatatgtatcttggaggccagacaggaaaggccaggaactcttgtcacctgtagtgctgggtgcgagcacaggactggggcctgccagccagacccaccccctggtgctgggattcaggaagcaggacagggagcattcgtcatggtggctcagtggcagaggcaggtgccagatgggatgctgagccctgtgtgcccgggtgtgggctgggcaggggccttgcctgcctgcctgcctgccacagggcctactttcactgtgcttctctgggtgaacagcctccctggcagaggcccggtttctgagcgtggctctcccagcttcctgtgttttctgacctgcacagtggccttttagtgaggtcccttgctgctcaggtcagccccaggaaggttctggtgctcacatcccagaacctgctggtctctgggcctcagagtaactcatactgagaggagggaaggatgcccaggcaatactgtgcagagacagggttgccacttctggccgcagggaggagtcagagaagacttcttggaggagggggcatttgaaaggtactttgtaggacagagggcctggagggaggttcagatcctggccgggcagtggaagcctggcccttgccttatagcctctttgaaatgtaaatgatgctagtgcctgtgggatagggcctttgtgaggagtaaatggttgaggacagcgcctggctaatcactgatcaaaatagccccctcctgacaggggattaggttcatggctgtcgtatatacgagaccaaccatctccccccacactctgtattgatggggagtggtagagttacacttctgctctgagctcagtgcatagacatcctatcttgttgaatgtgcacgacacctcgagatgtaggcaggatccttccttttttacaggggagaagacggggccttggtgaggtgaagtagttcccagggccttccatccaggtgatggagccaggaccttgcttctagttctcctgcctcccaagcttggctgtttcctacagctgcatacggccccacccagagggaggcagtcaccagagaaagagaatggcagtgacccagagggggcacagagctacttcctgctcagggagtgctgggcagcctcctgcgggggggagaggggggcattgaatgggcccttcagagaaggctgggagctcaccaggtcctgaggaagaggagggactgcgtgcaggaagcctcaaggcacgagccagcttagcatttgggggaactccaagtatttggtgtatacagtgtctgcagggtgcctgggcaggggtgttgggccaagcggtgtggcaggggaccatgtgtgctctggccaggggccttgacctcattctgttggtggtgagggcctctgcaggtggggagtggcaaagtggaccaagaccgcctctcctccactatctcccctccctacccctgctctgtccttataccccaggccacagtgaaggacattgggccgaggccctgctttcataggaggaagcaaagctctgcttcatgtagctgaagcccaggctccccattgtccaccctgacacagaccctctgagtcctcagttttctggtctgtaagtggctatgaagtctgtcttgcttctcctcccagagaaatcatgagcataaagagcctgccagacgtgtggatatgcggttttaaagattaaggcagtttaaccaaaaagaacaaaacattggctgaattaatagaagtggcactgggcgttcttcccgtcagcctgagttggaggtggggtgcctcccagcaggggctggcaggagcacccgtgtgcgctctgaccccatccagagggtttctgggtgccctgcacagcgggacaccctctggaggaggccctgtggggaggacagagggccagtaagaacactcagtggccttggagaagcaaaggtgtcatttgtcccctcccaaccaccctgtacttcctgtactgaaactgacagcaagggagactttggcagggagaactcccagtttagctcctcaagtgtttttgaggctgaataccagcctgacagcttgctggcctgctgcagggtgtggggctgagacggcctcagcgacttatcacagcgaccctgtgaggtgtaggtgcgtcctggtcccccattcagtggtcacagaagcacagtggggtttaagtgaccagtcagatctgcgagcagcggattcaagattccagagtctggggatctgacaccaagcaccttgggctggtaaagatacaaagtctccagcaggcacagggtggaagaggaggtttctgtttttaatttttttttgtagacaaggggtcttgctgtgttgcccaggctgatcttgaactcctaggctcaagtgattctcctgccttggcctcccaaagtgctgagattacaggtgtgagtcaccatgcctagcaaaaaaagaggaggcgtcttgttgacatggattgagagaaggttgagtagctgagaaggagagagaacagcctctgtagaacaaggaggtggggggtgtttctgggtatggtgagcatggagcaaataggagagggagcccaaagcatgctggggccagagcctgcccaaaaggcctgtgcccagaactctgggcatcgtttagtaggaaaggggaagtcagtggtgggctcttgagtttggcagcacccccgtgagagctgggcgtatgcaggcggacgctgtagccatggcagcaaggtcggcggtggtagcaaagggaacttaactcccaacttgggacatcttttggggctcagttcagagaaaaactgagcaagaaataggtcacaggttttaggaacggtattagagtatcttattttctggcatgtccaggaaatgccattttccactggatgcattttttagatagttgcttggcacttatgtctttgtcttcagaagaatggttttccggttttaaacacatatctggctgggtgcggtggctcacgcctgtaatcccagcactttgggaggccgaaacgggtggatcacttgaggtcaggagttccagaccagcctggccaacatggtgaaacccatctctactaaaaatacaaaaattagccgggtgtggtggcacatgcctgtaatcccagctacatgggaggctgaggcaggagaatcgcttgaacccaggaggtggaggttgcagtgagccgagattgcaccattgcactccagcctgggcgacaaagtgagactctgtctcaaaaaacaaacaaacaaacaaaaacccacatatatcccacttttctttcccttccaaaagagagtatatggatataatttaatcatttttcctgtgttatgtataattgtacaattagaaacaaccaaacattaaaaggtagggaattgattaaataaattatgcttgatttaccttttaatgataatgctttagaagaatatgcaatgttggctggacgtggtggctcacacctataatcccagtactttgggaggctgaggtgggcagatcacgtgaggtcaggagtttgagaccagcctggctgacacggcaaaaccacgtctctacaaaaaatacaaaagttagctgggtgtgattgctcacacctgtagtcccagctacttgggaggctgaacctgggaggcagaggttgcagtgagctgagactgtgccattgcactctagcctgggcaacagagcaaggctccatctcaaaaaaaaaaaaagaatatgtcatgtcacaggaatatattccttatagtttgttaattaaaaagtaggatccagatgtttgtgtagtataatttcagttttagcaaagataaatattaaaaacttggaggagtacgttatgtaatacaaatgttacaggctatctctgagattaagttaaaatttttcgatccctgagtaaataactggagatataaacatctcttacaatggacattaatttgatcagagaaaaaagacagtttttttgaaaagctgtattactttatagacacagctggtatctttattctgcctgagtctcaccatctccactgcaggaggcagctgggtcatgttaagggttcctagagccccaggtggcactcttctgtcttccttgtctttaacatccggaccacaccttgtcaggaagctgagtttgaatctcagccccgggctcgccagtaggagttcttgagtcctgggcctggccttggactcccgttgtgaagtgggagccagccttgcaggtggctgctcaggtgagcatgtaaggtgcatctaggtggctggggcctggggctacatcctgaagcttacctgcgccttcagccagtggctgctgtttattccagcagtgaaacccaaccgtcacattccttgaaatacctttaataactcttaccaaattttgaattttcagtgagtttgaccttgaccatctgtttgaaagaaaggcagacacacacccacacacacccatggtgaaatgcaggcaggatctgacgtcctaggctgagaaatgctggtctcctcttttcctatcaacactgccctgttgaccatgcaaggggcatggagatgccattgtcccggggtcagagggttggcagggagaattgctgtggctccggggcttcctgtgtaggccccagggattgggactggcctggctcagagcaggagccacccagggagcaggggaacagccttccagggcctccctggtccagctgcctgggcctgcaggctcttctgaggacagagccctgataagtgagggtcagtgcccaagaaaaaaggagcattgttagggggtgggggccgggggaacagccagggcattgtcgccgagccgggaggctctgtgtgttccgtggctttcccagctctctgacagtcacaagcactgaggtttggggcttccaccccttgacagcaggtaggtccctttttggcagctgtcagcatctctcagcccttctctgctctgctctggggggatttttcttggcatttccaagttctgggggctgcatcctcccctgcggtattgagatgagtgggagagaatgcggtgcgggttgttggtaacgatcccagagcccagagaataggggcagtgttcctgggggagagccctcacccggcccctggggtgctgagcctggtgagtcatgaggggtgtgggccacagaacgccggggagagtggctgggggttagggggtgtggagaggctgccaccagcaaacagcaagagccgtgggggtcaaatggggcacgtgctcccaccagcctctcggaggaggtcacgtgtttgtcattgttggctgtgtctgacgtgcgggaaagcagccgtgaatactgaggagcctgtcacatttgttctctcagcatctttggtttatcttaaacctcagtgagatgtttgcagttcttctcacgctgtcacagagcatgaccttgtggcctcaaccggatgccctttagacattgcagtccactgcaccatgtggacctcctggggcagggctggttgctataggagcggcccttcccagtaggacggggacagtgtccctccggttgtggcctctgctccccgcagctcttgaagttaccgaccttgggctcctgggaccttgggctcctggggaggggcaggtctcactgacgccaccattgctttcgtagccctttcttggaaagggtggccttgggcttggcgagtgctcctcccacctgtttccaaactctgaggatgctcctcaggaattagaacaattcaaattagtcatcacgtgccggagtcaggctgggaagaggcagccacttggcaccacatacatccacctgggcctgccacccttagcccaggccttggacctctctggtctcctggctaggccctgggcccagctggtttctggtgggaggtgacaggcccagtaactgaagcaggaggctctggtccagaccgacctgggtgggttgaaacctgcctctgccacctcctggtacccaggagggtgaggcagctgttcacggtgctgtcgggcaccaggccctggacagccatggttgttcccattctgggcctcatgcagtgcctggtagaccactgcctcccactcaccagtgtcacagcagccagacaggtttctgcggcctgagccccctccctccctccctcccgtcctgtttcctaggcagcatggcctctttggccatttgttgacctcccattccccttggcttctcagtgcagaatttccatagcacatcagtctgcactggtgatttggggctctctggtgtacatgtgcagatatacacacccatgggagatgagggaggcattccactgtccttcaaggctcagcttacctgccatctcctttgagtcggcttttgactgcccagcgtgaatacctgtgcctgcctttgtgtgctcactgcactcttttgggtcattctggaagagcctccattttattttgcctcactggcccaactgccaaccatgtctgcccttgaggccatccctgctgccctggtgcagcatgaagtccacagcgagtgcctggtctctatttgttgaatgaatgtctgcaacgtaatgtgaccaaggtcccacagatcagcatcctagtgagctgagagctcaggtgagctcatctgtgtgtttcagagggggtggtgggcagaggacagcaggctgttgtcctgaagcccctagaacctagcggagaagaggcaggacccaaaagaaggaggtgtgttcaccctgtaggacttgctttgtaggtgcaggtgcccagaggccaggcccgtcagtgctacctggggtggggctggagaagggaaggcctgccaggccccataggtgatgggagggccaggacctcaggttggagggaaccactgaatcctcggccctgtggtgcaggcccacacagggcatagcccctgggcactggcactgcccactgcccactgcccgtgtgtgctggggccatgccagccttctccgctgctaaactggcttcttcaccctccctcagtgggcacagctgccgcttccatctcagtgtctgcttctcccttgcttggtgggtcattatgtgcccacttagccataggctttcactgagtccccaccttcatgcaggatgtgggaggtcccaggggcccccaggcagctcaggctggcctgccctctagtggggagcagagcagacagatctcccagcccagtgggggccagctgtggtggagcccgcctccccattctattcttggagaggaaaagcacagaaatacaggagtgaaggcacagactgggcagaggggccggagtcgccctctgaggaggcctgtagggcccccagaagagttttctgggtcagaatcaagagactcaggagcctttttgcattttgtgagcccagtcactttgcctctggtcagggtaggttttccagagcatcttcctgctccgacagggggtgggggagtgttgggggtgggtggtttgccatgggaacccccggctgctgcaggtgctgtgtggctgaagccacctcccagttcagtgtgctgggggcaggatgtgggggagggcacctgggaggaaggtgtcggggcagggcttaccagggacccatggggaagtattagacggcttttggggctacactttggatagggagctgggggctcccagcatcagagcccactctttctcccccattcctgagtttggaaaaaggctgccagctggtgcctcacccctgcccctcaccagaagaggtcctgtgcttgccccctgccccatcctcagtccccagtcccacagctgctgtgcagtcctgcttctctttctgtctcctcccctgcatcattcctgccctagctctagacctctccacctagctacccctgtgctgcccgagagccctcctgtgccccaccacacacccacatgcacaggcacgcacattcacacactccgttctcttccaggagaaaccctccctggttcctgaggccctggggaccagtgggtgtgtgtctgtctctctctagcgcctctttctcctctctgcctttccttagacacgtacctcttacctcctgtctggcctggcttcctccatgaagtgctgtttggttttctcagcaggagcctcccagccccaaggctcccactgttcctctaccagtcctgtcctggggccctcactcctgggtggtcactgttgactgattactcatcagtggtccctctctagaccctggttctgatgtctgtgctcagcagggctggcccagaggaggtggtggggaatgttggggggcattggctgttgtggggctttgaggaagcctccttccttctctggttaggaagttattgcagcagatccagcttttcttattctccttttcacaaggctcacaggtcacatggctgctgcctcagagtccctgaggcactgctgtgccaatgcacagttggtttatcttaacatcacccaccccaggaaacctcccttgaccctgtccctaggcctggctgagatgaccttcggtcctactctcacctgtaggattgcaggaataacaaatgacacttaatcacaggcctctgagcaaaaactgggacccaacaaatttgagtgtgctgatttcatttgtagaccctgggaaaaccgatgcttatacctttcccaagccctggcagggcattggcacagatctgctttcaccctgagtctctctaggtgtctctgtgtccatgccttctcagcagctcacaactgctgcccagggagatgaagcccaccagctcctttgctaaagggctcaccccctagagaaaagggctggctttgcagggtgcacgatccgatccgtgctggcctttgtcacccgattccctgagcagctgctcagagctgtggagtacgctgcagtctgcagagtgcgatggccccttcgtgagtcccagcaactcaccagggtcacagccagagctgggtggacatgtgccttctagatgaggctaatcggaagatattcaagggcatcaagctgccccgcccagcatggtgtgtatgtggtccctgggggacttcctcccattgagggtggggcaggtcagatgtgggtcagtaaatttctgtgacctggcagcattctctggaattctcccaagtgagtatgcaagggtttcagtgtcagcttcttcctctctgcaaatctctgtgcaagtgaacatattaaagtatctgagaagtcctgcaggaaagcttctgctgctgcttagcttgacgcaaccgagtctttgcaaatgattttgagtactgaacttccccttttcatgtgatgtttaaaaggttgttaatgctttattattattattattattatttgagatggagtctcgctctgtcgcccagcctggagtgcagtggcgtaatctcggctcactgcaacctccgcctcctgggttcaagtgattctcctgcctcagccttccgagtagctgggattgcaggcatgcaccaccatgcccagctaatttttgcacttttagtagagatggggtttcactgtgttgcccaggctggttgcaaactcctgaccccaagtgatccgcccgccccagcctcctaaagtgctgggatgacaggcgtgagccactgcacccggctgctttgttactattatatcaaataccagtttggaaaactgcctcaaggaatgctctcttcggattggaaagcaatgaatatagaaagagtacagcttcagggcttaaataataatctatgcaggctttgtaggagtttgagtcagagtttccctccttattgttaaaaaggatgcatagaaaatttttttgacttggagaattctttgccacttgtggccggggctgccagttgccattctagggggaacatggagataaagcaaacattgaaatatgttttttattgtcagcaaaaataaacatcccaggccggaagccagggtgtggaagggaggagtctggggacatgaagtcggaatcccacttggggatgggcacttattctcttaccaccacctcttggagccagaccaggaggccttaggggggtctatggccctcattaaagcccaggcccccagcttccagacaagggaaatgatggctcgaggtcccacagcaagtcagtgccaggctcctgacccctggcccgctgctgtcttcgaagcatcatggtttctgaaaatcttacctaagtcccttgttccatgaggccataaaaatggcaactgccatgtatgaagcgcttacagcctgtaccaggcaaggtgctgacacctcacctgtgttaacttccacagcggtctctccaaagggactgaggcatctaactccctcactcatggccttttgccagcttcccccactctgaggacactgactccaatcgtgcccccacctctttgtcccccgtcccctgcacccacgctggcctcctctgctcgggacccctgcacttgccttcttcttagttcagaacattcttccccaggtctctcctgggccttcttcttgcccaggccttccttagagaggccttggattcatttgccagtgctgctgtcacaaagggccacaaactgggcagcttaaatagcagaaatgcacccctcccagttccggaggtgagaagtctgagatcccaagtggggctccttccgaggcagcggggcctgttccagccatctctccctgctgggggtggattgccagccatctttggcgttcccgggaatgtagaagtaccgccctcatctctgccttcatctcctcacgatgttcctcctttgtgcgggtctgtgtctaaatttcccctttttataggagcaccagtcatcgtggactagggacctacctgctctggaatgacctcatcttaacaaaggtcatctgcaaagaccccatttcctaaccaggtcacgttctgaggtactaggggttaggacttcaacataccgttttttggggacacagtttagcctgtaccaggccttctctgacgagtgcccccctttcctatcatgccctctgcacttcattgatgttgcagccctcggtggtgcctccagtcgcttcctttgcttgtttgttgtctgtctcccacactaggctgtgagtatgagcactgaggacagggacctggcggtcatcttcacgttgcatcttcagagcttgagcaatgctaggcacaaacttactctgttcacttaattactcaatgaatgagtgcatgaatgaatgaatgaatgaatgaaagaaagaaaagaaaacaagtcctgttgtctttcccatgcatcactcacacaaactgaggctttgagaaaaccagaggagagtaaagaacaggcttttgtgtgtgattcatgaagcagtaacggtttctcttttatttacattttggataaagggcagaagcaagaagggtggctgtgactgcattcttgatgttttcagcatttgtcaagtgggacgtgtcacctcattttatttttgcacattccccagtcagctctactgagtgtaaatgcggggtgccgctctcacaccctcagttcccatgttggcagttggaagggagtgcagcctgcattgcgcgctaacttcgtgcttgccatctgggagggaagttgggatccaggtggtgcagtcctggatctgaaatcctctgtgggaagtgcagagagacagggtagctgggtttctggaagggggtagcagcctttgaattcatctggctgagagctcagatagaaatccatccctcgccacagctttgggacagtcagatgtggtgcaccgaagacaatctgctggggactgtcagtggcttcctttgttacccttgccttgtccactctcttgggcctgggagggtcagtgtctgtgactgtttgatccttactatgcttggctgtagaggaaggggcctgcaagatgctcatggcctgcttgggaggacaagagtcatgcccaggaagccgtgccagtgaccaagggtggtggctcatctcctgccttgtgtgcttgttgtcagagctgtggcatcttcagccctcaaagattgtggcctgccggcttggctaaaagcacagctgcctggagcctctgtgccttttgggcttcctggggcccatgtctcctctctgcaaggtgcaccctggggctgaagctcgggtggctcgggtgtccttgcctgctctgttgcccagagacggctttatttttcttaccctgctaggcccagggcatgtgtggcttattcctggggctgcttgggacatcgtggaattctttaacctgaagattctcacctctcccaccataccctccagagtccaacacagacacaactaagctcagggtccccaagggtccagaccccaggtggaggtgaggggcgggcagtgtgaggtgttggctctagggaagggagtggtaagaaaacatgggcctgccgcttactctcagtgaccttccacgagttccctcatctcatcatgtccttttttcggagcaaagcagggataacatgtccttggagggtggttatggaaatgcccaatgcccaatatatactgtatggataggtgaatggcatgaatccctccagctttggggaatcaattcagtccatgttggctggtttctagaacaactgggcatgatgccaggccacacaggggccacggggaggaataggacatagtccctgtcctcagggagggggcacaggctaaggagaactctctgcaactcatcagccacgtaagctcagtcagcttgagcgtctctgttctccctgagtaggcaccactgcgaggaggcagtgaagtgttctcaatgggagggaggagccacagccccatcatcgtgcctgggacgctgaggcttagaaatgccgaagctgaacctgaaggcggttactgtttggcgttagaggtgggagatccaatgggaactgtgattgctgaggttccggagggtctgagagctgacatccgcttggggaggtgcctgcagggggcctgctctgggccaggcttggtgctaaggcttcaccaacactgtctcgtggaatgctgatggcagctgtcatcggctgtattgtaccagtgaggaaacagtgtctcaagggggttgaagatcactgactgaaggcccaggtctgcccacagctgcctccacccctccattgcttccagtatctgggacttgagttccaaagccatccttggcgtgggcacacagtgagcagtgcctggggagagattgtcctggctggagagctcgtcaacaggctgagcgaaggtgttagaacaggctgccctgtacctctgggggttggtttccggctcatgtcacagtccagtggagaccagcggcctctccaagcagtgactcaagaatctgtgttcactccatcaggttattctgtcatccaagtctttttcgtcagccacatgaatggggtctagggaaggcacgctgttcatcatacacttgaactagcttggcctggaagcacccactacgtctgctcccattctgttggccaggacgcgtcctgtggctcctgtgcgtgtgcaagggaaccagggcatgttgggcgtgtggctgtgggagagcagcctccgggtttctggcgggagccagcaggtgcatggacccacagtgccggtttcccacagaggtcctctcagtgcagaaagccaaggaccagcccctttttttcccactgctctctgggtgacttggaaagtactgaagcctcagggcagaggttggagagaggagagccaggattccttgggcactgagagcagggaagggttttcagtgagccccttgtgctcagccaaagcagctgggtcaggtggccctgggtgagactgaggttgtcacgtgtgccatttggtgggaatgggggcaccagttggacagcagcagaaatcatttctgttttctgttgatgactgtcttgcttactcagtgactagtgcacgggctctgagatctgcagaggagtcctgaggcacgtgtacacagttgtccacgtgcgtgcacatgttgtagacgtgtccctgtgttggaacatctggagtgtggttctccagttgtctagcccagagtctgcctccctggccccctcccagctccttcatcattagctgtgtggatgaaggcgagttgccttggtgtccccatctgtacaatgggaataataattggctctgcctcatggggtcattgagatgattaagtgagatagttcatgtgaagtgcgtagagttgggctgggtgcacagaggtgctcgatggatgttagttattggctggatttgaatctaagcctgtctgactctcagactccaaacgtgtgctcttcctagagactgctcagttggtaatttacaaactttcagtaagtaaataagacatttcactggttttaaatttctgggagcacatgatgagcagtctccctttcaccctgatcccacaagccccctggtcctctcccctgtggtggctgccactctgaccagtttctagtgcacatcccaagatactctgtgcatatccagtaagatctcacttaacgtcttcgataggttcttgaggactgtgcctttaaatgaaatatataatgaaaccaatttttttctcactgttataaaaaagtgacgttgaaggaattgatgttatttaaggacctgctgtacaattcagttgatactgcactttccaagaacctatccccaatgttcagtgaagacttactgtacaagcacatgttgattttgtgtaacccttttttcccctccccatacatattctagcatggtatactcagtgatcggccccttcttggagatctttccacgtcaccacagaaagcactccccgttctcttctgtggcagcatggtcttccaccatatggatcttcataagtgattcagtcccttcttgttggacttttatttagttactaatttttggcgattacaaacagtgcagcaatgtgtgtgagtgcatatgtgggtgagttcaccctgtgagatcagctcctggaagtgagactcctggacgagaaaggttatgcatttatattgtgatggatattaccaacttgctgccgtcgagacggttgaatctgcatccccccagccctggccgatacagtctgttatccgtctctctgactttcaccaatctggtacataaaacatggttatcataatgtagttgtaatttgcatttgttgtatgaatgaggttgagtattttctaatttttatatgttggaagccttttgtagttaattttctgtacttaacattcaaacatatcttttgttcatgttttctgttgtgttaggttttctttttaaaaaaatcagtttgtaggatcttaatatatttgagagagattagtcatttgtgatataagctgcaaatataatacgtggtgttcctggctaagaggattcatgatcaaaccatgggttttccttaaattgatacataaatataagtaattctccatccaagtcctattctttttttctttttttttagacagggcctcactctgtcacccaggctggagtgcagtggcgcaatccgtgcttaagccaccctcctgcctcaacctcctgagtagctgggatgacaggcgtgggcgtggtgtgcaccaccagcccggctaattttttatatttttagagatggggtctcactctgtcatccagcctggtctcaaactcctggactcaggcgatccacctgcctcaaccttccaacaatcccatgctgggattacaggcatgagccaccacacccagctccaagtcctgttcttaaggatgtgtaggaaaaataaatgagcatgactggtcaggaaaattgtgaaaaagggaggacctagatcttattggtattaagcttatcatgaagcaattgtaattaaaacaatgtgggaaaaagaaaaccaaacgaaatcattgtgatattggtgaaagacaagttaatgaagagtccaaaaaatgtgagaattatgaaaatattggcatttgcaaacagtgggtaaaagatgggtaagtaaatgttgttgagacactggagtgctcatccggaggaaaacatacacagatgcacacctcagtctttcactgaaacaactcccggtggatttaagatttaatgataaaaacttaaaatgtaaaaatagttgagaaaaccgtgggctgatttaaaaaacagtctagggagcaaagatcaaaagatgaaaatatttatacatttgaattacagaaaagtcaagattttctgcctggcaaaaccaccacaactaaagtagaaagacagcaacgtgggcggcgctaggcaggccttaccactgtctgcttgcccccacagcctccattcctgctcttgatttccgggttggggtgccagtgccaggcccttcatcttggagaactctgcaaagctgacagtggtgtgctgtgtcggtggccggcaggatggaaagaccctgattccagccctggacaggttctcgcttcctgacccaggtggctctcaggagatggcgttgtggttgaaaacttgaggcctgccagctaggatttcagaattgtcctgttctcctggaactggggcaagtctgggttgttgacgctgtgcttgtgggtgcttccctgcctctggccccctcagattgtatctcggaccacatgatagctccccccagcctcaatccctgcacatcaggaaaggacgtctagccagctgtgttgtcggcccactccccttcctgatgaaggcagaaggctcaggagcctgtgtcccggagccacagggacctgggggtgttgggggagatttgctggttatacagcctcagttcggttgttttgcctcttgacttccttgcttcatgtgtaaaatggtgacagtggcctctgcctcctaaggacatggagattatgtgctaaggagattaggtctgtcatttgctcactgcagcacctggaatataagggtcccggtagttctggtggaggtgattatcagaatcatgctggtggaaagccaaagaaggccagaaaggcctccgctgaggccagagaacatccagcctcatgtgaggaagaaagtcctatttgctgacacctgtacagcatggtcagctctagtcacagagggaggtaatcgatggctggccctggctgtgtgctcatcgcgactataggaaggatatttctttaccctcactccacaggcgaggaagcaggcttggggaggggagggatgtgcccttccccaggctgcacagctggaggctcagcccctgccctctaacccctgggcatccttctgcctggggagggagcacctctgtgcttgaggtggcttgggaagaagagcactggccagccatggaggagtgctgtgggcaagaggattccgcgagttccttcctccaggcctggcaacaggaggttcatgtgtgggatcctctccgctctccccgcaacacacacagggcggtcaggctttgttacgtggcttctgactccccaccttgtggatccagacctgccagcccttttatgctccctttttttctttttctgctagcctgtgattcgtactttccccccaggacaggactagattggtgcctggcaacagaggggaggggttagctcctatcagctctgactctggcctctcaggtgccactgtgaacaataacacagatgaagcagccccttggccaagatgcacgggatcgagggactcatctggcaggttgaggggactgctaggggtgagctttcctaggatgctggggaatagccacgtcgtgatgtggctctatcaaggctcctgccttttgctcctaagggctctgacaagttatcttccccttacaggataaatccccattcctctctcatccaaatactaataaactacaatgtgaaaaaaatcatagctaaatcctgttctcaaccttgcagttacctgtcggggcctgtttgccttaatctgcttttctccccttccctttcccttcccttccatccttcctttgtttcaacaaatgaaaaagaaaagcttggggtagggggaccagctattttatgaggacagatttggttgtgctgtattaaccaacagcctcagaatcttagctgaaaaccgtgggttattccgcactcatgccacatgtccacagggccagctgggggctctgtccatcttattcactcagagatctaaaactgagcagccccatctggaaggttgctggtcctgcaccagaggggagagagggctctggagaccttactcctgcagttacatgctctgcccaggaaacggcatgttctgttttcactcacagctcattggccagaacgagtcacatgatcacccatttaccagggaatcaggaagtgcagtcctgccttgtgtccagaaaaggggctgataggccgtgtgcggtggctcacacctgtaatcccagcattttgggaggccaaggcgggcagatcacatgagatcaggagttcaagaccagcctggccaaacatggtgaaacccagcacatctctacaaaacaaacaaacaaacaagcaaaaacagaaaaggggctgctatacccacagtccttttattttcatattctgggttttcttatcagccttttccacagtaaatgttggttcatgtggttgtaattcaagcacctactcttatctctatcaagacctcttcattgtcatctcagttactgtttttttctttgtttttgtttttttgtttttgttgttttttaagagatatggccaggcacagtggctcacgcctgtaatcccagcactttgggaggctgaggcaggtgaatcacttgagtttaggagttcaagaccagcctgcccaacatctggtagagatgagtagtgaaacccatctctactaaaaatacaaaaattagctgggtgtggtggtgcacgcttgtaatcccagctacttgggaagctaggcaggagaatcacttggacccgggaggcagaggttgcactgagtggagatcatgccactgtactccagcctcgacggtagaccgagactgtctcaaaaaaaaaaaaaaaaagatgtggtcttgccatgttggccagggtggattcaaactcctgggctcaaatgatcctcccacctcagccccatgagtagctgggattacaagtgtgccccactgtgcccagccacaccatctcagtggctcttgactagccctttgtggtggcatgcccagcattagccagcaccccgttttcacacatgctctctgtgtcttttctcttgtcaatatgttgtcagtgactctccctaggccagaagtggccttcacttgttgatcatttccttaggccagcatcctgggagtgggtgtgcttatcctttgcctgctcttggacctggccttccagcacccagtgttgggaacgcagaacaggactggcccatcctgagaactcagggtcagtcctattcttaaggagctgtgcttgctgaatgggtgtagcttttctgggtctaatgtcagctcgtaaattcccagaactttggctctgcaaggtagcaccatcctcaggccatttagttgtcttgaccctttatcttctagggagaaaagttacccactcttatgccttcacgagtttgccgtttcttcccattatccgagtaattggaaaccagttactcagaaatcagggaattgggtcagagagcattttcaacagcttccctccccagcctggggcagaggctgctagggtgaccagtaccatccttgtcccagcctgctggtcttggtggcagccccaaatgacctttagctcttgacctctctggagcacctttgagaatgagagttgttcttgccagggaaaagactccatctcctcttctccagtcttcctttggaatcaaacccactgaaaacacaccactggcatggagtcctctgaggccaagctcgtttctttttctttttcttttctttttttttttgagacagggtctcattctgtcgcccaagctggagtgcagtggcatcatctcggctcactgcaacctccgcctcccgggttcaagcaattctcccacctcagcctcccaagtagctgggactacaggtgcacaccaccacacctggctaatttttgtattgtttggtagagacagggtttcaccatgttggccaggctggtcttaaactcctgacctcaagtgatcggcccacctggcctcccaaagtgctgggattacaggcacgagccactatgtccggccccaacatccttctggaagtctgtccatgaggttcccagatctgactttcccttctggagagacctgcttctgcttggcaaggcctttgaactttggcaatggcagttctgtcccagattctcagatccatggagagggcagaggaataagtcagacttcagccctctcaccctttattggggccattttgtctcaagcttggttgggacaaaacttttcggaagtttccactggtcagtaataataagaatagtaagtatagggaaatacaatagctgacatttattgagtgtcactggctaggtactgctaagagtgagtgtgaagttgtgagactgtgacatgttatttaaccaccctgtgcctctcatgagtccccgtctcagactattgtgagaattgagcaactcagtgcatgtgaagtgcttagagtagagcctggcaccgagcaagtgtgcaagagctgggtgctagtgctgggatcgcgaggcttcttgctttaaagacaaggaaactgaggttcctagagggcggtggccacacagccctccccattatctgagtaattggaaaccagttactgagaaattgaggaattgggtcagaaagattatatgataccgtgggggaagagcagcccccagcgcaggagcaggagacagtggattaaagaatcagcatcataactggggttacggtgcaatcctggagcgacgtgcaaagggttctggggctgtgggcaacacaagggagccactaattcttcctgtttgggctgaggtgagttgagaaatgtgaaagaggattgaacttttgctctgggactcataacaatcctgtgaggtgcagggaagggtgagtagcatcctcattttatgactggggaaactgaggtaccacacagctcagtgacctgctcttgttcagaagcagtggattggagatgggtttctaggcctgtctgcctggcccacccctccccagttccagatcctgggagagacagggatagtgtcagggcctagctcagcttggttaccaggctgggtacgattgggttaatcattttggaagtcaaagaggactctggggccactggggtttgcaggcctttgtgccgtctcccagccctgcccccacctctagtaagtctctgccttcgtccctgagggaaacagtggccccttgttttctctgagttctgaactccaagcgccacacagagcaggatccagcatgggccctgcgagatggcatgacttggaaacggagtgcccacagacctcaggccccggcgggcagcctttcattgagacacccttgctcctgctgggagggacaaaccagaccccgtcctctgaggagaacaagaagtccctgggaatgttcttttttctgggggcagagtgtggtcagaaaagcagaatgacaaccttgaaatgagttcctgtccccatcgcatctgggagacctgcctctgtggtgtccttccccccgggcatccccctgcacagtgtccttttctccgtggcctccccagtctcaggagctgggccctttctcctgtgggggccgcacccaagggcccatctcttttctagctagtggagggagaccgcagcctgtttgcagtgtgttcaggggacagaccccttcagggcagttgtggcatgtcaggcacctgaggaagagccactagagctgccagcagccctgctggtacccagcacagacgccacagcgagaggcggccgcacccgagagcagcccaggcctgatgtgtgtcccaagctgctgttctcacagaagggttttactggcatgaaaatgcttggaaaatacacaaaggagggtggcccgtttccagagctcagctgtttaccttcagtggagcgccggggatgcggagagcttattttccaaacagctgcggttgtcaggtctacgggcctcaggctgatgccaggggaggacaccaagggcgtcccctctgctcacctccttccccagcgccaagggaaccccacagtttctcccaggcagggaaacctggagggctgtctggagatgtgggtgctggtgggcatgggggttctgtgggcccggatgcgtcgctcctgtggcccggctccccctgcgctcgtagctgtcttggcctctcgtttgtggtgcctgacccaccgaagccacaggctgtagtggaaatgggttggtgtttggctctgtctgagagcccagtgttctctgcccatggcctctctaccttccttcagagtctgctttttctgggaagaggtattgggtggagtgtaatttggaatctgtgaagagagccatcaaagctcttgcagtttcttgtttctatcaaaggggaaactgaggccccaggggatggtgagcccaggtcagcgggctgctcatggagactgacacatgggcattgctgcacagcctccatcctggccgcttcacctgcatggccttgcttggtcattttccttcctgggccgttggtgtcctggtctttgcagcagggagcgtcttccccggcccctgggcttgccgtgaggatgagccggcgccaagtctcaggagatattgggaagtgtctttcccttccccttcctcacccaagagccccagagatgggcagcttctcagctagcctggttttggttttattttatgttgttttgtacacaggcctgtcaccatggggagggaacagcattccttagtagtttcttattgtgaggtctaaaggatattttttttttctatataggggaaatcccttaacatctttcctggcaaacagtaagaaagaggagttaaagacaccagcagacaagagctgctgcgttccgggggtgcaacggagaggagtttagtaagggaccatcacagggtgtgggcaggcccgagagccagcacaggacaaagttccccggtgctaacaagccctgagagctgtcaccacccctaggcctgaggggactaggggaccaaaaatgtacctggagccataggggaggcggtagtgttgagagaggggctgccctgctccatgggggctgtgactgctgccagaaatatggcagggggtgggggcgtgaggatgctgcaaatacattccctccctctctccttcttgcccatcttctgctgtgcctccagttggcccgacttggccagaggacaaggcagccaggtgattgtggcctgagaggacagctgcctagggcacagagcaggcgtggggagcggggttgcaggggcaggcagcggggaatggagtgagaagcgcagccttagatctgagtttgtgtccccacttcaccgccttcctgctgtgagaccctaggcaggttttaaaagtctccgtcctccacttttctcattcgtaaaatcacttctcatagtggttgttaaatacaatgaaagaaatgcacgcaagctttgagcgtggtgcccactgccagtgaccatttgtagttgtcattatgatgtctttcgtaacatttttaaaacagtcagccttgaatcctggagggaaacccacttgggggtggggatgagagcaggggtggggcttgtggccttctctggcctctgctaaggccagattgggggtcagccaggtgccgggctggcgccgctgcctccgaggcactggccttgcaggtggtggtggccgcgtgccgggagggagacatgtggcgggtcaggaagcgggggtcaggctgccctggcttttggcaggtgctcctgtcttggggtcaggtgacgctgactgttggccagaggctctggctctcttggggcctgatcttcccaacctcaggcacttgcaaaaataaacaccttccctggcatagcaggagagcagtatggaacagattgcaggcagccctacgcgccttcgcttctcccgatgagcccagatttcagtgtgaagtgcaagtggctggtcgctcaaagcggcaatttctagattcctgaggaccacagctttgctaaggctttttatagattagcagaagcagtatccacttagatctaagttctgatctggctgtgcgatgttagtcatttacataaccccttggaaccctagttttcctagggcagatggggtgtgttgagaaaagcctttctctgtaaagccatttctcagcatcacttgcctggcctgttgacactattgccctgattcctcttatgtgtcttctgcatcctgggtagcatggggcttggggaacagaagttacaaacgtggggtgtgcccttgaggagttagcaggagagaagagttgtggggtcttggagggtttgtcctgcttgtcctgtctgtattttccatgtcagccctcctcctgccccatctccagagtgctacagggaggctcgagggtcctctggtgatatgccccagggtggacaagaggatgggggcagtggactcaggtgctgaagttgttgcttttgtctgtgttccctgcctcacagctgaaccttagccggccgatcgaggagcagggccccctggacgtcatcatccacaagctgactgacgtcatccttgaagccgaccagaatgatagccagtccctggagctggtgcacaggttccaggtgagtgaggaccatgcagcccttggctgtggcattttcaggaggaggaggggaggccctggaatggccgtgtgtgtatttagggcggtagcagctctctggaggtatagtctggagaaatggctctgccactggcaagacatgggctcgtgggcaggtacttctgtgcggcgtcagtgtcctcgggtgtagcgtggggactgaaccagggcatggttgggccgtctccaccccctggctgtgtagacacggtttactgatgaggcatcgctgagttccagtgtggcctccacgtcctcagcacaggcatgtgcaaccctttcccctggctcaggtaggcacaagggatggaacccttctgctgcacttggtaaaggggacccccgagggcctttgaactgagtcctgccttggtggagaaccctgcctctgcccattactttgacctgggtactcacctttgagcatggcctgaggtatcttgctgagtcccttggctgcttccctctccccacaccacttccccagcggcctcccaggtcctgatcgcacagtgacctgcccactgccctggggttctcatgctggctactgacttgtcctgtgttctctctgttgtggacaagaacgtgattctgtcctctagaaagcggctcagaggtcatgaaaaacaaagttgtattgtcagtgaaagtgcagtcaagatggtagctgttttcaggtgtgcctagtgggatggggatgcctgagatggggtttctagcgtgtgacaggcgcagatttggtgccctgcttttcttcaccaggacaaagggaatcttacccgcctcctagtcacccggtgctgccgtcctgccgacactgttctctccccgtgtgttcggggtcagccgccttggccccccttgcttccttggggctctcaccccgttccttggccaactccctgctgcacattcctgcttcccaccaggaagtggccccggacacagaggcagcctgctcctggcatcccctgcttgggggcagggcatgtcccacgttgtgccctccagggcgtctgccctgccagtggccccaagtccattccacttgctgaacactgtctccttgatcggactggagactgtgggaaaaacatggtcgggctcctctgtgacctcgtggagcctcagtttccttatttgtaaaatgggtgctaggaataagaaaagctcagaccatgttgggaggagtgtgctggggttcgaggggaacaagacagaggagatgtgtgccctggtgatgtgctgcttcctgagtccctgccctgtgccagggctgggctgatcagcactcacccatgtgctacatttgatccccacagccctcagtgcagactcaccagccttgttgataagcaggaagtggaggcgtggaagcatgtgcagcttgtccacagggacccagcagagccgggggtcagtcttgactttctcaggtgagccgctgctcatcctgagggcttgctcttctgttcctctctgcctccaacctacacaactgtcctggggtgtggtcccagctgatcccaagtcatacagcgactttcctctcccctgagccatttgctcctgcctcacccccgtctccttcggaaggcccctgagtgcccagttcatgtgcctgtggtgcccttggggcttattctctggaggagcacagccatgcctgggctgccacgcagacctttggggcagggatggtgcatctcttgctgagtccatctgggggacgatggccttccagatgcctgattaccgttacctcagaaagcactgcagagcagttaccgcttaccaagccctgctcgaaagcgcttcatggcggttgacccacttgctcccatgagctgtaaggttcaatgattcccgtcctgtggaggaagaagcagctgcaggacaactagaaagtggtccaggtgggatttgagcctgcgctagcttgctctcctcacctgtcgtgtggcctctccagagatggatgaggcggaggacttgggagtcaaactgtcttcaaggcagatccttgttccaaaacttaggaaccgcgtgcctccccacagcctcagttccttcctccttgggtgggcaggttgctgggaggagtaaatgcctgtgggtgtaaagtgcccattgtagctgagtgccacttcatcacacccacacggttgctcttcctagagaccacatctcccagctagcctgggcccggagttctggaacatctgctcccaagctcttatccctcttgcccacttcccagacacacacacagcccacagcccaggcaagtgatgtccaaacagtgaatgagagtgcccgctgtgttccttttctgggcagaaaacaatattaacagggagcgtgtgtggagggcagcatggggccttgtggcttaaggctgtcaggcagccacaggtgcatttctcaggcagtgtcttgtctgggtcttgggggatggttgccgtgacctcaccataacctcccagcactgatatttctgggataaattttcatcaccgtctgtgcttcagtaagaggccggatatctgataaggtgggaagtttcctcctttgtgaggagaacaatcctttggagaaaagggtgcggggctgcactttccagaggccccaggagagaggaggcaggcagggttggcacagagaatgactgagaggcactgggatgggggctggggaagaggcttccttctaccaccggtcactgggctgtcagcattgatcgtccccttccctctgccataagatgcaagttcagagccagaccacatagacccagggaggcggacacttgacctcagtcgtgccctttgttttcagatttttgttttaaattttattctctagacattaacaaggaggcatgagtgtggtttgaggactgggagggatagggatgctataggcagaggcaggggaagcagcacccagagctggggtcctcccattttgttgtgagcagggaaaccgaggcaagatgctttgccccagcagggactcagcttgaagggccttctccacagtccatactcaggtcctgggagggaggaggaagtggtttggggctgtgtgggtggagaaaaatgaatttctgagatgttcctcagggccccagagcactgcactgggctgcctctgtgaaagttccggtccccagggagggaagaaattcccagagccaggaggccgtgcctgcttctggctgccctggtgggcaggtggaggctgtgggccagaggcttactgcagaacattaaagctgcttgtcacagaaccttcatcactgccccagagttttggattttttttgtttttgtttgtttgttttttgtgtgtttttgattggcttctaaatggcttggcttggagactcaattgggatgattcagttgtttttctgctccaaggttcatgtggagccagcagcctgttgcccctgaggctctgcctgaggtttggttctcagtgtgcagaaccaggcaggggcccccagggcctgcccacgtgggcaagtggggccggcatgccgagagggtccctgcctcaggctcggggacactaggggcctcctggcctggtgagtggctttcccaggggggcaacacgagccttctcctcgctgtggcgcccagagccacctgacaggtgtgggtgcagggtgggaagggaggggcccaccgtcctcttctgctgccccttctagccctggaattgcccctgaaggggtgctgtgattgtgatccatgggccatgtggggctgcctcgggggaccttcctggggttctccctgaataagcttaggactaagaaggaagtttcagtctcaactgctgcctttgccctgtctttatcagctggaaggacggtaattgtccctcagatgtcccctgaattcccggtctgcacacagactgctaggagagtgtcctctgcggcagcactgctgggtgccctgcccgcgagctcctggccaggaggagaggccagcaggcagacccagaactgacctcacggcccctaaagtgatgagttaggaaaaacacaggtctgatcacagcacagcttggcttaaaacatcccatgctttcttattgctgtgacactgaaggccatgattgccagcttgacccatggggcctcggtgatctgccccacccgctccttccctggccccctcagcagctgcccaggctctgatgtgtgtccacctcagcgcctttgcacaagctgttccgtcagctcagtgccccttcccaagaaatgtcctccctcgtgagctgattaatgacacatctctcgtcccaggccctgccaactttgcacttttccttcatgcccttcggaagttcgtaattctttatcagtggctattgtctgtcccttcactgcggcagggattgtgtctgctcccagcagctggtgttcccattgccgcctgcagtgcctaagtgtttgggtggcggcgcatgcccagtgctggtcatgcgctggggcggcctttcatggggtgccctgatggccttgcggagggaggacgtggctctgctgggctgcttggagcggggagggaggaggccaggagcgttaatgaggcagatggcgctgcctgatgggcatgtgcggcgatgtctccaggtgtcagcgaggttggagagggagcagcaaggccggagcttgagggctttttcatgccaggctgtgcagcttggactctatcctgcagggagggtggggcggggatggcggtgatatgatcagatataattggcaagagagaggccctgcttggaaggggagattgccagtgcaagatgaactctgagcagctgaggacactgtttactctttggagcccaggtgcgtccaagttgaagaaggagctcatggccccaggctcagtgttgtgcccatcctcagccccaggtgcccctgcatgtggtcctgagcatcccctccctccgctgccatgaaggctggcctctgagcagcttgagccttgcccagcctacacaggacaaagttgcactcacctcctggctcctctcagtgtgtaatcatctaaagtggatctgggaaggaagctcctgccccgaaggatgccggaagagaatgcacacttggccacactggttcttctcatgttgtccctggaaggaaaccatgtgtagccttcagtagtgcctccccgaccccaccatcctcctgaggggacaggaagtgagtagggctgggagctggtgggagggggtgatgtttggggccctccctgctagtccgccaagcgaggccaggcttcgccacagggatagacagctcccctcacccagcacaggcttagctgggcttgcaccacgtggtcacggagggttaactacagctttgcagcctgaaatgacagccgtcatggcagagggatgagaaggcagtgaggcttatgctggctctcagtgtctgccctgtggtgacacggactcatccatctcactggacctccctacaggcaagggaacccaatactgcatagttcctttttcttcttaaaaacaattaaaataccttgtagggttattgttagcattaaactaattaaaatttgcgattcccctagtgcctggcatggtgtgaatggtgcacgtgtgtgtaagggtcagtcagccacgcttactgtgaatgcctggcatggtgtgagtggtgcacgtgtgtgtaagggtcagtcagccacgcttactgtgaatgcctggcatggtgtgagtggtgcacgtgtgtgtaagggtcagtcagccacgcttactgtgagtgcctggggtgtgatgatgcgtacgagccactcagtacaggcccggcgcctagtgaaccatcagtcaccgtggcttatgtcaatattattattacagtgacagtaggactactctgtcagccttatctgtggccccagctgacttgagagctctcagtcctaattggagtcagtgaggcagtgattatgaaagtgtccccaaacgggagatgcattctgtgctagggcagtggaaatgcctaaaaggcagggccaggtgggggtcagagggactcaagtgctgttcctagccccacccttcacctgctggcccacctgggcctcggtccccttgcctaccgcatagggaaggtgcaggatggcacagaacaccttcagagctgttgcgtctgcctccaaaggactacccaaggccgcggttcacgtttgccacaaatgtgatttcacagctgcattgaatcaaaccctgttggcccctgatgtttattgagcagtcgccagcacagggatggagaggaagtagaagaaacaaaggtttttgttgttctaggtgttcgagtccgacttggaagataacatctaaacctatcagaggataaataacaccgtagaatctaagtgggcttgtgtcggctttgcctttgtgcctgctgaccagtggggtcagagtaagaaccatgggccccgggaaggggtttgtgttgtcaccagggagccatgggagggctccctattttctaagaatgtaccacgtgacccattctgccacgggcgttctcatctcttatgtctttggtccccatctcagtccctgagataatggaattatttccccatttttcaggaggagacaactgcggcccggggaagttaagtcacttgcccagggtcaggtagaaagtggcaaggtcaggatcatagctcggaggggctttggtgacagctgatggcactgtgggtggtgtgagggttggtgatttcagggccaccttggcaggaggtcatcgtctgggattgcctctgacacagctggtgccgtgtgacgatgagactgctggccagcagatgctacgggaggcagagttggacgcatctggcagccctggtcccagagaaacagatcatgtcctgttctggggttgctgtgaggtcagcctctcgatgactgctgccctgggtcataggcgactcctcctgtggtggagacagccacacaatctgtccattgtgcaccaatgccaggccaggaatcgccctttctgcttcggggagggtgggaccattctgtgccgttagcccgttgcagttgcttccccttgtggaaagcaagcctggtccccaggaagacatgtggccctcttaccaaccaggaacagagctagactttgtgcagcccagttgggacaggggcaggagagggcaccccaaagcctgcgctctgagccagcatgtgggctgcagcccctctgcttgtgtgtggacggtcagggtttttcagctcaaggtctgggggcatgttgagttttagaaatatcaatgtttatcaataatacattttccccaaagttttagaaataacttttatgcacattatttctgggtttcttaacctcaacatgattgacatcttgggctggataattctgcactgctaggggctatcccaggcaatacagggtgcttagttgccttcccggctgctcattaccagatgccaacagcactccccaccctgcccctcatgacaaccaaaaatgtctccagatgttccctggtggagggagcccatgccacccctggtcgagcgtcactgcattttgtaagagatgggtccagcagctctgagagctcaggtgggccagtcaagttgtttctgatttttgtgtggacactgaggccccactgggtgcagtttctgggttttagtgtttggaatcacacaccaagaggactaacatcttgtcacttcttttcttcagtaatattagtacctgcggcagaaaggacaccctgttttctgtttcctcctggtttgtgtgagtggcatgacttcccaacgtgtttctgtgctgcctgtgcaggctgtgtgcccgtgataaagcccactgtgtctgcctttgtcttcatgtaataaatcccattgccacctcaccagccaagagcacagccggccgggtaaaccacgcgctgggcctctgctgacctcggccctctgggatggacagagtgaggcatgaggatatcctctgagcccctccctataggtccctgccccaggcctcccacgcctcctggcagccagccctggatctggccctggcccctacccgtttgtctctccactgatctgtgagatcattcatcagtaactattatgttcattcagcaagtcttagtgagaacttactgtctgccagagttctcctaaaagacattacagatgcaacaatgaataagacctggtggacgcagcccctgccctgctggagctgtatctgagtgtgagtgcatcggatgatgggaacaaaacataggtaaatagaggacaaggtaacacagccccagtgatggcgagtactaggaagaaacacaccgaggcctgggagaacagggaggtccttgttactgatcctctgaagagctgacattgagttgaggcctaaagggcaggacactcaggaggggagcaggcaagggagcagcacctgaccaggcccttcagtgaaacaggatggaggcataaggacccgcagtagctgggtgcagctggagcacggtggatagggctgtctgcagtgggctggcaggagccaggctgagcctgggcctggtggcctcctgggagcgctgggtagctctttgaggacacaaaatatcgtgccagctcccctctttgatggccccaagttgagccacagacaacgtgccattttctagtccccaagctctctgaggaggaaggggccctgcccattgcagcagtcagaggtcagggaggagctcctggggcggcaggacgactcccacttctgagcatgcccgcagccactgaagaggatggctgacatgtggaacagaggccagtgtcatccacggggtagatgtcgtagccaggtcacccctggcagcaggatctgtctctcttattgtgcacctagagcctgtaccagaaactagaagactcgggtggctggatgcagaggtgaggagcccaggggtcctctggcctcagtgacccagttggcctaggtcagcagcaccaccgcaaactgtgccctgattctggatgactgttctctccctgcagacactagtttgtaagccctgctggctgtgagtcacatttgcaaacccagcaatgcatcacacggacaaggcaggggagcccatgggctgccaggaggcattggcttattctgggaactgaaagtcagactcggccgggcgactgtgggccagggtggggtgggtggggctccagcaggcatgtcacctttggccttgatgtagggaagctgctcttctgtgtattattgtatacaggggaggggcagctgcataggcccacctgagcaggtgcgtgggaatgcatgtaggggttcagacaggtgcttagggggcgtggggctgctgctgaggtgggtggaacccagctccgtgtgaccttgggcaggcagcccctttcttgccctcctgttgttcagctggtagctgtgacagtgggccagatgaccgaccccttccagctccatctgcgtggaaatcccagctgtcccttcatcctgcgggatccttccctggtcgcctagaggacctgactagtgtgatggtgctgtgacacagcatgtggcatttgtcaggggaatagctctggctgggcaccttgcctgcctcccgctgacagaaggtggagaaagctcataaaagtttggtgtgaaatctggggacagaggggaggtattgttttcagtggcaggcctggaaaaagggggagtttgctgtctccaaataatagtgttctctttccttccagccctctcctctgtagcagtcagggttattttttggcctgaacaccattgttttgcatgggtcttcctgctggctcttgaacaacagtttcccccccagagagcctgtggtttctcccagccgtggctcacaccacatgccaggcggctaagtgaggagcatgacactgtaatgcctcagtagcccccatgggaggatgacccgaagtgaccattgtgggtagcacccaccttcaggatgggtgtgcctgtgacctgcaggccacaggagacacagtggggtctgcatgcagaatcacattcagggtgccccatttgcgtgctcgggcccctgccctgctccgccccacacagccccttttaatgccttcccccaatctgaaatggagaatcatgtacagttcattcaccctggaggctggagcctggttgctttgaatcccttattctatattcattctgttcaccagggaggggatgggttgttgttggcgtctgctccagggaagcttccccagcccttcccagggctccagcgtttcccctaccccttgttgggcctgggacaccgagtttgaccagcttgcacatggactgtgagtctgatggatcctaagtgtggcttgccctgcgcaccactgctcggctctcagcagtcctgaacgagctggcacatgcatttggaacaagtttgtgaacagagtccctctgctgctcagccagccgcttcccatcttggggggcagccatcagttccagtggcctggagcctttccagggggttctgtgggactgaacagagacagtcttcctcgctgcacagcccctgtacaatggggctgtacggtatgccctggaagtgatctcatcttagtcttttgcaggcagcctcattctaactgctgcatgttaaacggcctccctgtcctttttaccaagccagctctctactggtgtatacctagggcatttctgatcatgttttagaaacatgctgtagtgaatagcctagtacatgtatttttgggtgcacaggtgaggaattctgtaggataaacacctaggaatcgggatgctgagtttgcgcattctgcattttggctgttgtccggtttctctctgcagaagcagtaccagttacactgccaccaaccaaggactggtccctttccaccaccttaggaagcgtctctaatcagtttaccttggcatggagtcacagagtgttggagggtgccaggatcctggcagtctcctcctcttgcctgttggttttgctgctgggagctccaggccctgggaagggtggtgtcatgctgcctcacttggcttgcccggaccctgaatctgggccatcttgcccctgtctggtgctgtgttctcaaacttcacttttctcttccgcactccatgtctgaccaccccagcctgagctcatgggtttaaatattggctcacaggagctgatagacctagaggcagattgcatcagagttttctttttgccagctctaccaaatcacagagatcactgtataaaagatgaaggcagcccatcagttcttcctgaacagtgaggtccagcacacatacccctaaggccagcaccacatctgacacaccaccaagaccgcatccatccccagctccatcctgtggccttgcaggctgctggactggtcactccataacccatagctgtccttgtcacttcccagctcaggaccctgttgctttagggtcaagtccaaactcctcagctggtccgtctcctgctctctaccttgtcctcacttttcatgttgagactgccgtccgccccagccctgccaggcccccagcaggcccgtgaatgtgctggactccctcaccccagacctctgcttttgctgtcccctctgcttggagtaccctttctcccctggcccatgcctgtggccctttgtggttgacatcaccaacctcagcaggctcctccccagcccccaaccctgtgccccccgcacccacactcctctgctcctttattgctggtcagccccacgcctctcctttgctcagccacatggccgccacttaggagcctctgggagggtggggagaatgtggctgctctatagctgaataggtgacatccatcaccacacacgcacgcacacacacacactcatatgctctcacactcattctcacacacacacacatatgctctcacactcatacacacacacgcactcactcacaagctcccacatacacgtgcttctcagaggctgtcactctttctgctctcgtactgtctgggaggcctcaggctgagtgctcagacgtgggagatttctctggaatacaaatgagggttgcttaagacccaagtgtctgctgatgggggagctcaactctcccaaggagccgttttagaaaagttaggaaagaaggagtgaggaaatggcctcaacacactaggactgaatccaggcaaaacagagaccgcagggaaccgcagcctcagaggacagctttgcttgggctggtggtcggtgcctgtcgccaatgcacagctgtccactgcccaccagggtgtgcctcctgctggcctccctccctcacctgtggtgggcatggatctcgctggcttgcaggcgactgggatgcgtgcagtgaccatgccgtgggtgtgctctgaggacagcaggccctggctcctgcgtttgaatgtctctgggcctgggaggcatctggctccgttcaggggcctaacagctctgtttttggtttgttcgtcacatcacagaatcaaataatctagaacttaagaggcagaaaggatgttataaatgaattattctagcccacacatcttacagatgggaaactgagatacagataacttaagtgactttcagaaacacacataaagtgaatggcagttctaggacttgtaacccaagtttcttgactctgcatttgtttcaacttgcacagtgccccaggacccacgcgctcgggttaagttagccaggtgtagctgggctgcaaaagattatctgacagtgatgggcaggcagaagccttggctgactgtcaggactgttacataggttgcacgctgcccagcccagtggtaggctttgtgaatggcaccctgggtagctaggcttggtggtcctgtcccagcgtacagtggatgctgctgcaacctccttttggctcttgagagcccacctccaaggtttacctgcatgcatctccaactccaaccctatgccagcctggccacctggcacattctgttgcacctaggcctagtgtggatttcccaggactatctgtggcatgtggttttctgtaagctgtaatcaacaggcaggtgttctgggaggtgccaggaagacttcttctgggggatgttcggctggccttggttgatgacaagttaatcaacaggggttggtttcacggttgcagtggtctgccaagagggttcattacttgtccttcccagaaagcattgcttggcctggccccaccccctccccatgtgacctgacctcccagggagaggctttgctttctgcagaaccacactttctgccttcgaaagtacaactgctcttgacactgttatgtctgttagtcctccccctgcaggggccactccattcagcagctgccttgggagccctcctgtgcataagtgcagtgctggccctgacacgctcttccccctgcgccacgcggaccctcctcacagaggccctgtggactgtggccttcagttatgtcatgtatttactgtcctaaggggtgtgtgtcttcatttgctttcatctgtcttgctccagggctgggaagagatgcagagcctctggtccagctgtggctttgagagaacaaacaaccagtgaggaccatgggttgggaggaacagtggaaagggagctgcagtctcagctctgccactctcccttgcgaccttggcctcgctaccactgcctttcccctttccaaaaagatgggggctggatgaagggtccatctgggttttgctagttctgaccatctttgcctttccctctgggaaaggaaatcgcaaactggatctactattttttttcttggatgctctacctcatgcagaccccaaatggaacacacccggcctccctggactgtcaggctggtggcctcgccttggggtagtgaacatgagaaaggcttccctttttcctgaaatgccccagagcaaccctggccctagttagagttgagatgcttttcatttcgccaggccttccatgccttgggtctttgactggagggctctggagccagaggccctgggttcagactccatcttggccactgctcgcagggagagccctggccacctactaggtgctttgagccctactttgttttcttttttcttcttattttattttgagacagggtctcactgtaatgccccggctgagtgcaatgtcgtgattactgctcactggagccccgaccttcctggctcaagtgattctcccacctcagcctcctgagtaggtgcgcaccaccatgcctggctaatttttaattttttgtagagacagggtcttgctatgttgcccaggctggtcttgaactctcagactcaagcagtccacttgccttggcctcacagaatgctggaattacagacgtgagccaccacacctggccaggcctagtttctttgattgtcaaatgaggctgctaacgggatctacatagggttgttttgagggggaaacatgtccattcctgcaaggtgtataggtctgtgacccgtgcgtggtgagcatgtttataactcaccctggaatcttggcaggacccccgtcaagatgccaaggcttcaggaaccagagacttccagggtttcacccggcgctgggtacggaggagctggtggaaaggccaggccttgtggccctcagctgggcctggctgtgctctcaggaggagccaggggagtgaaattgtgctgagtgagcccagggtcgcttcctttcccatgaaagcccctgtgagtacttttaacagccataaggaagtaatttcagttcttctgtcaagggtagaatcactggtgttagtggggtagctgagtgttaactgaacacacaggccctgatgcagtggatcctagagtcggctgggaagtttcctctgggtgtggcacgctgggttcgccttggtgctgacacctatctccttctggagccaggtggtgatcaggattctagaatcctgttgggttcagtacaggaggctgttgtcatccccagctgatgctgctgtggccatgggggaggtgacggaattgtgccccctctgatgcttgatctattccacgtggaaagctggagtcccgagaagcaaactccaggcaggcccacgctgactttcaggcctgtgcttgccgttttttgtttgtttgtttgtttgtttgtttttcctgagacagattcttgctctgtcacccaggctggagtgcagtggcacaatctcagctcatgcaacctctgcctcccaggtacaagcgattctcctgcctcagcctcctgagtagctgggattacaggcgcccaccaccatgcccggctaatttttgtgtttttaatagagacggggtttcaccatgttggccaggctggtctctaactggctggttttgaactcctgaccttgtgatactcccgcgtcagcctcccaaagtggtgggattacaggcgtgagccaccgtgcccagcctttttttttttttttttttttttagttggagtctcactttatctctcaggctggagtgaagtggagtggtgcaatctcagctcattgcaacctctgcctcccaagttcaagtgattctcctgcctcagcctcctgagtagctgggattacaggtgtgcaccaccatgcacggcaatttttgtatttttgcggggggttttgctatgttggccagtctggtttcaaactcctgacctcaggtgatccacctgcctcagcctcccaaagtgctgggattacaggcgcaagccaccgcgagccacagtgatatgtcgagttcactaacgtttagctttcaggtgctccctagcctttctggagatgcacaacagttcagtcacagagcctgtttctgtaggtgaccaggtgcactgcagtggcctggcgtttgacactggaatggctgattttgaatcctggcaaagccccccagctggttgtgtttgaccttgagccagtcacattgcctctcagaaacttggtttctttatttataaaatgggaataaaaacagagacgttttgctctgtaaaccatggggctgctctgagaatcaaatgcaatattttgtgtcactgcccttgttgaaccagaaaagtgctacacttgtatactgtggtggatcattatgactatgatttaaaacatccatgcctgaggagccaaatcctggggtcttttgtattttcatttcaatttatacacccaagagaagtgaaaacgtatgttgacacaaaaatttatacacgtatgttcacagcggcattgctcctaacagccaaaaagtggaaacaacccaaattccttccaatgatgaatggataaacaaaatacactacaccatgccgtgaagtactatttcatcttaaagaagaacaaagcactgccgcacgctgcaacatggatgcattttaaaacacgatgtgagcaaaaggagcctgtcatgaaggaccacacatcacatggcttcgcttgaaggaaatgcccagaataggcagatctacccagacagaaagtagatgtgtggttgccagaggctgggacttggggctgagagtgaaagggaatgggatttccttcggatgggatgaaaacgttctaaaattgagctgatcgttgcacaaccctgttaatattccaaaagcccttgctttggggtaaattgcatcgtatgtgaatgatatctcaatcaggctgtttttaataaaaatcctatgaggtaggaacaagtacaatctccatttacaggtgaggcccgggcttacaatgaggaaggcccagttaactgggcctggcggcctccagctccctggcatgcagtcccttcatgccatcagccctcactctacagagaagggagctgaggcccagcaaggaggaggggtttccaggctctgtgtggggtcttttcctcccttccagcctccccacccactggaggagagatttcctaagcagcgtgtggagcaggaccttcccagccctgccatggtacccgctcggcgctcaggccatgcagcccagtgggcagaatttcagcccctgggtcctgagtgaaggaaggagcaagctgttaggacgggcagggccggagcccgggactttgtctctgaccaaaacctctcagagtctcagggtcctgagaaaaatggggagaaaccctgccaccctctctgtgctgtgggggacccgcaaatacgggaaggtgctgcgagacctgccaggacttgccttgtgcgcagccgtccctgctggcttaggggtcagtccgggcccctgggcctctgccaggcaggtcacgcacaggctctcctcagagcacaggcctagggcagatgggggctggaactcacagaggtttccagtttccatgatgtccactttatctgtttctttttctgtcttgtgcttttggggtcacatttaagaaactgttgtttaatccaaggtcacgaagatttatgaccgtgttttcttctaaaagttttatagtttgggcttttacccaatagcgtttttatattgaaagaagcagtgtgcatatagcaagtcccaggtaagtggccactgcctttatttttaaatgattactgatgatgatcatttttatttattattattatccttactataattaatctctcgttgtctttcccatctgggtagctggctcttatttcttcttgaaagatagtattggtgtttgaatccatttctggcacacttaggggtgcagggtagaaggggaagatctgattacctgcctcccatttccccccaaactttgtgttatgggaaattaaaaatatttgagaagagagaatgccgcaacgtgctcccaggtgccacctcccagcctcatgcgtcagcagctgcagccactctcatttcatccgtccctcacctacttctgtccctgcccccaacccggattgttttgaaacacatcccagattcctatttaatctgtgagtcctttttgagttgcatctctgaaaaacgaatcccttggaaggtcgctgcctggagcctgggctgccggtggggttgggaggttgtgttgcaccccaggcatcagcaggagggtgggcatgggccagaaccacagcccccttccatgggcacagctggctcctctggggtcggctgcacagggcaaggcagggtgagcccagaaaccttgcgtcaggtttagccctaggagcccaggtgttgcagggtaatgagaatcctttcatttttgtgtctacaaactccttttgcatccatgatctccatgatgcccacagcagctgcctccggtaggctttattcagaatggaccttacccaggatgagtctcagagggttaactccagacacagaatcaatgtcagaggcagaatctggactcaggactctgacagcattttccattagaaggagcaaatccctgtgtctcactccctgctcatttcctgcctgtgaggatcgaggaggaaagagtatctctgacgttcatctcattctgctcagattctcagtggcagcttagcaaagggccagttgtctctgttggcatcattccatgggcttggggcctctgaaaaccctgagagagcttgcgctgtaggtgggcaccgtgacgctctgccccaggtgtgttccagccctcatcctggcaggggctgaatgtttctgcctagagccaggctgcccttgttagctccaggatcccactcttggtgtcctttagctggcaggccctgcgagggaacatgtgcttacaatttgccatggagacggcgctgcccttcttcctctgagtggtgataaaatggtacggaagctcacccacccagcagattggtaattctaagagacttgtgaaaaatacacgaggccctcagtataataggtaagctggaaagcttggcacaaagtccgcttgtggatagtgaggtgactggaaaaattctttgccctctctgttcccatcccagaagagatcgtgtttaggaagaattcttctgttaatgctgatgctttcatccccagtcaaaagctagttgacgcctgcttgtcagatgttttcccctttggtttcatgtagccgctttccctcatgagtttggcttaacttcatgtcttaatgaatctgagttctctctttaaaggtcactgtcctaacgcataaacatggaatcagaatcgccctcatttattcagagctgagcggagacttttcttgggacttcgaggggaggaaggagcacatctgtgttctaagtggcctcggttgctgagggagaattgggtcatcccatccacgtgctcggctgttggcccccttttggaaggaaggcagcgaatgcgtgggtggccctcccgttacctggaatgcctctagctggtggtccatcccgttctagaatggctcccctgtgcagccttcaagtttacctttacaaatacactctccattttctcagtctgtttacacccttggaaccagaggccatctttacagagaccctaagggcatctggagtattcttcatgtcacagatgaggagactgagactctgagaagccaagtgacttgcccaaaggtgactctgagaggtgacgacatcgggcgcctgggtttcttgactctaggtcacatagccttcccactacaccaggctgcttcctggtgtgtttaggggaagggagtgaggacagccaagtgcctttagctcataaccgaggacatgaacttgctagccaggactatagatctggcggggtgaagcggagaaggcttttgatcatctgagtatctgctgcaccccacataatgccctgagcactgtcagtgatgtgaagtctcttgagtggatgacctttttttttttttaaatttaagttctagggtacatgtgcacaacgtgcaggtttgttacctatgtatacatgtgccatgttggtgtgctgcatccgttaactcgtcatttacattaggtatatctcccagtgctatccctccccctccccccaccccgcgacaggccccggtgtgtgatattccccaccctgtgtccaagtgttctcattgttcaattcccacctatgagtgagaacatgcagtgtttggttttctgtcctcgcaatagtttgctcagagtgatggtttctagctgagtggatgaccttttaatgttgacatttatttttctttattttttttggagacagggtcttactctattgccaaggctggagtgcagtggcaccattgtgcattgctgcagcctcaatctcctgggcctgagtgatcctcccacctcagcctcccaaggagctgggactaggggcttgtgccactgcacccagctattaatgttgggctgtgaatatgatttcatacatatgtgtgagtctcggcggggagggcctcatgcatgacctgctctcttggaagcatggactgcatttaaaagaacaagctctgatgacggaatggtgccaagaggggtagttgcccatggagagctcccaaatgagacgagggatcaggtgtaggtgcttgggtgaggctgagactgtcaggagagaggcactgggtgtggctgcttggccccagggcagctctagataaaaccttccttaaggagactcctcggttagtccccaggctccatgtgggcggcagacttgggctctcccgcatcagtgcctggttcactgtctacaggcagtgggttggtggccaaatggcttgctgacggctggagggttctgccccgcatctaggtcctcgcacttatgtgcagggagaggatggctaaggggtgaggagagtcacaggcgtgaggactggaatgcgaggcctcccctaggttacgccggccaccactgaggccagaggaagtctttaaacattcagacagaaaggagcccagggccagatactctgccgcgaaatccaaggagaggctgatttcagagcagaagtgggaatatgagtctctggtttttgtgttaaaagtggcttttggcttaacaagtggtcactaggaccaaaataagttcacttaagaaaaataattccaaatggctctttctctctgtccataaggctcactaggaaggcagcactggggtgtgtttccccagcctgtgcaggcctcactgacgggctgtggagtgggtgagcagagggcaggggggctggctgggcggaggaatcacgctggcatgtctgctgcccccggctctcacaaccaagtatcacaaacagggaggcttttaacgctgcaggaatctcccagcccagggggccaacagctccagtcagggcgtcagcagtggctccctccggaggccctgagggcgaagcttccctgcccctctcccggctcccagtggtggtggtggtgggcaccttccaccctccttggcttgtaggtgtgtcactgcagttgtctgtctccacacggcctcctccctgcgtctgtgttcagatttctctcctaagaaatccagccaggggattcaggcccacccatatggtgtggtccacccatatggagtcctaactctgttccatccacaaagaccctgtttccttataaataaggccacgttcacaaatgctgaagggttaagacttgagaggacacaattcaacccgcagcagctggttgaggccttcttcaggccagctttttccctgagacccccacatcacaccagcattccagttttgtccttagaatcatggaggttgggagcaagggtgggctccttcgctatgtcagctcgggttggtctggcccacctgggtggcgtggggttctgcccattattttattgagttctgttctggacagcagtgtcttccccccatgtaagttagggttattcccctaagaagatagtaagttccttagagactggtttttgtcacggtttctcttgcatttccttcgtgcctaccccaaagctagtaggtacagaagtggagtacttgaggagtgttgggtggctggtgcccaccctgtggcgtgtttctctccaccacaccttcccgcagaccctctgatgactcctggcctcatcccactctcccgcccctgcctcagagtccttatcagtgcggggcatggggccgccactcccagaggagccagtgcctggagtggatctgcttccgggtgaggttttatctggagtcaggcggcctgccctgagcctggttgcagtttcctctctgtcttctgtgtggtgctctatttctgagtttggcctagtcaagcctctctctcagatctccaggtgactgctcgaaatgtcccagtgctggaatgcaccaccctccaccaaagctagggctggaggataggacaggaacggatggacgtgcagagggcgcgaggggtgagttgctacctggccctacccctgctctaaccagagcagcatgcttccctttcaggagtacatcgatgcccaccctgagaccatcgtcctggacccgctccctgccatcagaaccctgcttgaccgctccaagtcctatgagctcatccggaagattgaggcctacatggaaggtagggacacgtgtggcaccacatccgtggcaggcagccacctttgtggtcacaaagtggccacggcctgaggtgtggagacagaggggtcttgtctttttaagcactttggggcaggaagcatttgaattccatggtgcagtcattctggggaggtcctttcattctcctgtgaccagcagtgaggaaacaaaagcctcagggtgctcttgcggaagggggctctgagggttttgttttgctgtgttgaacccatgggtgacattgaagtgtcccggtaacacagtggctggagagcaggagtgtgtgtagacagctcagtggcaggcaagcaagtggagttacgtaactgcgcggaggacacaaacagaaactgaaggcctttaatcaaacacgtggagatgtaatgtggctgctggacctcatgggtccactctgttctggagggcaggggcctccctcttcactgcggcgcctcccctgccagctgcaggctcctgtccctgagggctcaccctgacgcctccccaccccttgggcaggcagagccagagaactcaaggccacattctcaaggtgtttatgtgagaaagactttgtggagagattcatgttaacagtaacctcctagttcactgcttagtccaagtgtgccctgctgagagctcttgtttaattttaaggaaaagtgcttggcctgggccctccggctttgtgaggatttatcctggggtcaaggaggcagcccctgctccctgccctacagaccatgattgaggcctaacctggctgccttgaaccctgacctggatggtgacttggccttgggcataatttcctgtgatggtgaccggtgggaccagtgggtaccatttggctcacagctccagaggcagaccatctgcatgggagtctgagaccaccatttattggctatgtgttgtgttcctgcctttgggttaggccttctccttgtattctcccttttggtactcttagaagtgggcatgataagccttcccattttacagatgaatcccagaggctctgagaggttagcagacatgccacgtcacgcagcattcaggtggctgggccagcatccagccaggtctgtctgactcaggctccccggcccctattcctgagcttgactttcatgtccatggccagagggccctggatctagaagaacctgaaatgggtaccactgaggaccctggcctggagagtaggtgagtcctcggttccctctctgaggaatgtgccctgcagaagagctggctgctggatttggctgtcctggaagggctcccgaggcctctttccctgaatgcctgacacaccgctgggtgcagagaatgggggtgtcatgctggtgccccatgtaggcaggctttcttagcacatgccagcagcctttatttgctaggcctggagtgattggcctctgctgtgcacttcatctccctttgcactgtcttcctggatccatccagaatcccagatgggaagaaagagctgtatgttccctcctggggtcaccttcatctcagtctgccatgggtgaaggtttggtaaaatttgggaaagggaatcagcctctttccagaaggtgtgcttgttggacactgcctgtgtgaagagcaggaggctgtattagaacatgagaaggcccagctagcagaagaaggtggcagaccagcagccacatctcatgtcccggacaagtccattcgaagagtgatgggtttgggtgggattcgaggaggtgccgctgaagggccttttggagccaaaagcacaggctctggcatgtgggttcctgtctgggctcttgttagccacgtggtctcggacaaatcagtcatttgagttctgctggtgttctggaagatatgggtgatacctggttcagccacggggtcaggggtcaggatacctgggatgatgtctgcagagcacttagcatgggaccggcccactgggtcacccgggaacagcagctgctccagctgttcccaccacgatggcaggaccccagcatcctaattgagtcttcacatccatcttagatttttaggagtagaagcccagggctggggatcaagggtgagcctgggctcagggtgggtgtgtgcacggtgtgttcaaggagcaggaacccggtgatgaggtggaccgtaggaagtcacatggtgagaggaaggcccaggaggtacctctgttgcccgctcgcctggcttggaattgggcctctcctggaggcagttaggaatcaggtcaggaattttaagcagggtgtgtcctagttcactgggagattagaaagtttaggagctacccataaggggagagctgtgggtgttccaggagagggccccgtcctcaacaggtccagggagagctgttgaccaaaccctaacgcatgcttggttctagatcagcaggaagtgtagggtgggtgggccataaatgttgcacgctgggttttccttatcgtgcacgccgagcctgggcttgtattcttccaggagggcggtcagaggctgggacttcctggagccctttcctgacccccagtggctgtccattcaccagcatcgctgggtgggtccctgctgcatgcccccaccagctgcagaggcagagagccttcctgggaagcacaccctgggcccccctcctcaactgcctgctgttcctggaggcactcagccctttcaggcgtactgtaaatggccataattacccttgaagttccctcagataatcacagcaatccagtgacacgcttttgtgctgggagaaggagcttggtgagacttcctccggttgtcaccccccctgccccggttgtcaccccccctgccccggcagtaagactgctctgttttcagagactctggacagctgcagggaaaacagagctggtgggggacgggtgggtgcttcgggactgctaggatcctcattgatgagcagtgggagggagacgaccagagcccctgctttgcggtgggggtgggcagttgggacatggcacaaggggaggctctcccaggaatagcaggcagagcccttggataagggtctgtgctcaggtgggccgtctgtctccctgcagagcatcagccgtggagggcctctcccaccccagctctgcatccaggagacagatgaggcctgctgctgggagctcccagcatcgctgtctccgggcagcctgtgtgaggtcactgccttctcagttccacattcccagagctcattcttgtctcattcagagcctggaggggaagcagggtcatttctctgcctcggctctggcagcttcaaacccacccacttcgtatcaattagcattcaagttgctttaacagcagacctaaaatcatggtggcttaaatgcgacagaacttcctttctctctgatgtaaaagcccagaggaaggccatccagcacgggcacaggggctgggaccctggctccttctagctccttattcttctgtggtctgcccatctggtcctgggtgatggctgtatttccagccctcacatccaagatctagacattaggatggagaggaagatcaagaaaaaggaagcaaatgagaagaaggcctagttctcttttaaggaggggttctgaaagcaatccagtgacatgtttttgtgctgggagaagggactttggccagaattagtcacatcctaagctgcaagggagtcaggaaattgagtccttgttctgagcagccacatgcccagctacaattcgggttttatcaccatggaagaagggctagaacgagttttaggggagcattagcagtcttccaagacatgggtccctgcctgaggacccaactttcccatggcagaacaaccttggaatttctcctctggctgggggtttggcctcggcctgtgacctcagcagcagtcccctctttgtagcaaccagcatcctggaggcttgcagaatgacccaccccagcatgccagggccctacctttccctcatagatgactgcttctgggaggcagccatgcctatacccatacccatgtccctccccacacccgcaccccctaggcagaggcacaggcagcgttgagcctggattcaattcaaaccaagcacttaattcttcctagaaattaagcattccctggtgcaggcctcggggagggagggaggaggccgcagtaacaaacattgaatttgcaggctctttctcccatcagcagcccactctgccacccagggccagggtccagagatggaagccccaaagccaaggcatggctgtgctaccctagggtgagcgattctgggcacggctctagctggctcccaaactggctgagaaggcaccatgtatgagaaggcacctgggccgtaattgcatggcgtgggtttgtgtccctgtcttcagggacagcaggtctcagaccattgggcaacaggctggagagatccttgaaagccctgactgctttggggtgatgggtggctctcctgttcttcttctcttagaagttcccatgtgtctgctctgggggtgacagatggcctgtttgggatcccaggcctccctggggatggggggtgcataccgcagattgaatgcttctgcctgtggttttacgggaatttaattagggctcatcttagaggccatttgaaacctgggttgaaattgagtagtctggatacaaagcaaagagaaagtaacattccttagagcctggagaaataattccccaaaaagcttttgccttgggggtgggtgtttgtgattggtggggagctgctcccagaggcaggaactggctctcaaccctcggggagctgcagaggggtggggacttggagtcaaggcctcagaccctgcccattgccaccgccacccctccaaccctccgccaattgtgtggcctctctgagctgtgcgtctgtcagcgcttaggcaggtgcttagtgtgccaggcactgggttaaatactttacagacagtacctaatttaatccacttaatgaccctatgaggaaggttctgatttcatctccgatttagaggtgaggatactgaggggctttgatcttaagttacttgaggtcacagagctagtggggcagatttgggatcagaatccacacagtgtgggtctgctcttagccagtggttcccaagccctgtccctcacccctgtgtgtaccccttccacacccccagttcccctgtggctgatggagagggaccgaggcaaagataggtagggatggggctctgcgcctgcaggtgagtcctgcctaggctcacctggtgctggtggcatggccatcatccctgggggtgccctctggggtccaggaaatgatacttgagggcagccacacatcatggcaggaaagaaggaccttgtcgctgataaggcttccaatcttagcccctcggggggctgggccagtcactctcccctgagttgttcactcatctgggaagtgggtcgccagtgcctcggacgtgctgagtgggcgtctcagctggtggccccaccccagatcgggcagagcgaccccttggtgtgcacctgcccatgcctcccccagtgtcagcctgcccagaccacagggctgaggtgaggggacagcgtgccccatcgaagggtctggaatgagggaggacagggtgccagggaggtagggtctctcaggggaggtgcttggtttgtggttccctttcttggacttcagggatgtgtgggagcaccactgtttttgttttcacatcggctgttgtctgccacccaggctgagacccgccctttcagtgcaggggaggctccgcagagcaggattgtgcttgtggctcccctgccctggggcggctaagcgccagctgcagaccaggccgggtaggtgcgttgccggcatgaggcggcagctgggaccaaggctagccctggtctgagtctgcgtgagctgccgtcctggcgtctgccgtgtggaagccagtgccctcccccagtccgggagtcatggggtgaggaagaaatggtgccccagagcatgtggaaccaggtctggcctgcaagggtggctcctcctgtccttgaagctgctccttccctcagctgtagcgttccccctttacagatggggggtgtggaaccttagagaggttatggtaacttagttgaggtttcagagctggtgcatcttcaagctgagctccatgttgatgccaaagctcaccctgttcccttacaacaaacatctattttacagctgattctcagaatccctcccatctccctgcccttggctgacccttctgtgggttctgctcctgtcctctggagccaggggccacctgtgcagccatccagacattcacattctaagacaagaccctgtcagcccccaggacctgggaatctcggaagcatcagtcctgctggccgggctctcagttgaggcagcagaggccagggatgttcagggcaggacagggcctcagggagcacgcccccacattcacactgccccgtcccctttcctgcacccccacagccaaagccagctccacatcaggcccacaggcctactcgcagccctttctgtgccatctcctcttccctggcctagctgcagcaggggtccctggagagtagtgagagcttccccactctccctccagcagcctcacccctttgtcccaccaggactggggtatgtgcctggaggacagtggcccgggagcctggatcagcttttcctggagaggttgtcaggtccaggcctcctaagggcactggcagagatgaaacagatgctggattctctgccaagctcctcatttccacagctgtgggcactgtggacagggcagcagcccctggcatcctgatggtaggcttgcagtgacccccatgagaacagaccctgccaggcatttgctgccctctgtccctcctgcccagggcactggtctggaggctcccaggagagactcaaaggagtggactgagctctcatggcgactggctggcaccctgcaggagagatgcaccttcatctagggaagaatgttcctgtctgttcactcagagcttaaccttgctgagcctttaagaccatggcagggacccgctccccagcaaaacaagaaggcccctccacccacagcccaccaacccctccagcgccctccagctcagtggcttctggacgagataccccacttggtccaggtgggcctgccccaggccttcctgcagagctttctgaaaacctctgtcccctctcaacccacaggcacccctcctctaggaggtactctcccaatgacatcagctggctccgatcacttttctagggcactgctgctgatcctaggccagttggtgaacagactgtttgtctttgggactctggctctcacccaaaattcctttcccctggctgtgttgactaactccctccagactccactcccaggctttcttccccctactcacactgagtctcctggctcccctgggatataagcagggtacatgggtactcaaaacctccttgttggtcagattggtcagaaggtatccaacagcagccatttacactttagtgtgaatttatagctcacttagtgtttttccagctgaaagagatcttgagttctggaagccctacaaaaactgctcttctccacatcctcaacaatgagaatagaggcccagagtggttgcatggctgacccaggaccactcagcacctttccgactctcagtccagtgctgtctccatgggacccacatctctgcaggggtcttttcagaagcagcgccatagtgaatctaaagtcagactgcctgggttcagatcctctcctaaacacccagctgtgtgcatttaggcaggttatttaactgcattgagccccagctttcctatctgtaaaatggggagggaggtaatgttggtggcaccttcctcataggttgttgtaaggattcctcaatagatgggagctctcctggcagacagtgcattgtgagtttcagaccacaccctgtgtgctgtgaccctgtgagtcctgtgtttctcaacttgcatttagtgctaaaggcagcagcccctggcgccctgatggtaggcttgcagtgacccccatgagaccagaccctgccaggcatttgctcccctctgtccattctgcccaaacgcccagccccgtgtttgcaaatgtgtacctgggtttatttccccaaacaagagtgtcttcagggtgaccaatcatgtaacacaagcgggcttttaaaaatctctttattggctactagatgatgtattgtagatttattataataaagttcacattgcacaggtttgtttagtgtaatttttatttttaagaaattttgacagagttgcaaagatagtacacagagttcccatataccctttgcacagcttcctccagtgttaacatcctatctgaccataattatctaaaccaggaagttcacattgataactattcaataattgaaagacctaaatgaattcgaatttccccagttgtcccactaatacccattttttagtccaggatccaatctggttgtcgctctctgtggtctcctgccatctgggatggagcctcaggttttgaccttgacactttggaaccttgactgtttattttgtggagtgtctctcaattcaggtttatctggtgttttcgtgactgggtcaaggtcatacattttcagcaggaacaccacccagcagtgccagtccctccctagtgcgtcatatcaggaggtgcatgaggacaacgatgtcttctgtctgctcagcagcagttatttggttaaagtccaccaggcttttccactctaaatttctattttttcctttgtagttggcaagaaccttctaagaggattctttgcagactgtctctcatatgtttgcccttctcttgtagcatccgtggatgggtgttgccattgttactgtggtatttaccgaacagtcatcatacagaattataagaactgtgtcccaaccaccccagttgccctagaagtgacaggatccccttgcagctttgcagacatccacagggcaccaggtggcaccttgtggagtgtcagcataatctcacgtgtgaacaaagggaaaggcaaaataaggaaaagagaaaagtgtcagatatgttggagaatcaggattacatgtttctttgctgcaggacttctcagagccttagtaatgtgttaatatgaatctttagtctgggggcagtgttgaatttcattaccgattgtaagatgcactgatacttcatattctataaaaaagaaaaaaatcctaagtaagttgtgaaatatcaattatgagacacatctcaatttcagagatggaaaatatgaaaaacatgccatagaatcagtgaagttctgcagaatttagccttttccatccagttaactatagagtcccctcctctctttgaggcttctcttgagagactgttgcactcaacacactcaggaattccctgactgggtgccttctggccgccctcacttccggccctgcacaggtctgttcttgagttccctgtattagtgtgtggggccctcattgctggtgcttctcgaatctgtttaactccagcctcacttccctgaggcagccactgttcatagtttggaacttatctttctagacccttcctattcatacatgtagagatacatgtgcacttttagtattattttttcattacagtaggctctagtgcaatgtgtacatttagaaacagggtcattttacacgtgtcctgatacagctctttgtccccactgaacatgtgtcttgcttcgcttctttccatgttagcccatgaagatgagggggatcaggtctgccccttttgctggcagcataatatttccatacatgaatgaatgaatcctaatttatgttgggcccataaggtcattccagtcttgtttggattttttttttttaaacaaactgggctgcagtaaacagctccctgcatatttctgcataattaatccctagaagtgggatttctcagccaaagattataaacattcctcactttggcagatctcactggattgcccttcaaaaagtttgagcaaatttcactcctgatggtgccagtctgcctggggaagccgtacccacctcgattgatgtgtgtttgtcgttattggcacaattgagtatcccatcatggattcactggctccatttgcttgtcttctatgaatgaatctttgcctgttgtttgcctattttttagttgagttgttgggcttgttgattaattagatccctttttgtatgaagaaaattgtcccattgttaaaaattgtggacgggttcatgaatgtaagcgtcatctttgctctgggtccaagctaagatgttttgcttttagaataggtactaccagaaagagccctccaaacattttaaaaatgtcttgaaagtaaaaaaggctgccatgttttgggagcgggagctggagctgagcagggacagtgagcgtctgcctgggtccagaaggggctgtaaatcagtgggagcagctgccacagagtctacccacgtttccagctactgccgccagactcagacatcgggcgcagaaatgcctgtctctgtctgagccagtgtctggctcctcttctcctgggctttggacattgtggttgcaaacagctctctggtcacataagatgaaatgagtcactagctaagtcaggtgggaggaaacctgctcttcccctgcccgtggcttgctgtattggactgtaactttgcacctgtggcatttgttgtcttctcttctcgtcctccagtgttttctctccacagcttgcctgtcaccaggtagctaagtgaggatctagctgctagcagggaggttgcacctgtggtaaggccatagggtctcttagatgccttcaaggagcagggtagggggctgtggccactggcgaaatgccccctgctttcccccagtgactccaaatatcacaattgcgtttcccccttgaaagctcatagtagctggatgtgttaatttcctattgctgcatgacagatgacagcagattgagtggcttctgacagtacccatttattatctcatgggtgggtgggtcagaagcccgcatggtgtggttgggctcttggcccagggtgtcacgggctgaaatcaaggtgtccgcaggggcaggtgatcttctggaggccctgaggaaacatccacctccaagctaactctcattgacagaatccagttcctggtggctgtaggactgaggtccccacccttgctggccagcagctcctacaggtcctgtgtttcttctcacggtgcccctctacttgcaaggcggccacagctggccagtctccttgtgctttgaatctccagcttcctcttcagagaagaagctctgtgtgtgatgccctaagagttacccagaccatctccctgttttgagggcagcaatgcaacagaaccgagtcacagaggagaacccatccatcatgcatgcagttctggcgatcatgcagggtgttgcccggccacagggatcttggggttgacttagattctgcctgccacactgagtaatacaatggttttcccttgcatacttataagttcaatggaatttaattgctatcattgcatctctccaggccctgtcacctgtgctgggtgtcttggggcatgtcgcccctgcccattccctctcctgggtggcgtctcctgtcatactgcccctgcactccacactgcagccaagccgaaccccaggggcacccctcttgacccttggcctttgtccatggtgttctgcctatctggaatactcttggtccccaggactaactccaactttggggtttggctcaggccacttcctcccagaagccctctgtgctgcacactcccttccctgcgtgggcctcagtgccttcctccctactcacagaccctttgctgccctcatcgcacattcattccactgtttcgtcattgtctgctggccgctgtcttccccacctgaccgtgacagccttgaggacaggggcgagtgtgtctttggggaccatgacaggtcagggcctggaacatagtacctgctcaataagtatgcaaaggagggaagaatgttttcaagaatcagatacataagaaggagatgcactgggggaggctctgagcagaaatcccactcccatgggagataggcctggggcaggtggggtcatgggctcggggccacaggaaggggtggtcctggttgtctgtggggctctcgcggaggtggtatttggagcggctctgaaatactgggctcaattagaggaaggtgggagccattccagggagagggagcaggatgttcaggagaaatgggggctattggtgctgcgggagagagccccatgccgaggcccagagggcctccagggccagtttctgcttagcctatgcggggagagagggaggccattgggaggctgctgtggcttctggaaaagatgctgagggtgtgatgagggtggtgactctggtcaggaagaaataggatggaggccagaaattgagggggaacattggcaggcatcagggcaggcattattatctgggatgagttaaggagaaggaaacacaggacaagccataaccacaatctgtgtgccagctccacagggcaggacagtgctggggggctccaagggtgggccaggtgtctccacggcggccaagaaaaactacaagagaggccgggtgcggtggctcatgcctgtaatcccagcattttgggaggccaaggtgggtggatcacctgaggtcaagagctcaagaccagcctgaccaatatagtgaaaccttgtttctactaaaaatacaaaaattagctgggcatggtggcacgtgcctgtagtcccagctacttcggaggctgaggcaggagaattgcttgaacttgggaggctgaagcaggagaattgcttgaacctgggaggcggaggttatagtgaaccaagatcgcaccactgcactctagcctgggcaacagagtgagactccatctcaaaacaaacaaataaacaaacaaactatgagagagggaccctttgtaggcccccaatagtaataagtccccagcctgggccaaatcccagggcttcagtgataaagattccatttcaacaggcagagatgagaagggagggcattccagtggcagatacagcacagacaaaggccaggcaggtaagaaaggccaagttatcaccaggaatagagatggtccctcttggtgagagcctttcttgttttggggcatggggtggtacaggccccctccacctggcttggagtggacttgttggccttgtcatgggccagagccctccacctttctcccctcctctcaagccttcagagaagtttctgtcatggagttcactcggctgcctcaggggctctggctcagccaagaacattgtcagggctgggtggtgttctctttgtgttttctctggacttgttctggcaactgacagccccagatccagccttgtattttaaacacgaggatcctgcatcgaagctgtgtgttctgcccaaagatgatccaggcctcagtgctcctctggggctggtgtatagtctgttatcacactgctataaataactacttgaggcctgtcatggtggctcacacctgtaaacccagcactttgagaggctgaggcgggtggatcgtttgacgtcaggagttccagaccagcctggccaacatgggaaaaccccgtctctactaaaaatacaaaaattagccaggcgtggtgatgtgcgcctgtaatcacagctacttaggaggctgaggctgcagtgagctgagatcacacactgcataccagcctgagtgacagagtgagactctgtctccaaaaaaaaaaaagggattaaaaaaaacctacctgagagtgggtaatttatgaagaaattatgaagaggtttaattgactcacggttttgcaggctgtacaaaaaatatggccagggaggcctcaggaaacttacaatcatggcggaaggcaaaggggaagtaggcatgtctttacgtggcagcaggagagagaaacagagcaaaaggggaagtgcgacatgctagatttcatgagaacttactatcacatgaacagctagagggaaatctgcttccatgatccaatcacctcccaccaggtccctcccccaaattgggaattacaatttgacatgagatttgggtggggacacagagccaaaccatatcattccaccctggcccctcccaaacctcatgtccttctcacatttcaaaacacaatcatgccttcccaacagccccccaaagtcttaactcattccagcattaactcaaaagtcccagtccaaagtctcatctgagacaaggcaagtcccttctgcctataagcctgtaaaatcaaaaacaagttagttacttccaagatacaatgagggtacagtcattggttaaacagacccaattccaagagggagaaattagcccaaacaagaactacagggactgcagtccccatgcaagtccaaaacccagcagggcagtcattaaatcttaaagctccaaaataatgtcctttgactccatgtctcacatccaggccacactgatgcaaaggatgggctcacaagacttgggcagctccacccctgtggctctgcagggtacagccctcacagctgctttcgtgggctgacactgagtacctacagcttttccagggacacagtataagctctcggtggatctgtcattctgggatctggaggatggtggctctcttctcacagctcccctaggcagtgctcctgtggggtctctaacatcacatttactctctgcactgccctagcagaggttttccatgagggctccacccttgcagcagacttctgtctggacatccaggtgtttccatacatcctctgaaatctaggcagaggctaaaatcttgccttcagcacacctgcaggcccaacaccatgtggaagccaccaaggcttggggattgcaccctctgaagctgtaccttggccccttttagccactgctggagctggagcagctgggatgcaggatgccatgtcctgaggctgcatggagcagcagggccctgagcccagcccacaaaacaatttttcccttctagacctcctggcctgtgatgggagggactgctgtgaaggtctctgaaatgccctggaggcattttcccctattgtcttggctattagccttcagggcttcttatgcaaatttctgcagctttgagttcctcctcagaaaatgggtttttcttttctaccacgtggtcagcctgcaaatttttcacttttatgctctgcttcccttttaaatataagttctagtttctggtcatttctttgtttttgcagatgagcataggcttttagaagcagccagtccacgtcttgaatgctttgttacttagaaatttcttccaccagataccctaaaccatctctctcaagttcaaagttccacagatctctagagcagggacacaatatgccagtctctttgctaaagcataagaagaatgtcatttactccagtttccagtaagttcctcatctccatctgagacctactcagcctggacttcactgttcatagcactatcagcattttggtcacaaccattccacaagtctctgggaagttccaaactttccctcaccttcctatcttcttctgagccctccaaactgttccaaactctgcccgttatctagttccaaagttgcttccacattttcagatatccttatagcagtgccccacttctctggtaccatttttctgtattagtttgttcttaacattgctataaagaactacctgtgactgggtaatttatgaagaaaagagttttagttgactcccggttccacaggctatacagaaggcatggctggtgaggcctcaggaaacttacaatgatggtggaaggtgaaagggaagcaggcacaccttcacatggtgacaagacagagagaaagaaggatgaagtgctacacccttttaagcaaccagatctcgagagaactcactcatgtcatgagaacagcgagggggaaatccacccccatgatctagtcacctttcaccaggtcctcccccgatgctgggaattacaattcaacatgagatttgggtgcagacagagagccaaaccacgtcggctggcttagaagtttgctgctgatctgagttcgagttctgtcatggtaggtagatggacgagaaggctgcaccttccttaatgcctaagggtcaagagttccatctttgggcaggaggaagcaaacatgtcactcctccagtattctctactcttctttctcccctgcctcccccagggccatgtcagactgcagagcagtgataggctctgtaaggtgatcttggatggttttaaatggcagaccttcaaatagtaataccagtgatgatgatgacgataatgatggacaggatgttgggatctgacacttggtgtcttctgcatgctggtttctgttttaagtgctttgtgtgttaacctgtttgatccttacagcaatcctatgagcaggactgctcttattgccattttacagatcaggaaatgaaggcaccaaaaggtgaagtaaccgtctcaagttcacacagtatggagcattcagccaggcagcttctgggactggctacagtgtttgggaagcacagctggcccagtgcctctgtttcctggtccctgaagtgggaaaggagccttccttaactctttccagactcagtgttcttaagtgggaatgatgagactggagaccagtgacaaaggctattatgcagtggtttgcccagcagtcaagggtattctttcccgccacatgctggctttgatcttgaacgtgcaaccaactcagggcctctgcttctcacatgcaaaatggagtggtgatagtgatccgtgctatggcattgctataaagatgacacaagttgatgcctgcaagtgcttgttgatggcgcagagcacactgcattgcttgtctggttattgttgacattaagccctgcatatgctgtgttaagtgcccaacacatgtcatctctatgagccttcattttggttgtctgttagatggaaatccaaaatgataatggtgtttcttgtgctcatgaatctgcagcttggctgggctcagctgggtggttctcccatgcagtcttgcatggcagtttagcatgatggtgacagagtagccagactactgacttggcagctcagggacccaggggtgtgtcccgagaaagacagcctctctggccttgcttccagagtccatattctatttatctgtgaggctctagggccagttcacattcaagggaacagcatttagggtctacttcataatggaaagaagcatgtaagaaatagagactgagaagtcccacaatctgctatctgctaactggagacttgagacctaggagagctggtggtgtaagttatagtctgtattaggtcattctcacactgctataaggacatacccaagactgtgtcatttataaaggaaagaggtttaattgactcacagtttgcagggccagggaggccttaggaaacttacaatcatggtggaaggggaagcaaacatgcccttcttcacatggcagcagcaaggagaagtgcagaatgaagcaggggagcatggggggagccccttataaagccatcagatcttgtgggaactgactatcatgagacagcatggaagtaaccgcctccatgattcaattacctcccaccggctccctcccatgacatggggatgatgagatttgggtggggacacagccaaaccatatcatagtccaagtccaaaggcctgaggaccaggagagctgatgctataatttatggttctactgcaggagactgatgtcccagcttgaacagggaggccaagtgagtgaattctttcttacccttccttttgttctattcaggcctttgactgattggacaggctccacccacattggggaaagtagtctgcttgactcagtttaccaattcaaatgctaatctcattcaggtacacggagaacaatgttaaccaaatatgtgggaaccctgtggcccagtcaagctgacaagaattaagcgtcccaccatggcaggcctgctgtgttctaggctctagggcaggtcccaggcacacagagatgagcaaggcaggcatagtccctgctcccaccgagcctcctgcctcatctgcctccatcagggaggaaggaactgcgtactggggcaggggcacccaagaagccttaatgtcggaggaactgggtactgggtcaggggcactgcctggggcactgagcctgcaccctgtggcggagcttgattgagaaaccgagcaaggctcattttgcccagagcttgggaggagggaggcataggcaggcccttggccatggaggacttcaaggctggcaaggagtctggacctgattccgaaggccatgggagccgttggggagcatggagcagcggctcagccttaggctgggctttacaggtcacacctcccgagttctcccttgccccctcgcaacagcatgaggcatgccaacactcaggagatgccacttccctaccctctcctcatggtgggtccaagggaggagacacagtcctgccctagcccctgtgccctgaagctgtgaagtcactgcttagtccatgtggcaagggcctggccttctctcacacccccgctcctcctgtgaccacagtcctcatgtgacccttcctttcctcagtgaaccggacggctgggcagcacccagtcctgctggggaagactcactccaggctgcctttcagtgacccaggccccatgggccttttgccattggccttgagtgccttcagctctgagttcctcagtgcctaagcagcacgggaagtgccttctctcctcccttgtcccacgagggcacctgagagggccactgtgtccttacgcccgatgcccatgagagatgctagctcctggggagctcctgagactgtgcaccttggattggaacctgggctcgtagctctgtgtcctacatgtatgcatcgctgcacatgcctggcctgcccaaggcccttgaggttgctgcattagctacaaggggctgcgaggctgagggtccactgctcctaggagccaggcagggctgtcatagattttcaggtggcttccaggagccaggctgtttgtcctgcatccccagggcatgccagcttcaggatctggaacttttaatgtcttcacaaacaaaacacaacatgtcattccagttttatctcatccaggactgttcatagacctttaacacacgatgatgtcactgccatccaattgtttccatcctttcggaagcgcccaaatcccctacaaatccagccctgctcagtgccagcccctgcaggggccccaccctccaggggcccccaacttcagggagagatgagtcactcatcctaagcgagagggacagttcggaggtgttagggatgtaccctggaggcacagggcaagggcagctcctcagcatagccagagggatctggtgctctgccaatctgcaggagggcagggtgggggcctaggcagtcaggcaccccagaggggcatggaggggccctgcctgcgggcaaggcacatggctttctaggatggaatgcctggagccctccagccaggccacgtggacaggaccttgtgctgtggtggtgagggtgcatccagcccctctcttctggctctaagtcccttcagattgggaccacctctgtctctctgtcgcttgcatcccggggcctctcacccgggcccttcctggcatccccctcctggctcaggcctgtgcggccctcccacccacgtgcctgtgagttgactgtgggtgttactgggtggctgccatcgtcatcgctggccaaaaagccatttgggttgtttccagagctgctgtcaggctggaacttggttcacccggatgcacagaacatcttccctgtctagaattcaagagcatgtgactcccgccccctaactgcataaccacagagggaaggtgactttggatgagtccagggcctgaatgagtccagagcacttgaacttacagatgggccggccaggctctttccagtcctgccacagccatcttcaaggctgttccagacccacagcgccacagggtggccaggcgggagattgcaggcccctcctccttcctttgcaggctgtgccaacactgggcttccctcctccttttgtttccagtgcttacggctcacttatcccatccatcaacttatcttcacacgtgcacatgtgccagagagatggttcttactgaggcctgccttctcctgtccccaaggaacatactgcctagttactgaatcagaacccatatatgaaaatttaatagcgtacaagaggtaaacaacaaaactcggtagcagtgccagaaaaagtactagaaagacgtgactgtgggtaggagttgcagggtgaatgccactcgaggcagcagcatgggacagcgtgttcttgggggctctgcagaacagctgggattctgtgatgcttggaagagcaggtgttgccaagtgaggcatggaacggggaccatcccagagatatagtggggacagtatatccacctggcacaagggtttggctgggaacgatcttgggttgtgcggtcagagaagagttgggcgcggtggctcatgcctgtaatcccaacacttttggaggccgaggcgggcagatcacttgaggtccggagttcaagaccagcctggccaacatggcaaaaccccgtctctactaaagacaaaaaaattagccaggcatggtggcgtgttcctgtaatcccagctacttgggaggctgaggcaggagaattgcttgaaccgggagggggaggttgcagtgagctgagatcacgatgcctctgcactccaacctgggtgacagagtgagactctgtctcagaaaaacaaataaacaaacaaacaaaagagttgggaagtatattcatttgcgtgggctgcatgacagtgctgcatttaaacaacagcaatgcactgcctcccagttctggaggcagaagtctcagatcttagtgttggcagagttagcttcttctgaggcctccctccttggcctgcggatggccctcatctccccacgtctgcacatggtcttcccctgtgtgtgtctgcgtcctaatctccttataaggacaccagtcctattggattaggacccactctactgacttcattttacctctttaaagaccctatctcccagtgcagtcccgttctcaggcatggggattggggcttcaatatcaacttggaaacagcgctcagcccatcacaggaaggtacagagtcaggctgcggaggcctggaaaggctgtgggcttcactcgcggggcatggacgccttgctgggagctgtctcagtacaggtgagagctgtaggacggtggtttgtgggcagaggatcttgtgtgtggagatgatgattatggagtgaggggaccaacaaggggcttcctggattaacagacttcaggaacatcgattccaggagctgggaagaggtcgcggtgctgggccacagcccttgttccatcagtgtcccaggagggcaggccagagcaggctgggggtgctgtgctggtgggtaccaggcaccccgaggagggtgggcatccatggaaacagggctggacaatacgattctcagtcattccgaatgcccctcatgggcgtggcctcaccgcgtccctgcaaccaccccgggaggtgggcggcatcactggcctagtttacagatatcagatcagagcattggcggtcccagtcatggcaactgggctggccctccttttgcttcctgggctttccctgccatgacagcttcctccctgcagtgtccctggcttccctggccctgggcattgtggcatcagtgctgggtgcccctgttccttggcgtgttactgacatttgacctacttcttggaccctccccagcagaccttgcgtatgacggtccaggtgatgacgacaatagtacggcgagtttttcatgcacacctgctagtgccagggtttaaacatgaggcccatcctcagcatctgctggatgctggccacctctgagtgagggcagtgggaccacgacgatgagtgggggaggggtagtagccctctgaaccagatgctgttctagtcctcattttacagcaaggaaactgaggcatagtgaggtaactgagacaaaacaaagcaaaatttcttggccagggtcatacggctgatataagatggagccaggattaaaacccagacagcccaggtcctctgtggatcctgcagagtgcccagtcgggtgggggaggtggatgcttcattagttggccaagatgagcagcgtggggcccttgggtggcacagcaagggggctgctcccaggtgagcaggaagagggtgcctgacccatgttggaggataagcaggagtcttccaggccatgggttggtgctgggaggggaaagaaagggcgtgtggggctgagatagctgccctggggcctgagaagtccgggggtgggtttcactccaacccccactttcaaaagatgctgtaaggctggcccggtggctcatgcctgtaatcccagcactttgggaggccgaggcgggcggatcacggggtcaggagatcgagaccatcctggctaacacggtgaaaccccatctctactaaaaaaatatgaaaaaattagccagacatggtggtgggtacctgtagtcccagctacttgggaggctgaggcagaatgttgtgaacctggaaggcagagcttgcagtgagcagagatcgcgccactgcactccagcctgggcgacagagcgagactccgtctcaaaaaaaaaaaaaaatgatgctgcgagaacttagatcctgctgatcctgtccccagtgccctgctctatcagcaacacaatggggcccctcttgccccagtttcctgccatataatatgggcccctaggaaccgggagtggcccaggaagcaggactgagcgcagctctaagagccggtgtcggaggcacacatagctggggtctcccacgtgcaggggcgccctgggatgtggaccagtaaccactgtttgacacctgcctcctcccctgagggcatcccccgctgggtgcctgtcgtgtgccaggcctcccagcagctctctagggaagcaacactcccattttatagagaggaaagcaaggctcagcagagttaagtcgtgtgcccaaggtttcagctagtggaagtttgccccaggtccagcgtcgggctggctggcttcaaaactgccccttcaggtgctcatttcctcctccctccacccctgttgtcctctcgggtccacctgtttgtcactgaacttttgttttcttgtaagttctgtagctgctaccggtcggatgagggaaaggtcacctggtggagtggatgggtaatgaggtgtgacgcgggaggccagcctttttctggctctgctggtaactcgtgtggccttgaactagttccttcccctttctggacttgtggaagcctgtggctgggacttgcccatctccacgtgccctcccgcttcatggtgtctgatttggaaaggcagagagggaagacgggagcatttccgtttcccaggggctgatattcgctctcaaaagaacacaacccaccatccaaccaaagaaagcctcattccacctcccatccaaaaataaggatggcagagaaataagcaacagtcgcctttttcagggaaccagaaatagcctcccgggctccccgctctgacttcccaagtcttcattctgtctctattctgggagaagagctgctggcgccaccactgcgagcttctcgtgatcgagagggaggaacccctgctgtcgctgtccctcaggcaggcagaaggggcttgtctgctggtactgagatggtgggggtgcacctgggcgccacctgccagtgaagacagctgggcctggttccttcccagcctcccactcagctggagcgttctcaggttgggtccagttcatacatcctaagagcagcaggttgggcctttgcaccggctgttccctgtgcctcgttggcgcctccccacccccccagtctttggaaggtgcccctcaccatgttgttcaaatcgcataccccacctctgccggcacccccattttgtggttaatgtttccctgccagctccggccagctatacatttcatttatctctctggattattgtctgggtcccttccactagaatgtaagctcctcgaggacagggatgcctctgttttatttattactatattgttagctcctggcatctagtagaggctcaacatgtttttctgttggtgaatggttattggaacagtagtactctacgtttcttatttactctcacttcatgggtgtgtcgggatgcttttggctaccagaaactgactcaagcggtgcagacatagcagcctgtcatgcccagcaacccgagcgggggcagctcgggatgcaaaacagtctgtgtccactgagagatggggtccttcccagcatgtgctctgtgggctcaagactgccttcagcaaaggctggtgcccaagcttggaatacgagctcatcctagcagtgtggctgggcgagtctcagttgagtccccaccccacgccagagcaggagtggtccaggcagccggtgtgtctgccgctcagagtgtggtcagcaagctccagcctgggacgaatgaacaagaatgaccgtgcagacctttcctggccacccaattcctgctcccacctaggctgctgtcttaacagagcctgggatttcagaagggtgggggtgtctggcctgatgctggatgtggcccattctttgaaaatgtcttgttcttgcatttcgtctggactccagacatctctggaggaagatgggctccccttgttccttctctgacttcacctcagacccagtggggatgaggaacaagactcaatgcgtgtgtagggaggactggaggagaccgtggttgtgaagcatttacttagcccagtgtcctgcagagggcaagcactctggatgacagctactgctactaggttttttttccccttaatgtattgatacaatttatgtatcatacatttacctttctattttttttttgagacagagtctcgctctgttaccaggctggagtgcagtgacgcgatcttggctcactgcaacctccgcctcccgggttcaaaggattctccttcctcagcctccccgagtcgctgggattacagacatgtgccaccacacccagctaattcttgtatttttagtagagacagggtttcaccatgttggccaggctggtctcaaactcctgacttcaggtgatcggcccacctcggcctcccaaagtgctgggattacagttgtgagccaccatgcccagccaaatttaccttttttaagtgtacatctagttctgtagttttgattatattcacaaaattgtgcggtcatcactactaattctagaacattttcatcacccccaaaggaatgtacccatttgcagtccctcccagttccttccttccccagctcctgtcaaccattaatctctttttttgtctccatggatgtgcgtgttctggacatttcagataaatggaatcttacagtatgtggtcttctgtgtctggcttcttccacttagcccagtgtttttatggttcttccatgttgtagcatgtctcaatactttgttccttttcatggctgaataatattccattgtatgggtaggtcacattttgtttattccttctgcagttgatggacttctggattgttgccccatttggactatgatgagtaatgctgctgtgaaccatttttaggattttatgcggacatatgtttccattctcttgggtataagaagtggaattgctggatcatatggtcactctgtttaactgtttgaaaaactgccagactgtttcccaagcttctgtaccatttctctattcccaccagcaatgtatgagggttggaattttttccataccctcagcaacacttgttatttttggtctcttttattatagtcatcctggtaggtgtaaagtggtgtctcattgtggttttgatttgcatttccccgatggctaataaggtgcttattggccatttatatgtcttgttttgagaactttctattcaaatcctttgcccatttttaaatagagatatctttttaattgttcagttgttgatagtgttttatatatttcggatactagacgcttctcatgatttgcaaatatttcccccattctgtgggttgtctttatgttttctttatagtgctctttgaagcaaaacattttaaattttgatgatgcccaattctatttttccttgggttgcttttgcttttagtgtcctgtctaagaagccattgcctaatgcacggtcatgaaggttcacatctatgttttcttttaaagttttgtagttctagctgttataatgagatcatgatcagttttgaattaattttgtatacgatgtgaagtagggttccatcttcattcttttgcatgtgaatatccagttgtccaagcaccatttgttgaaacgaatattctttccgccccttgaattgtcttggcacccttgtagaaaatcagttgagcatagatgcacaagtttatttccagattctctgttctattccattgatctgtatgtctgtccttaggctggtaccacattgcctcaattactgtagctttgtagtaagtttcgtattgaggaagtgtgagtcctccaactttgtttttctttttccagatattttagtggtcctgagtctcttgcattttcataggaattttaggaccagcttgtcatttcctgcaaagaaaaagctgtagttttgatggctatcatattgagtctatagatcaatttgggagtattgcccacttaacaatattaaatctcctattaatgagccttgtgtgtctttccatttattgaagtcttctttaatttctttcaatggtattttgcagttttcagtgtttaagtcttacacttattttttaaatttatttctttttgatgcttttataaatggaattgttttcttaatttcatgtttggattgttcattgctggggtatagaaatacagttgaggccaggcatggtagctcacacctgtaatcccagcactttgggaggctgaggcgggacaatcacttgagccaaggagtttgagacaagtctgggcaacatagtgagacccccatctctaccaattagttgggtatggtggtgcagttactcagaaggctgagcggggaagatcccttgagcctgggagtttgaggctacagtgagctgtgatcgtgccactgcactctagcttaggcaactgagtgagaccctgtctaaaatacacatacataattttctctttttttgatatggagtttcgctcttgttgcccaggctggaatgcaatggcgcgatcttggctcacgtcaacctccacctcctgcattcaagcgattctcctgcctcggcctcctgagtagctgggattacaggcgtgcaccaccacgcctggctaattttgtatttttagtagagacgggttttctccatgttgatcaggctggtcttgaactcccaacctcaggtgatccgcctgctttggcctcccaaagtgctgggattacaggcgtgagccaccatgccagacccataaatataatttttaaaaattaaaaaagtacagttgcttatcatatattgatcttgtatcctgcaaccttgctaaactcatttattagctctaatagttttggaggttttttaaatatgtgcattccttgggattttctatgtataagatcctattatctgcaagtagagatggtttcacttcttcccttccactctgtatgctgtttcatttttcttgcctaatggccgtggctagaacctccagtacagtgttaaatagaagtggcaagagcagacctccttatcttgttcctggtcttaggggaagtgtctagtctttcactggggagtctgggtttttctagaaggttgaagaagctcccttattttcctagtttgtggagtgttcttgccatgaaagggttttagattttttcaaatgctttttctgcatccattgagatgatcatgtggtttttgtcctctattgatatggtgtattgccttggttgattctgtgtgttgacactgctattgttatgaggtttgccacagagcagagtagcatgctgtcaggaaccccctgagccagggagctccatgggcactttttctgcgagggaggctgtagtcaacagcaggggcctgggagtcagatggtctgggtatgacctcctggctgtaccactggctcaccatggaactctatgcagggaaatgccacctctgtgccctagtttcctcatctgtaaaattctcaggggacaggagtgcttccttgtggggttcttatgagggtaaatgagttactgtgtaactacgttgaacagtttctggcatggaacacatgcagtgttttgagacattggctactggccactagtgacattatgtaaaagcttggatgggccagggtggggagggacagttgaggagggcattgaaatctgaaagccaagctgattcacctgctctaaaaactccggggggccacagggagtctggaagctcttccaggaggtggcctgtttgaccccagcagcctccaaatcttcctgtgggaggaggggccaagggtggagcccaggctggtgagcgcccgtccgaagcctgcctatggcagaaccctccagtttaaattcaggcctgagcaccatatcctttgggactgggttgcaggggcggtgtgtttgcagcgaggaggcttttgctcagactgcttcctcccttgacagccatggagggcctgccagccctcacagcattcccgccctgcctggggccttgtttggaaaatggctttcagctgagcaccagctcccctccctccccaccctgactttcctgacttcccctctcctgtgctgccaggtgagcctggctccttgtcctggctctgccgttgaccactgtatgaccttggggcctgtttctggacactgtcagggaccgcttgggattgaacaggcctctgtgcagagggcctgcaacactgtctgccaggggctcaggaaacactggctccagaccaccctcccagtgccccagagaaactgcaaccccccaaatctttctgtttggagtttagactgtgagggtaggagtcggggaacgggggaatgaggatgaggagggagataaaagcaattttatatgccctgtgtaattcttggcatttgtttttatgacataaatgaggctggatctaccttgatttaatgtcctgacctcctagccagccaagtagctagcagctcgagacagtctgctttgctctgtttacttttggtttggtttccaagcctgtgggtggcagaccgcccccgccccgctcacactcagcctttcctggcccctgtgccctgaagtacagggtggtcccacctttgtggtcttatcagggaagggggacaatgacaagaaacaataataacaaaccagtaatttcatcatcagcagagagattccaaatacattttgttatcccacaaaaaatcagtttacccctgctcggtgccaggcacgagtcaggatgaacagaacaggtcagcttttgagggttttaggaagttggactcactcttagaatccactgggtgggcctggagaggggcccaggaatgccaagctgtgaagggcgaggaggaattggcagggggaccaggcgcggcctgggctggagcatgcagcagagatgcagtgagcgtggtggggaggccacctctggagctccacacaatgccctcaattatgttaagtagtctgcaggtgaggggtcaggcagtgtccatgtggaaacagttgtgtcaccaccagctagttctttaatctctctgaccccagtttcctcctcatgggattattttgcaaactgtggaggtgatgccggcaaagccctcggtacagcgccagacgcatgctaagagctatattgtcactgcgattattattaagccagtgtatcacatggtgggaaagtctttattgaaccagaaaaaatggtcatggcttatgaagttaggattcaggttacaaaatttgtacagctctctgcgtgtaaatgtacgcgtgggtaaaagtccacagtggtggggtagtagttgtaatgtcttgtcaatatgtacattttttacttttctgtactcttcggattttacacagtgatcatacacgagttttgtaattacagaaatgttattagacaatgtaacggcagggctgtggttattgttcacacacacgagcacatgggactgcagaggttggggacggtcagatccaggagcgtgggggcactgaaggcccctggggtggggcgggctgtcacaggacgtgcacctggggcggctgcccaggagctgtgctgaccaggcctcccttctgccctagacgacaggatctgctcgccacccttcatggagctcacgagcctgtgcggggatgacaccatgcggctgctggagaagaacggcttgactttcccattcagtgcgtaccatcccagctccacctgagggcaggcgctgtagaccgcaggccagcataggggaggggctgggtttatagtgccctctggatttaagctcacccgaggatggatgagcacatggccctgggtcccacctccacccacaccatagaaacgggtcctggtaggggacacaggtcaacgtgctctcctgcctggcctgggggtgtctacccacacgtcaccctcagtgcagataccaggtgtccagagtctgtgtctcagctagagttcctttctagacgtgccaagtacctgccttgtgggtgaacggcctcactaatttctctctgcttttctctccccaacccatagtttgcaaaaccagagtggctcatggcaccaactctcacgaggtgagtggaagaagatctgactgttgtccctgacccccatcctttcagctcatcgtgtctcactgctaccctgccggattcctcactgccactgctcctgccctgctgttagtcctggctccttggtagatagcctccttcccttccctggactccagaggaatcgagcgggagtgctgtggcttcatgcactgtctgcaacctcacctcaatgcctgtcctgtccctaaggcaggaggatgtgctggggacccacctgtcctctgtggagcctgtcgtagctgtggcagccataacaaaccccaggcactgggtggcttcgccacatttattttctcacagccccggaggctaaaagtcccaggtcaaggtgccagcagggtcagtttctggtgagggctctcttcctaccttgcaaatggccaccttctcactgtgtcctcacacggcctcttgtgtgtgtgaatggggaggggcagaaagcaagagcaagctctctgatttcttctgataggggcactaatcccatcttgagggccctgccctcaagacctcccaaaggccccacctccagataccaccacagtggggcatgggcttcagcgtaggaattctggggcacacgttcagtccataggggagcttgtgcgagtcatgcctcagtccggcccgccctgcagggctggctatcctttgggccatcagtgtcatctcttcgagggcctgttttgtggcaggcaccgggctgggcccacatgagggctgttagctctgacaaggctctgtcactgccacaggggtctgccatgctgctgaattgagacgggccagggaggaaaagagggctgcttagaatcaaccctgtggaatgctttgaatcatgagtcacccacccgcccattcattcttttattcactctatgatgttcccggccaccttgaggaccatggagaccaggagacagatgcataggatgtgagtcctgtccctagagagagccaaggagcctgtgaggactccaggggctagaggagtggatggtcatgcaggggcttcgctggggccagggcccgtaccaccctcaggagccacacctggggccttgtctttgccctggacacagcactgcctggggtctccccagtgggcacatgttggggtatgctgggcaacaggcatctgaccggagtgggctctctggggaaggcttgtccttggaaagccccaccaacagaaatgctccccagagctcacgactaaaaggggaagatgcagcagcatgggcctttcctgggttatgtactgctctttatccctggcctgcacttccggggaagtatcagcagacagtgtcagcgtagcgcagcacatgctgtgatgggaaggagtgtggagacagcccgccgtcccgttgtcagttgtctgaaatcaggagccctcacgtagtcttcctgtgggtgttggccctcctgccgcagcctacctgggctctgtgcctggtgctggcagcaccctccaggatgtaccaggccagggagggagcaggaaggctcgagagcagcagcgttggtccccaggcccccctcagccccagtatctgcctgcccgccttccaccagcccctttaaccacccagtggttcctctgtgtgtgagttgcttgggtgttcccagatggaagcacgagcgtagttattaacgtgagtagatccgcctaactcagaacctggcagcccgggaggagggagccacttctgcgagtcactcaaggcctgagggccggggctgtggaatcccagagacctgggactgattctggtgccgtgtgttgccatttgtgcgactttggcaaattacccagccacccagagtatcacatttgtgactggagacgttagcggcttctgtgaaggatgaggggtcactgccagggttgcctgggtggactgttggatgagctgccggaaccagctgccctggtacttgcccggtacttgctgaaggggatgggggttctggatccaggtgcacccctctcaggatgcccctgatgggcctcgggactctcagccctcaagtatggggtcagcacgctcaggggaagctataaatcactcctcattctagccgcctggctccaggatgtttgtacaggtgcccctccctctactccccagccggctgtctgggtccactgccggcaaggtgtgccaccacgtcccatgtactcagagaccccagcggactctctgtgcagacggggcatgttagcattgcagggacgtgccctctggggtggacactgtccaccagatcggcagaggttgggggacaagcttctcacagattccaggggtacccggggaagccaagtacagcaggggcagaaaatagcactgtgcatggctggctttagatagggcagcaggtgcttctgatcgggagtcctcgtctgcatcccagcccgcgcactcccggcctctgaatctcccagcccgagactcaaccaaaaccaggaccatttctgctaaaccactctgtcttcattttatgttctcagaactcttttatttgggtttttgttttgtttttgagccagtgtgagggtactcatttgctccacagtggaatctttttttttttttaagctataacttagccaaaagctcaaagcatccctgaagccacccatgattttgcagaggaagacagtggcgcttaagcagggtgggggcccagcctcggctcacacagcaagtgctcagcaggcattccagcccctgcctgactccagagctgctcgtgtttttcctgtcctttattcttgtcagaaggctgaggagatgttcactgccccccaacgcccccagcacagacacacactttttgtttttcccatgtggcctggatttccacgtctgtcctgcccagctgagctccaggcacgtagggccggcgctccgtgacagctgacacaaggggtggcagctggggaggcagccagctctccggggcccattatccctgctcagcagccccagccgtctggtggctccttcctggggccctgcgggctgagggattagccatgaccctggcaccagcagctggatcggctaggcctagggcccacccctctgtccttagagcagaccctgtgcagagcccgtgctggccggggctgagagggttttggcagctgcccccctgcactccctaccccagcccctaccagatcctcctgtcagggacctttttccccagaggagtcggggaccaggagcacaaaggcctgttgtttgcggagtatcacatggctccgtgtgtaggggcgcggctgggtgctgtgcagacccagttccatcccgggctcactcactgtccagcagtcactgaacctctcagcgcctcatcgtcctcatctgtgaaaggttgtatgctcacctcagatgtgcattgtgagggagacactaggtaactggtgtacgtgctcagaacagggcccggcttgtcacaactgcttgacaagaggcagccgttgtcatcagacaggctttgacccaaggcctcctgactcctgcgcccgagtcatctgcttccttcctcctcccgggtctttgtggaggatcctttaggatgtcagagggttgagcagcacacaacctcagcggcccccttccctggaccacagtgcgacaagtggtgtcacgctctcagaagttgtgcagtgcacagccagctcgatctcacatggcaggcccggtgaagggaggatctccaaccccgtggcagaagggatgcatccccaggtgttcttcacaagtcccactccactcaccctggctcaaggctcctctaggggagtcctcatgccacaggaccagggatgggccttggtggaggtgctctggacaggtgacacacctgtgtgttggaggctgagaaggtggtggattctgacagagcttttgaccccttgtcttcccagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcaggtaactgctcttctcaccatcttgggctgagcaagactcaggggcccagctgggatgtggcagcagctgtctgtccttcggcactgccccaaccaccctgtgttcttggtgggatggagaggtgctctaaaggtggaaacagttgtgtacggtggataaagaggtcttggggaactagtaaaatgtccctattccctgggtcattgtagggggccccactcacctgaaccaccgtagactccaggatgcatccagaagtgttctgtccccagcatgcttctgggggacccacacaataatgatattcatggaggaatacgctgggacaggtgtggccagcatggcgtggattggccttccagggaagccagggcaggtgctgcctgctgtctcccgctgagccatctttaccttgggtctcattttcccctggggagcctgagacagagttgcctgctgctacctgcatagctgccagggtaaatcagactgtgagaagcagcagctgccgggttacaggtcttcttaggtgcaggactcctaccgtgccagtgagcgtgttttgagtcagtggacggtggtctaggagtcccgtgggtgtcacatagggcgttctctgcatgatgctgttgtcgctgggcctgagaagcagcctcccagggagcagcctgtggaccccactgcgctgaggggccttccttccgccagctgctcaccgccctctccagcctcagccattttaaaaacggacactgagttaaagatttgctggcagtggagctgctcgaaaggatgttctagtggcttctgaaggcatctctaaggcacgttctggaaacctttggaacagtggcagtgtcttgggataagtagctttccaggaggaccctttggagaacactcactgccccgctgtggcttgttcaaatcagctgcacatttctttcagcaaggggaacccacatcatcagaagcgttcagacgccggctgttttacctccagctgagcaaacagatgtgtcctcttggcatccctcctccggggactgcctgtggccatccacatctcctggctggtgtgccgcccggcatggaggggctgcagtgctgcggttgccctctcagcccttcttcccctagatgcctcttctctttccatggacacatgcagagcgtggatactttggaaacgtgcaggtgttcattttcctccgagggcaggtggccttcctagctgggcgtgtggctcccagactcaaggctgtattttcagggtttgggacatcatggtcccagcccctgcccactgggtgggagccaaatgctggaagcatatttttatatgtggctatataccaccaagagatattcctccaagttatgggctggaagaggctgacattttttaaaatgctgtttattccctgatttaagaaaataataatgctttaagtctatggaaaatatattaaattaagaggagttatattttatatcaactcctttctgtttttacccaggtcactccatctctaaaagaaatttactgtcagatctcctttcttatccactgtggttgggtttttctgttttctcctttttccttctggttgcaaaatgctgggccagtttccgtctcgacgctgggaaccattaacagcagagtgtgggctcctatcctgtatctgtgaggacgaggactccttgcctgtgtgtcttcttgtgtggctatttctaggttgccagtttgccataaaatgcataccaggagaccagacgtggtggctcatgcctgtagtcccagttctttgaagagaccaaggtgggaagattgcttgaggccaggaatttgagaccagcctgggcaacatagtgaaactccatccctaccaaaaaaaaaaaaaaattaaaaaattacctgggcatggtggtgtgcacctgcagtcccagctactaaggaggctgaggcaggaggatcgcttgggcccaggagtttaaggttgcagtgagctgtggtcatgccactgcattccagcctgggtgacagtaagaccttgcctcttaaaaaaaaaaaaaaaagcagactaagcccaaatagtagagaaacacacagagctaaaaaggagaaatgtttattctgttcacgtgaactaagtaactgttagtgtgtctctccatccccaaagctgattctgtgtccccatctctagggcactgtgccagggagctaacgtgggtcctctggtttctacgtgtatgttctctttctggataagaagtgtaatgcaacagcagccttttaagctggaccagttggaaagggggtttgggactctggcctctttccggccctcaccccagctttccaatttcctttgcccaatgacatgtcccccaacttcccgtggccacgcagggatgggggttccttgagtgggatttttctggacctgggatagagacagggacatgagtcttcactcgacaactgccagtctcctttgcctgtcagctgcacttttgttttttacgtgttgacatctcaaatcaagtgtgccttatagccagtggcatccatgcagaggctttggctggagctgaagtcaggttgtggcttgtgccatccaccaggaacattttgtgttctctgcctgtggttcgcattcacagagagactgtttccctccctccaccctgtgccagggtagagattagcgggttcctttgctctccctttctatagagtgggtttatttcttgctcgtctttaccctgaggacgcagcgcaggctcccagctttatgcaggttccctccattattctctccagcttgagccttgtttctcttaggcatgcatgagtggtacctctcaccatgtagagcgggaggcagcaaacttttttttgcaaaaggccaaattataaacatttccagctccatcccaattatttaatgctgccgttgtagtgcaaaagcagctgtagatatgtaaatgagtggcacggctgtgttcaaatgaaactttatttacaagtgcaggtggccgggcttacagcctatagtctgctgagctcctctccagagcctcttaatagtcagtgatacagcatttatcaaacctaccatgtgcccagccctgcgtgagctgctggggatccagtcagggactaggcaggcacccagcttcctgccctcatgagcttgtattctggtgggagaaactgcacacaaggagagaaataagaaaagggtcaactgtggcctgagataaggggttctgaggggaagagaatatgtcctgggataccactgggtgaggggagccacttggaaagggcagctcaggatttccctctgcagagatgatactcatggcaactggaagatgacttgggtcaccatctgtagcattaggacacattctccccatccccttcgcctcccaagagagagagaggagatgaaggaaataaggctaaaagcagtgtggcccagctcgtggctgtacggctgagttgctgggatgtttgggggctaatcttatcatttattcttcttttaaacctattttttaaatccataagttgagaagaaaacacacacattcttcctttcattgccctccctccctgtagaacgttggtggtagttctccactggtgctattgggctagtccaggaacagactgcatggggcacccaaaatccagggtgctgtcgtgagtgagggcttgctgatacatgctgggagcaacgccctggtctggtgtgttagaggaaccgactctcttggagctggccaccaggtttctttccctgatgccttctcacttgcctcagctttccatcatctcttgggtgactggcagccacaggaggctgctcctactccctccgacccctgttcagaccgcacatagagaggaactgagcccagaccatctctcactgccctgccaaaagggtcttctggccagagctcccaggtcagaattagccagaagggccaggtgcggtggctcatgcctatatccccagcactttgggaggctgaggcgggcagatcacctgaggtcaggagttcaagaccagcctgaccaacatggcaaaaccccgtctctactgaaaatacaaaaaattagccaggcgtggtggcaggtgcctgtaatcccacctactcaggaggctgaggcaggagaatcacttgaacataggaggcggaggttgcagtgagccgagatcgggccacagcactccagcctgggcaacagagtgagactccatctcaaaaaaataaaaagaaaaacagaattagccaggaggagaaaagagccccttttgaaatgtcctggactccagctcttcctgccaggagaaactgttgtgttgcatgatctgtccaggtgagcagacactggccggcccctctgagtacccagctctggcccttcctggcacccactcagcacccacgtgttctccttgcggctcctgcagacttcccaacctccctgatctttgctgtgtctacctgcgcttggtggcccttcctccccctgggccttctccgccattcggcaactgctattcaggatctacagggaaataggtgggaaggtgccctgagctcagggggctgagccaggctgggctacaggatgagaaggtgggcagcgttcccctcccagctgctcgagctgttccagccgcaagcccacagggcttatgccatccccacagactccctcttcttggctgtcggtgccttgggagtagagatcctgggggccacatgacacatgtcctgcggggtgtttattttccccaggctcctccccaggaccatatttcatggcccccgtctggactggctctggtcagagcagcaggaggactgtcgggcacaccagggcagccaggggcctctgtgccccgctagcgggagggacgccgggtacatctcagcgcctgcctgcttggcttccgcccgaatcactccctcatgcataattgttgcggcgctgtgaagtcctggagctgatgggtcgttggcagccagatcaggtgccccattggcatggcccccagcacgcagcggccctcagccagtgccctcctgtcctcgcacataggcgcctgggtgccaggggtgtgcattgcatcctgggggtgggagccacaatgcctcaccctgcaaggactcaaggaggggctgctggggctggcggcccaggacggtcccgtgccagccttgggggaagtcgtgggatggtgacagacagccttttccagaactcggcctgaggctcatggttctgcaattcttgcatttgcgtgccaatgcttcccagtgcctacaagcgtgtttctgaccaaccgacctgacattttccccaagtgactttggcttactccccaaagacatttctcctgtgggatctacttgcactttcagtattctttggactggtctgcctctgcgggtccccagtgggcctgtacgggccgggtgttgtgggaggcaggcgggagccagacgtgtggggtgagggtatttcagactctctgtgccagcttccgttgccaaagagaaattgtgctgtgtgctttcttggacggatcctgtggaagcctacattctctgatttcctatttttttccctaagtcgctaagaaccaccagaaccctttgtattttaagtgctcacgtgccggtgccagcctgtccctatgtctctagcatgttccccaaaagagagtcccgtgggctgggagcactggcctaaataacaccaagaggctgctttgatgtgggccctctctggccgtgatattcaggtgtttagctgtcccaccgagcccttttcccctacttccctgtatagtgacagcacactttgggaacagggcctcagggaaaaccagatgtgatgctgtgagatggtagcagaggtcagctcattacatcggttacttttatgtgggaggagaaggtgaaccggagccctgatggggcacacatccgtgcccagggctggtgcccagcttgctggagcccagggctctgcagagccgggggccacgtgttgtgtgcctggggtgatgctgccccctggtgtcaggtggcggcagtgtggtccctgcattgaggttctaacgccggctccttcctgtcgctttttcagaccgtgagtccatcttcttcaacagccacaacgtgtcaaagccggagtcgtcatcggtcctgacggaggtgggtccctctgctgggatggcctggcctgaaactgccctcccgtgggcctaggtgtgggctgctgtggccatggggtccttggccaagctctccagcagggtagggtgggaaggacgtttgcctccatgccacaggccccaggaggttccagagccccctgttcctctgcttgcttcgagttttcatgctagcagccattgcagcccggcccagcacagggagaggtgaggggcacactgggcttgcagggacagaccactcactgcaagctgcccacacagaaggtgtgctgacccttctcccagcatgaggaattggaagaactgctctctaatctgccttgttcctgattttcaaaaaggctgtggaggcagcaccatctcagtcctttgtcctgcagtggtcctgaggctggcaggagtgttaccctgcccccagcactatgggtaacgggcgttctggccgttcagtgagtgttgctgtggccagtgtcagcccaggtgccctgcagtgcgggtcgcaatcaggtctcatggcatcagagaggctcagtgatctttgcacgttcacaaggctgttcacacggtgcaaggctggggtttgaccccagatctgtctgactccaaagttggatcttccaggaatttaggacttctgacctcaccagtgattcctgagcacctgaccccaaagaatttaggaaaggctaccctctgctgtttgcccgaagtccagagagccagcggctacttccctaaactcaagagccctctgccagggagcctgctgttctgaggatgcatgtgtgctgctcttctggggggctttgctggtctcttcctccctgtcctgggctggcctctccaacgaaccagcctccactccagtggcagtgctcgtgtccctcggggggctgccccagaacccagatggcctgtctgtctgtctgtcttttgtgtcagggtcctctgaggagccagcagtgtgctgaggattagacagagcacaggcgtgggcaggacctggagggaacatcgccatccctcaggatgttgacacatgtcccctgggaacatatcaggctttgggaacagatttcaacagagcctcagtgcctggctgagaatattatgagatgttctgtgcaagagacggctttcttctaagcttcagaatcctggggcttcttccgtgcatggctttgctctgggggcctcggcagcccatgcaatggaggggatttggcatttgcagactgagtgtcctctcaggggcaaggccagcagccgtgatggcagaaggacccatccagaagtcactgtcttggattatcacttgttgacctcagccttaatctcctcatctgtaaaacgggaaggggtcagcctagagacactgcagggcccttcccttcacctctgaggtctgcagtcacctcctccttccctcagcacatggctgctagtcaggaatctgccaggactgacgatttccaaaaatagaaaagagaaatgcggtcagcaccaccttttccactgggacatcagcccctcctggacgcccgcaggctggcctgacagagccagctctgttcccaggtgcggaaacacgcttgctgctcatccacctgcccctgcccacctggggctcctccagtcctgccttggcctccctgggagtctggtgcaggaagccctcctctggccttaaagcaccccctcccttcccagtgggatgcccctgcggatgggcctagccccaccgaacttggagggccccatacattttttgcttttcgaaattcagtctagggtattagttaagagcacagactctgacgggactgcctggggtccggcccaagctaaggcgagtcgcgtcgcctctctgagccttggtttcttcttcctgccccagaaggattccggagtccagggagttcctgggtgagaagcacccaccgcagttgccaggtgtgcagtatgggcacggtctcggcagccgggtgccgaggcccactggggacccatgaacgccttcccagttcctctgtcacctccttgctttccagaacgtcatcagatcacttgctttgagggccccaggcatcttgtcctaggatggctatttggttttggataaccagacaacttcggaaggatttctgagattctgcaaccaggccgagagcacttttgtaaatggcgtgccatggggcgtgtggcagtgcagcagccaagctcccttgctgctgggcctgtgctgtcagcctgaggcagcagctcctcccgtcgtcggcaccacaatctcacagcgagatgtttttattaccccatttactggggcaagaaaacaaggcccagaagggttctgttatggcttagggtacacagtggagagtgggcagctccaaggtatccaccagggtctctctgactcagtgagggccttgggctgcaggatgagtggctgagctgccccactaggcttagcctctggcccccactggcaagagtgacccaggaggctcagaaaagctaagtggctgggcgcggtggctcatacctttaatcccaacactttgggaggccaaggcgggcagatcgcttgagcccaggagtttgagaccagcctgggaaacgtagtgagatctttaatccctaccaaaacaaaatacaaaaattagcagggcgtagtgttgcttgcctgtagttgcggctactcaggaggctgaggtggtaggttcatttgagcccggaaggtcgaggctgcggtgagttgtgatctcgccattgcactgtagcctgggcaacagagcaaggccctgtctcaaaagaaaaaaaaaaaaagaaagaaaagtgctaagggatgagtgtctcttacagccaggccactcctgccccctagaaagtatttcttccagatacgacaccaaggccttgaggctgtgagcaggggggccctgtgtgtcctgcaaagccggggtgggagatgcgctggtgtaggcctcagagcgtgggtgatatccaggcgtgggtccctcagagcgtgggtgatatccgggtgtgggtccctcggagcgtgggcggcgcccggacttggagcgtgggtggtgcccgggcatgggtccctcggagcgtgggcggcgcccgggcgtgggtccctgctcagcgcttccctccctggaagttcccagtggttacttcagcctcctgtgcttgggtaagggccatttttcttggtgaccagggctctgtccccagccctgtcgatctgctttcacttttttttttttaattcaggtgcacctggcacagcggctcacacctgtaatcccagcattttgggaggccaaggagggaggattacttgaggccaggagtttgagaccagcctgggaaagatagtgagaccctgtccctacaaaaaacaaataaaattagccaggcatggtggcacacgcctgtagtcccagctaccccagaggctgaggcccaggagttcaaggctgcagtgagccgtgattgcaccactacactccagcctgggtgacagagtgaaacattgtctctaaataaaataaaattgaggtaaattcacatacataagattaaccattttaaagcgaataattcagtggcaattagtaccttcacagtgttgtccaatcaccacctctatctggttccaaaacattttcatcactgagaagaaaaccctgggcccaccggcactcactccccatttcccccacctcatgttattggcagccgctgagctcgttgctgtctctgtggcgttacctgtcctagatattccgtagaaatggaatcacacaatatatgagcttttgtgtctgggttcctgcactcagcatgatgtattcagggttcctccgctttgtggcatatgtcagaagttcattcctttttatggctgtacaatattccgtcgtatggatagaccagtttttgtagctgttcatctgtggatgcacgctggggtatgaataacaccacggtgagcgtgggtggacagcatccgtttgagtacacgttctcagctctggggtgtgtaccccggagcagaactgccaggtcagatggttattccatctccagcttttgaacccagcttcacttttgtctttcatggatcagccactcccttcccctttggcccctaagcccacaacccccaaaacttcactatttattgagcacctagtgtgagccctcccttggctgatttagaggagacgggatgcagttcctgccctagaattcagatgaatctcctcccagccgggcacatgctgtccacaccttatcaacataagtctgagatggaggcctgttgcttccttttacagaagagcaaacctgagacagagaggccaagtactgtttccgaagtccacagagctaggagttcactgtcaggtttggaacccacgtctctctgactccagaatccttcccagtgcagtgccccacttccttggaggccttggctgggggcaggctgagcccatgacagtgtgtgcctgtcccaggccagctgcgacaggcacaggacttgagtggcagaggggagtgccgggctgggagggagaacagagcagggtggcctgaccagcacatggaaaccttgaggaaagctgagcttggaccccaggaggcaggcaggagcagcagagcagcctctctggggagcccgcattgtttagggtgtgagttcatttggaaacagcatttttggggaaggaagactggcctgctgggccacagggccctcaccctcacctccttgggggtctctgtgatggcaggcaagtgggggtctgatcagaactcctcacttgtgcccggctctgcgccccagctgctcctagccatgtcccacagctgctggcctcagcacctttgcctcccctgtgtcctccctggggccgctctccttctcccacccctcccaggggcccacatcctcctgcctccaagttccggcttcggtgctctgcaccatgtcttcccgggtccctgacacactctccatctccttcctccctgttaaaaggctttggttttagaggctaaaaaatatgggtccaaattctgccctgtgcttttgagctgtgtgactttagaccagccccaaccctctctgagctccggtttccctgtgtgtaatgtgcagtgctggcactggccttccaggctgtgatgagcccacaggaggtaatgagcctcacacacctcgtgcctggcggccctcagagggcaggacctggccagtggccgccccgtgctcaccacagtaggtctgtctggcttcctggcctgaagcatgccagggcctcgtggcagctggtgtggggggtctgtctgtgtggtgtggcttcgcagctcctcggcccatggcctgacttccttgtgtatgttggcagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggtgagtggcggccaggccacctccactgaccggcctccagagactgtcctcaggtgaccaggcaggtgaggcggggtgactgaggccagaaagccagctttctccctcaccacgaggtccggggaggtgcagccccgagaagcctcagcctcacctgcgcgatgggcttacggggtgtgcgaggagggagggagagctgcacgtccacctggggagcgccaggcacagtggccacagcacgcatgtccctcacctcctctctccacctgcgtcattggtggatcagcccctcccccaggccctcctcgatttaaggagcaggaaggaccttgaagggattacagccccctgcagtttacatgttgggaaactgaggccctagagaggaggaagctgttcaggccccacagcacattggtggcaggccagagactcccaggctcacgttgcctccaccaccctgaactgcagcgccgggcagaggcctggggaggagccctgggctatggagtctgttccctgctgccagctgggccctaggaacccactggcattgagccaggctctgccatgtgcccctcagctctcagtgaggggccctatggggaccgcaggagcagagccccagcacagggcatgaggaacgatggtgtgacatcacagctcgcggtcaccaggctgcgtgcctcgccctggggacaccaaggctcagtggcttgtttacctcccgcagcagctcagagacagagccgcgcttgatgccttggtgcctgccattccccagatgggggtcccccgttcctttctccatcctgacccttgtaaagcatctgctgtggaggtgaagccagccttgctagctgctgaggtgcaaaaacgttcaggaaatgcctcctgccttcagagactgtgcctggcaggtggggactcggggttgtttatcgtggaggtgaggcaggaccttggccccacacactggctgggcactttctgtgtgtgtcacctccgctcgtctgagagcatgcgcaggcgcagtcagcagcaccggccacagcaaggaagccaaggctcagaggagtgtgctggctcctgtcattcagctggtgtttacccagggctgctgtcgcccagggctgctgtgtgtcccagctggtccagatgctgatgcagcttgagctccactgccatgccctgcctggggagagctcacccctgtctggaggaggcggaggacagagcgggcggtcagcgggctcctctgtgaggtggtgacactggagcacaggggcaggtcccaggagaggcaccgtggagccctgtggctacagcaggtgcagctgcggggcaggaaggctggaggacagagtcaggggagctgcgtgtggtgaactgaggacgttggagctctccctgggagtcggggagcagccaccgtgagatctgtgcttgtgaactgaaagggcagacccgtgcgacgatcgtgtttttctccattgcctctgggtgcagtgggggggaaaccatgggtttagctggagctgggatttcatggggttttgctggcaggtatgagggaaccagggcgcaagggacattcaggataatgcaagggacgttcaggataaggaagtgtgggatctaaaccacggagcatgttttgagtggcagaatgaaaaggggacaacgtcagtggctggagggccaggggggcacagggaggcctgttagaagagaagttctggaaggagggaggagacaggagagggtgggaagctttgcacctgagcaaggccagtgcctcccaacacaaaatgtgtagatggtcgcgatctatgggtgcagataagggatggccttgtgagtcagtgtggggcactgtgagccagtgtggacagggagggttcttccagagaagccaagagaagggccacccagatggggtgggactatggctgagcctggcggagactggtgagggagcctggtactgaggagaggcccagggctctggcagggcagagctggttccccgggagatagctcagtgtgtccgccttaccatagagcacccttttggggccaagcagagcagcaggcctgttctcctgcaccccacaggaggcaccttgggccatgggtgtccagcagcacgtgggtgggagaggcctgggagagggcccctccagagaggggctggctctggagtaataaccgcaacagctgcaagcgctgatgacaccgtgagccaggcctgccccgacgcctcacttcgtcctcacgaggcgttgtgcaaagggccgctggaatctctgtgttgctgataagaatgtgaggctgggggttgagtggcttgtccaaagtcacgtggtggagctggatggggcccagactgtcagccccagcctttccacctctcagctccagccatgggttcgaatcttgcctctgcctttacagtctgtgatggcacaagccacctaacgtttaagtctcagtgttcactgcagtgggaaccagtttcccaccctgcagacagaggagatggcttttgcacagtgctggtatggagctggcaccctgccctgcaggttcatgcctcagtccgctccccgagctcctgtttatcctcaggcctccgtggaggcagccgtctctgcaccaccacagaaagcggcctccctgccctgggccactgggcgttgtctggggatgctggaggaggttgctggagaatggctccctgttccctggcgctgacctgatggtggagctcctccactgcatttctccctaggcacccaacagccatgcccgtgcccgggacacctaccctgccctccaggcctagcccagggccgacggacaccccgggtcctatggtgggggacctggcaccatgtggtattcaagacacacacaagaccaagggcgtccttcagatcccactctgcctcttaggagccaccttgagcctcagggtcctcacctgtgaaacgggctgcaggggtgcggtgggctgaggaccgtggcgctcacagcccagtggctgctacttcccgagtgctgtgaacgccatggacgtcatcactgccctccccgtggtggttaacggtcatgcctcctcatctgtaaactggggacagcattatgaagattaggcgagaggatgttgcgggacgctcgcacagtgccagctcgggaggcgccgcttgccggccagaatagccatctttatttccaccgcgggcacctgcatcccctctcagacttgggcttcctcaaaccacagcagttgtttgctgaataagtaagggcatgggcagattcagcagtctcatcttccaggcccctgggcactgtaagaggtggcacagggtgcccccgtctgaaccttcattcccaccctggtggggctgatggttgtaaatgttgtcccagaggacagcccagggtttttgaaaactcccgcccctccaagttggctcaggcaggcagggcgcttgccctgtgtgagtctcttttggagcagtttgctgggagccagcagaatcctcccctgagatccgaaacctgcttggtggctcccgagggctctgccgatgttcgcaactgtgttaggaagcacttgccccaggcaggtaccatggtttctgttctgttcccctctgttaaggggagcatgtgatgctgcgccctggagcttgtctcaggcctggatgttgctagtgatgcccagcatttccgttccttggctgtgatcctcagagaatgggacacagggggcctccctgcaggtattttgtggtgagaaggaagcagactcagttggggcggcagctgctttgtgaagcagacaccactcacatcccagcctctctcagtagtgccacagcagcctccacctgggcggcagccttctcttctcagtttgcagacagggaagctgaggctcagggtggaagcggtctccgggactcagcctgaggccagactcagctgggcctcaggagtatttattactccaagtgtgtggagctggctttggtgctgctacctccagccacgccaacatcccctgcacatgtactggcttttaccatgcaagtggatgggtgggtgagacagtggagctgtgcctgagaggaacagggacaagcaagtttcatcctcagctcaggttcttcagcttctcacaccctggcaacagctgaaggtcgaggagcacgcacctggttgggcgtccaagctttttgactcccctcagccccccttatctgctgagcctcacgttttctctgtaaatgggacgctgacagcacaccctgcctcatcccaggagcccatcggttctgcctcctcctcctcctccctgcatgatgcgtgcccctggctcacgccccttgtgctgtctctctcccacccccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattctctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcatgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggtgtctgggctgtgctccctcactaaagggaaggaaaggaagctgggcgtcctctgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccacccccttgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctctgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcatttcacacgtgtttacacatgttgctcaagtttgttatgtcatactcccagtccttaaaagacgtttaataaaacagctttaccttttaaaaataaaatttcaatcccagtctgcctcaggtacgggtgggggtgtgcagcgtgactcctggctgtgttcctgtaccgtttgtggcctccggggtcttgcgcgtccagggcccagataccgagtaactgccatgtggtgtcgtggtggcgtccataggcctccgtggtggggcgggggcggggctgtgggtgtgcagggcagctgcattttccaagagtggagatggaggatggagatttgcttcgtaaaggcctgggagctacatgggaggtagggaggggccagccacacccagggctggggggccggtggactctgcccagtgaagccaggggagtgtcagcaatgaggggcctggacagcgacgcgggacccgcacctgggagcggcagagatggagcccagctcgctaaacgtaccctaagggtgcacgctgaccatctttgatccctggacagtgtccatagagttgtctccccttcggtcacattgtccctggccttggagtttctgcctcagggaaagacccactaaaaccacccgggctctggcggcctcctcttctccagagcatggtggcgctgcctcctgagcagagtcactgagagtgtctgggtccaaggaagggacccacttagcaaaggttgttgtgtggtgctgtgcaggcacggcgcctggagttggccccgccagcatcggggtggcttggggctctggttcctaagcttctgcttctgagttggtcagcacgttggctctgcgccctgcagtgcctgtcttgatggtggtccctggatgtgctgaagggctccaggagcaaggggccagaccacactttggctgagtccttgggtagtttcagagggtcacctgcacagtctgcattgagcaccctggggctgaggccgtgggtcaagttctgcctgacagtgctttgattatatggtgatgtgattctgcaaacataaccccccaactgagtgccagctgctgggtgtccccaccccaagagccaaggggaggccaccctggaactggtgctttgcccttggtgtcatggaggtgtctgggtccacacgtggtgggtgggctgggcctgcagtcacccagcatggccggcgggattggacccagctgcaacctggcaggttccatggggcttcctgtgcctgggcctgcctgtgtctcatgcctgtcaataaaggagaaagcaacctgggaaaaacattcctctctgtacccaggggactgccaagtgtgctttatagaaggctggaagaccgactgaagtaggaagctgtcacatgtttgagccaactgagcaaagcagctgttgcctgccagacagccaccccaagaccaagggagccagcctgtcgtttgtccttctagcctggaagaccagttcttggctcttgggcactcacattggccactggccacaactgctgaatggcttcactaatgtccctggggtctgtatctgccctctcttctattccctagaaactctggccgggcatggcggctcacgcctgtcatcccagcacttagggaggctgaggcaggtggatcacaaggtcaagagatcgacaccatcctggccaacatggtgaaaccccatctctactaaaaatacaaaaattagctggacatggtggtgggcgcctgtagtcccagctacttgggaggctgaggcaggagaattgcttgaactcgggaggcgtaggttgcagtgagccaagatcgcaccactgcactccagcctggcaacagagcaagactcctcaaaaaacaaacaaacaaacaaacaaactctgatcattcacccggtgggatccccggcagctccttctccttcccgagctgtggctcatgggccattggattcagagaccttgagctgggtgctggctgccctaaaggagcacgacccctccagcctggtgaccgggaggcagagaagtgcagctgtccttgacaaaggcccagcctctgctgcctcaggccagcctggccacaccccgatgccacagtcatctgccccgcccaggcataagcctgactcaggtgatacaggcgaggcttctcccatgggtcctccccttgtgagaaagggtctgtgctgtgtaccttctctctgcacagccattgtcagtgtggtttggagtgagtgagcctcccgcactgctcaggggagagctggtgagcatgactccatggcctcctgctggttggggtcttcttctgattctcacccgcaggagcacccagacccccccttttcagaaatgattacattttcccttcaagagtcatctgtgacctggtggtgtggagggactgtcccctcctgcagcctggccgacccccttcctccagggctgtgtggaatcacctctcagaagctcactctgaaaagccactcacagggatttcaccaggatgttgctgttcctgccgacacctgggctttgtgacaaatgctgtttgcttcaagctgttcacaagcaacttcaccagaatcccaagctggttcgtacttaatttgtgtacatacatatgcataatatacatgaccatgtatgagatacagacaccatggcttctgtccattggctcattcgcctggtcgcatgttcactccatgaggttaggacactgcgggtggctttgggatgggtggtttcagggacaaggtgtcgctaggatctctgtatttgctaactagtcttgttttgatttctaacggtctagtggagtacagttaatgttgtgtttatttctgtaactgtaggggtggagtataaacctaacttttggaaacatgaagaaataaacaatagcgccagccgttcggagggtgtccttctgtgctttgcagggggcagggggtgcgcattagccgccatgagcagcccatcctcatcagagaaacccagacttgccgagacccctcaaacgactcaacaccattgcagtggttttctgtgtgggctcctgatcatcaccataatctggtaaggagatagtaagtattgtctccattttatagatgaggaaactgaggcactgagagggccaggagcgcctgcccaaagactcctgctcattaatggctgggctggggagttcaactccagtcttaggtccaaatctgagttcccaccatggaaccttgcctgctcagactcaccaggcagagcctcagggacttggttcccaaatcccaactggcctctggacttggctctgcctgggaccctggagggtggcagcgatgcctctgagcctcacccacccacaatgcccatgtctttcccattcctacctggaagacaccacgtgggcagcctgcgaaggccgaggcccctccctgcaccctctccaccactgcctgggatcatcaccctccctggcttgctcgtgtttgagctgcaaaggccaaggacgttagccccagaactgccacctggacaggtgaagtgactggccaaggctaaccagccagtccagcagaacctggctcgaacccaacctcctcctggcctgcaaggagcgccctccagcgtgggcgtgtgctcctcctgctgagcgtacttttgtccccatgggttgctttggctgttgaagggtgcagctgtccccgctggacagtgagcttcttaaagccagggcttgtctcagccatgctcaggcctaccaggcccagagcagccatgcacaaatgtttgacgagtgactgaatgatgggccctgatattcagccagtacacatgggtcctgactgtgtaatcctcacagtccccacgcttcagtgttctgagcatcatccccgcctgtgacttgggtgagtcatttcaccttctctgcctcagtttcctcattcacaaaactgggactaagagcagcccgtgctctagtgaagcgttacatacacgagatcttcagacgccccacattcctatgccttcttcctaggccagaagtcatagcagggcctaataagtggttatgccaagcggtccctgcagctcagaggctcaagtctgatgcctgtgtcctgcgacaggcactagactggggctgtcagggcctccacccggcaccacaggtgactggatggcggggaccatcagggaggggcgacctgatctcaggaaacagagcccgtgtccccacctggcgctgcctctgcatggcccagctcaggtgtggctggggacggggagaggaaggaacctggaggccctcagcaagtgtgctttaatccctgcacacactctttgaggcaggtcagcattcccgttttacagatgaggaaactgaggctcagagctaacaaagtcacttgctcaagatcccacagccaggaagtggcccagaaaggaggtccccaggaggactgaacctccctttgtcccttcgcccaaatccagtgcatctcactccactcttaagttgagaggcgaaaaaattcagaggaaagagcccagaacagatttatttttctttagataaagttcatacagaatatgttacagtcaggagttctcagctttcaccaaaaggtcagaagttattgcagttgtgcccagtggataggatggaggaagggaaacttctagaaagctgcctgtgttcagagaaggaatcgtcaatgtttaaagttgtggggctgccctgcaaaggatgttccagggcaggtaggagtcaggagtaggagacaaggcgcgtagggggcgatagggtggcctgggcttgggcaggctggaggctgcctccctaccggaagcagcgtccgggccatctggccaggacctgccaaggggacagcagagccagggccacagggtgccctggggccagccctgccagccggtgtctcagccccgccgtagtgcctgcagctggtgggccactttctccagctctgcctcaatggccgacaggctctccagctcctggtcctaggagagacattggggttcactcgggccagcctggccagtggcatggaaggcacagtaagccagaaaggcgctgggttagctgtgtggcctcggacaggtggctttgtctctctgtaccctcatccatcatggagacagtgataatgagcttactgtactgctctcgggatcattatgcacaagaaggtggctgatgccgggggccctgtccccacactgctcttggtggcctcttatccaggccccacttcctctcaaatggtcccgcacaggtgggagtccgttcttttagggcacatggaaaacaaagcttacagtgccctgaagagcccccttccctcggcctagcccatggttgccaggacccagggtgaggccagcctgggacttccgggtctgtcttctgcagccttcccacctgaggggaatgtggggcctgagacagggctacatgctgggggagctgccccacatcagcctgcctagggctgggctttgatccctggtcctgattgtgagaggatcctgaactctggctacccaagtttagggaagcagggacccctcctctgagccctgttctatgcctgtctgcagaagctttcaggcctcagaacttggacacccacaagagcacaacctcaagacttagagcaggagcgcagggaaggctgcctcctttgacctgggaggggtcattttcccggggtcactgccagatttgaggctgccgagggcatcctggcccagggaccccgacattgcaggccgtggaaatagactctacagccccttagtcttggaggaggccctggggcaggtgctctgcgaggctcgggtttctaagaagacccttgggctgtgttgaggaggcccccaccccatcctctccatatgcctcaggggtccagtttctctgccctgcggtccagagctccctctgcttgtggagaaaggaagctggtggcacctctgggcccccattctctccagctttgtcctcagcccctcgccctgggctcccaggcacgtgggcagatgccctctcccgctacagctgccaacatggagccttcttcctctcagactgccaggcccagagagggggtcgggggcccagtgaaggggccacaccctcttctaggtgggcagagaagagccttggggtcagggctgcggacaggtgtcagccttcccacagagcctgggttcctacctggacactaggcttgaaccaggtatcccagccgcctagctgccagggaccccaactcccccctgctcctgtgggctgtgtccccacgccccatttgtcttccccaggggccctggttttcaaagcctttgtgtgttccaatcatggtaatgacgtgggcagaggagactccttacccctacttcataaatggaactgatgaggctcggggaggggagtgaccctcccaagtccacgcagccaagaggaggcagagcccaggtcttccagctcacatccggtgtggctcccacccactccccacaggcaagagatcccttggccctgcccctgccctgccccgttaccctcatgggccagaggcagggcctgagcctgggaggaggctgtgcctgggctgcctgggggccaggaggggacacggtcagacccaccgcatggtttttccagggcaccctactgccttctggacaacgtccccactcagcgcctcccccgctgccacaggctgacctgagctcctcccatctcccagccagctttgctgggtgccccctgtgagctggggtgttctcccaccctgagagcccccggtctgagcatctctccatccccagacttcggcgggggggccctgtcccctcagtggggcaggggcagtgtgtctgggtgcggctgccccctgctgctccgtggcctggcacagagctggctcccgccccataccaacctctggtctgcggtttgcgctgccctcctcctctttcttctcctcggggtagcctcggacctggaggggcaggcccgcctcaaggctgtcctcccgggaggatggcctccagcctcgtcgcagctgcggcccagggcccctgaagccgtaggcccgggcccggaaggagagcttcatggaactgtcccggttgtcctcctcctcctcctgcccctccagccgcttctcagccgtcagctccttggccagctggtccatcttgctccagcgtttggagtcctcccactccttggagagccgctcctcctcctgctccagctctccgctcttcccaccccggaagaggccttgcgggaccactgccatctcctcctcctcctctttctgctgggagtgctcctgttctcccttcccttcggggtcctgagcctcctcagccccaggcttcccagctccatccacagccagagcctccgaccgacctggagcaggtggtgggcaagagcaggagaatgggtgggggaccaccattttcccagtctctgccactccctgggggcctctgctgcggccacagcccagcctctccacagtgatgacgcttagcgggaaaaaccttcttgatgccaggctttgcaagaccctctcggctcagaggggtgggttagctggagcctgcctcttcccctcatcctcaccccagaagcccggcagctggagagtgaggaaagaccctgacaggcccgcagcgggagccagggcctctcctaaaccgtagttgaagctgacactgttcccagatcagcctgtgcgctcctgccatggtctctgttcccaaagccagcccacccatcacccacccctagcttctggggttggtggggggaggctatgtggaatagtgggaaatgcatggttttggagtcagataaatctggggtagaacctcagcttttgctacaaattagctgtgtgaccttgggcaaattacttaacctctctgagcctcatttgtccacctgggaaatggagctaatacctacctttcagggttgttatgaaggtggaatgaggttatggagaaggctctcctcccacccatccccctctcccagacacgttcgttgaggtcttcgccatcatacgtactctcgcctttccggatctccttgtagccaaggctcgggtgggggttcagcactacagtggggccttcttcctcggggacagcctcctctccagcctcagcctcctcctcctcctcctcctcctcttctctctttgcctgccaccctggctctgcactcaggcccttctctctgtccaccagaccctgagagaggccctcactgtccccctcggcctgtgggcctgggtatttctggctggggaggctggctggagggtgggtgttggtggcctcctcctcctcctcctcttcctccccaggggcctgattgttcccctcagccttggactcctgcatgggctccgggagggcctggggcctggctccgtctgtggcttcaccacttttctctgcctccttggaatcctctcttttctccataacatccttggatgatggctcttccaccgcctctgcagacacagcacagccaagtcaggccctgaggactgggccacgtgtggggcctccccacaggctaatttcagatgttactcattatgtttcttggcttccagcgagcccagcccaggacaacgattagggttacccctctgtccatgtccaggcttgatctgagcacagctggatttgtttctttctttttaatcctgacttttaaaacaggttattattcaaagaacaaaaacaaaaaaccagaccttaagattaatccaggagataaagcctgaactgaaaattaatgtcagctgtgtgatcttgggcaagttgcttaacctctctgtgtaagaggcaccatgactgcaacttcattctcccctccatgtggggcttctctgtcttcagcatcctgtgaaagggctcaattctgcaatattttagggtttcattaaaaggtattttattgtggctgccttaaagacagcctttgaacaagtgaaaattcctcccgtcattagaatgataaccactgaacaaagtgctcccaagtacattccaccatctgagcttcaccaggactctggtgaaaggtgctcctatgcctatttcacagaaacccaaaatgatctgcagaaaggtaagatgacctgtccatctcacagtttgcgggcagcagagctgagcctggaacccaagcctccaaatgacaagctcgggatctctttgcactgacacatggctgcctgcctcattaaagcttcaaccaaagtgggggcacctgggcttcacttgcgggctttccctttcagccccagatgggagacaccaggatccagctcctggacaccggccttaccggcccatcttctacatggagagcagaagcgccacggggccagtttgtggctctccccgggaagggaggatggctcagagtgtcgcactgacctaaggcatgacctcttagactcctagaagctctttggtttcaagaaagatgatctgggttcatttcacgtttcacacctactctgtctgtggtcctcctgcatcctggctattctgaggccccaccacttcccaggaggacaggcactgggggtgggggctctgctacagtggccactgggtagacccagagttgaagctgtccacctgccatgccagagatctcctgccctagagtgccagcccctcttctgggcagacgggaccgagcgagggctttggtgtgaggcaggaccagatcgaaacccctggtcatgccactcaccttgggcaagggacctagtctctctgagcagcagtttccccatttgtagagagagggaaataagggattatgggtggggctcccgactcactggaaccctgggtccatcatagccactgttcccactgcc

SEQ ID NO: 827 - DNA, 3072 bp, Homo sapiens
gcggcgggcaggggcggcgagtgcgcgggcgctcgccgccgcccttctcggcgggcagcgcgcgaggaccaggccgaggaggaagtggcggcggcggcggcgggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattctctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcatgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggtgtctgggctgtgctccctcactaaagggaaggaaaggaagctgggcgtcctctgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccacccccttgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctctgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcatttc

SEQ ID NO: 828 - protein, 414 aa, Homo sapiens
MQTFLKGKRVGYWLSEKKIKKLNFQAFAELCRKRGMEVVQLNLSRPIEEQGPLDVIIHKLTDVILEADQNDSQSLELVHRFQEYIDAHPETIVLDPLPAIRTLLDRSKSYELIRKIEAYMEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGYEGVSEFFTDLLNHIATVLQGQSTAMAATGDVALLRHSKLLAEPAGGLVGERTCSASPGCCGSMMGQDAPWKAEADAGGTAKLPHQRLGCNAGVSPSFQQHCVASLATKASSQ

SEQ ID NO: 829 - DNA, 48674 bp, Mus musculus
  misc_feature (1)...(48674): n = A,T,C or G
tcggggcttcttagtggaagcagtttaatggaagataagataagctggagggacttctgcataagcaggtaaggtaagttagttgaggcatgctgaccttgggttcctagaacagagttaggtaattttccatgggattctccattaaggagatcaaattctacctaaacctgaaataaccccaacgagcatacaagatggaggaacctctgcactatcgtgtcctgtcacactgggatgagacaggcatcccagtctgagatccatatcagaaggactgaatagctggagaccagaaggctaggcagcctcctgacccatgaaaactgtggacactgatagtatttacagttgtggtaaggcagtgctgatttttgtttgttttgttttgttttgttttgagacggggtttctctgtgtagccctgaccgtattggaactcactctgtagatcaggctggcctcaaactcacagagacctgcttgtttctgcctcccaagtgctgggatcaaagatgtgtgccaccactgtctggcaaggcagtgtgttttgaaggctgattgtggatgagtagagaactaatacatcagacatcaatatttcaataagcaaatatcacaatatatatctctagaagataaggacattcctatagcttagactttaattactgccaaaggcccatgtgttaaagcttggtcccccatatggctggagggctgtggaatgttcaggaagcagggggcctgtcaggagatctgtgagtccttctgggtatgtcttcagagattacggcactctggcctcgtccttttgcttctgctccaccaatggtttaagtggatctactccattaattacgcctccatggctgcctcaatacaggcccaaggctacagaaccagctggtcaagatcagaacctccaacccatgagccaaatgaagcttttatctttctaagtagacagtcttggatccgtattatagaattgaagaactgattttttttttctttttccttcttttcttttttgttttgccctgggtgtcctgggactcactctgtagacctccgccagcctctaccttccaagtgctgggattgaaggtgtgctcccaggctaccagagttcaaagtctgagtaagtggctgagagagacaagcaaagcgacagctttgatcaaggggtaagtatcacaaaggaggctcgaggaatgtgaatgaggcaaccaggcagaagtctaaaaatgtgttcaagaggagagagctgtatgagtcagggttctctagagtcacacaatttatagaatgaatctatacacataaagtgaattcatgggaatcgcttacagtctgcagtccaactaagccaacagtgggcagcagtgaatgggaagtctaagaatccagtagctgctcagcccaggaggctggctgtctcagctggccgtctgtataagctggaatcctgaagaagtaggttctaacagatgtgctggcaaagtgtgtgcaaacaggcaaagaacaaacccttcttttttccattgtccttatgtaggtctccagcaaaaggtatggtccagatcaaaggtgaggctcagatctggcttaaaggtctgcgttgatctggattaagagcataggtcatcccaccttaagacctggatcaaaagattgtgtcttcccgcctcaagatccaggtcacaggtgtgctctccatttctggaccgtaattcattccagatatagtcaagttgaccatcaagtattgttgccaagctatcacaagggccaaacttatttttctaagaaactgactctagcaataactagcccattcctaccattaaaaaaaaacaaaaacaaaaacaaaacactaacccattagttcttccccatgacctaattacttacttttgtgttgagatagggcctctcctacctaacccaggctgttcttgagctcctaatcctctcacttcagctctccaagctatatgattacagatatagatacctaatggtttcttaaaagtcccacccaaatctcaacattgttgcactggagattaaatttccagcacacaaatcagagacacaaacaaacaatgccagagcaggtctaagagttttcctcaggggctcagtgacagaagcactcatctctcagggcagtttagcttccagggaaacagcagaatcaccgtcacatttggaggcacgtccatacttgccaggaaacaaaaaaaaaaaaaaaatgtcttttgtagacatatactctgtggtctgtgaacaagagaatggagaaatgcctattttacctggcaagccagatggaaggcacagatttttttaagtacccagtgccctctgctgttggaagctaaaaatgcacaaagaaatcaatttcattttttaaaagcattatttttatttgtgcgtgtatgaatgtgcatgtgcatacgtacgtgtgtgtgtgtgtccatggccacagaggctagaagaaggtacctgatcccctggagctggaattacaggtagttgtgagttgtccagtgtgggtgctgggaactgaactctggtcctttggaagagcaaaaagtgttcttaactgctgacctgtctccccagctccttcaattttaattttttgacattaggtagaccaaggaagtggaactacagaaccaaactgtaagcacacaggactctcaaaagtgagagtaactgagagcctccagggacagagtggaagaggatgactaataagggctgtggagattcagagagatggggctgaggggcaagtgttccctctgacctctgtggagtcacggagcagacctgtggcagttttacttccacgggacttggtgttcctgcttgtggctgtcgctctagtgaccctgcaggatgctaaagctttttttttttttttctggaattttaaattttcacatctctgatgtctaataattttacatactttcacatgtgcttttgacagattggatgttttctctttgaagtgctgatttaagacaattgtcaattctcgttgggaggacttggtatgctctaagggtcctggcctgtttcattttccctgcctgttaaaaaaattaaaaagcagagaaaacctgaagcacatcaggtagcaagagagaaatctcacacactgcagacagaatcagaggtttataaagctatttgtggggctggagaggtggctcaggggggtaagagcactgactgcccttccagaggtcctgagttcaatacccagcacccgcaaccatctgtaatgggatccgatgcccccaatgccctcttctggggagtgtgaagacagaacattcatgttgttaggaggtagttgcctgagttcagccatctcaaggaacaaggtccacctggctggcaggatcaaagctgagttcacgttctcaggccccgcaaaccaactcctgtcctgcttcctcagatggctcatgcttgtctgttaaccagcaaaggacggtaagagggaagatgctgttattctgttacctaaaccaagacacacaagtctcaatcgattaggtgcccttagaagagagtggccttttcagttcccaagcttcccgtctgctttgctaagggtcttttgctctgtgtgtcttctgcatgtgtctgtctccttccccccagtaaatatctttcctttttaaaacattcatttatcctatataatatttttgggttcaggatagaagccaagaaaactcaccagaagcttaaaaattaaagttttatnnnnnnnnnnnnnnnnnnnncttccttccttaaccccttgatcaaaatatgattgaccaagcaactgcccacctcatggcccttgcttctctttcccaacccataaaaatgtggtacaatcttcctttggggtatttactgggggtaaggagacaggcacatgaagaacacacacagagcaaaagaccctttgcaaaacagacgggaagcttgggagctgaaaaggccactctattctaggggcttttttttttttagatttatttatttatttcatgtatgtgggtacactgtcactgtcttcagacacaccagaagagggcattagacccccaatacagatggttgtgagcctccatgtggttgctgggaattgaactcaggacctctggaagagcagtcagtgctcttaaccaagcctctgtagagtttcccccccctcaatttagggttggtcagtttgaagaaaactatgttgattggcccagaactgtggtgtgacatgtcctgttctagtcttgaactccttgagactgtctatcagtggggagcctgtaagtggagacaaaggttgccgggctttgtctcaagtctcaaggttgaggaagaagctgagcatctttgagatttccacctttattacctggccatggtccctctctccatttgtctgcctaccagggagtctgtcgaactcctagtctctcagacggttcctgttttcaattattgactggcacacgtggcatctcagatgtacacaccatgacaagttcctcctgatatttggcttttctttcattcatcttatttttgccttccatctgagctcttactaggcaggtcatcgttggtgaattcaaggccggcttggtctgcatagcaggaatatacagtgaggccatgtccccaaatcaattatttaatccttcatttttaaaagttcaactttagggcaaaagagatggttcagtgggtcagagcacttgctgttcctagagtgtacatgaaggggtgtagcaaggaaactgccctcatgactgctcccttattaggaggtcttacggtgattaagagagaaaatatccagaggcatcggaagcagagagaaaagaaagcagactggacatggtcagagctaagaaagcgagagagcaggagggaagtgtggacaaagggagtcagcaatagataggaatagagcaagagggcagcaaggatgggggtaagagagtgagagggagggcataacatggggggagggaggggagaggagagaaagagagagagagaatagcaagagtcagagcagaaataaagaaatgtgaacaagtcacacagattacaggaagaatgagaagctgggtggagggaaggacaggatgctcctgtggtcttttgagctgtatcacaggtactagtgataccagggggagtctggaggccagcatgggcttctgtatgctgattgatgccacaggtatctagaagtaaggagaaagattccttcctggaagatgggaacaggtttcacaggttcctgagaaatgctgggttttttttctaacagccagaaatctctatatagtcctgattgagctcacttctagatatatggtctacctaagacagagacagaggtttggttccaacacgcacatcaaaacggctcacaagcatccttaactctagttacttctaatggatacagcaccctcttctggcctctgtgggcacgtgcacacatgtggtacacagacatacactctcagttacacacatatgcacattaaacaaacaaacaaacaaataaataaataatctgttttttaaggtccaagttataattcttttggagttcgttgttttttattctttttaattttgccttaacctggataaaggtgctttgtcaacctcaagaccacagaaagatgctcctttcggtttatctgtagaagacttacgatttttagttttcatattttgccatattatggcaagtggaccgaaaggggggcatagctgacacggggtctctccgtgtagccttggctgtcctgaaactcactctgtagttcaaggctggccttgaactcattagcctttgcctttcaagagctagaattaaaggcatgtgtcaccactgcccagcaagatccaacatttcttaagagataggattgatagacaacatgcatgtgtgtatgcgtgtgtgtgtgtgtgtgtgtgtgtgtgtgtgtgtgtgtgtgatcacatgcatgttattgcactcaaggagaggtcagaggacaacttttatgagttggttctttccttccacctttgtggctcctgaagatttaatgcaggtttcttagattggcaacaagtgttctttagctctggacaccatttttgaaggacattcttgttactctttatatgggtctttctttctttctttctttctttcttcctcttcctcttcctcttcctcttcctcttcttcttcttcttctttctttcttcttcttcttcttttggtttttttgagacagggtttctctgtcctggattcactctatcgaccaggctggcccagaactcacagagatccacctgcctctgcttcctgagtgctgggattaaaggcatgtgccaccaccacctctagaaatcaaattattgcccttcagtgctcacatacattaccccactgctgtagcccaccatgtctgatcagaagtcagcattcatctttcctctcccctaggcaatgagtcactttcacttttaatattttcttttttacaattaattggtttttatgtgtatgagtactttgccaatatgcatgtccctacaacacaacccatgtgttcctggtgccttagatgccagaagaaggcatcagatcccctaagactgtagttactgttatgagctgtcatgtaggtgctgggaattgaacctgcaccctggaagaaaaccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgactgggtttcttggatatacatattaatgttttcatcaaacttggggagtttgggactattattttctgtgatattttcctctccttttagatggagacatctttattaacttcttctgtcccttgctgtgatcaaatagctgacaagaagcaactcaagggaagagtttattttgctcaacgtttcatgacctgtatccatttgaggggttctgttgctgtggtaaacaccacaaccaaaggcaacttgggaggaaagtgtttcagctgacaggttacagtctcgtgtatcccaggctggccttgaacttgccacgtagctgaacatgtctatgatttcttatcctccgtcctcaatctcccaagtggtaggattataggcatacaccatcaggcccaaattatgcagtgtttgtgatcaaactcagtgcttcatacctataactcaagcacactatcacctgagctacagccccagtcctcaaaatactttttggcagcctgtccacggccaatattttcattgaggaagatttgattctgtctcaacttcttacagcaagagaaaaataacttgtttgcatttacaccttactgcattttgtgctttatctgtaaaatagggtgatgtattagatttcattagtaaggctgtggaaaagccagtcttaaatctcactagcccgtaactgcaaagaactatttctaactgaccacatgttagatgtggactatttactgcttcattttcttcctttcaggactcagtctagcagaataaccctagctgggagctgctctctctcatgaagaaaaagaactggaggaaacacaccattgcctaactctgaacgtttaggcttgtatatagttaggcctgtctacattccagcagtgaatggtagatcatatgatcaaactgtcatcagtggagctggaaaggatatctccatcttgggatgtaggacagtcacctagcaaccactgatgataaatagcccttaacaggaagaacagcttagttagaattagttgagaactgcaatgccagttaccacacaataagagcaagacactccttacggcattgtgagaatggagtagctcaaggatcctgaaactgttctccgcttaagaagggctctaagatcacagcaacagtgattttctgcttctgctgggagttagtctcactactgagttggattaaacctgacttaataggaagaaaatggcttgtagttattccccatattcaatgcagagacaataaaaatttgagtctaggggcacagactttggagtgagatggacacctcccttttaagggcagataatattggaaccagattatttaacatctctgagtcttagtttcctcaatgcccaaacacacttacttgagaatttatcataggcttttcagttggccaaattagcctggtcctgtttacccagtagatttagccttcagtgaattattgaacacagattttctttttaaaaacccatttcaaaaagtctgtgagctgtatgcaaagtataactatagcactattgaatagtagtctcagttcaagttatcttttctacaaggaaccctcacaaactgacttattttcctgcctcgggatacttctcccttttctcttggtttacaaaaggctctgaagtattgttggttcattagtttaggcaaaatccatctctgtcacttgaaagcaggttctttttaaaaatttgtattcttttattttttcttatactattttatgtatttacattccaaatgttgcccccccttactggtcccccctccctgagttctttaccccatccctttaaattggattctttttttcttttaaagatttatttcatttatatgagtacactgtagctgccctcagacacaccaggagagggcaccagatcccatcccattacagttggttgtgaaccattgacctcaggatctctggaagagcaagcagccagtgctcttaaccactgagccatctctccagcccttgtattttttttttttattggatattttatttgtttacatttcaaatgttatcccctttcccagtttttttaaattgtatttacctcatttacatttccaatgctatcccaaaagtcccccataccctcccccccactcccctccccacccactcccctttttggccctggcgttccccctgtactggggcatatacagtttgcgtgtccaatgggcctctctttccagtgatggccgcctaggccatcttttgatacatatgcagctagagtcaagagctccggggtgctggttagttcataatgttgttccacagcccttgtatttttaattaaagtgtgtgtgtgtgtgtgttgtgcgcgtgctttgtgaatgaactcagaactcaggccgttagtcctggctatttatctatgtactctatttactgaaccatcccacaggcccagggattagacagttccagtctctgcctcgaaatctgtgtaaaacttttgaaagggaggaggagctcagaggcctgggccggctcatgccccgcccagtttagcttggacccgcccctgtcgtgctcgggaccctgctccccgttgtgggcgtgctccacaatgttgtggaggccgcgtgccggcggtgttacgtcacacgcacgctggcgcggcacccggttcggcagcagacggaagggggcgtggcctggcgctagggccccgcggccgccggcgccgccgcctgagtgacctgctaggcggccggcggcgctcagcttccggccacacaggcagctcgttggccactctgttttgaggtcctcgccgcccttccacgtctcccggaagagctagccggcaggtccgggagcagcgggttgctgtggcggcccgggcgggcgacgaggccgcggtgctgccgctcggcgtcctcaggtgaggcgcgaccaggccgcgggcgggacggcttggcctgcgggacccggtctccgcctttcccgagcgctgtcgtgctcgtcttcgctcagggacaaggaaggggatgccagagccccgtagcctccggatacggaggctgacccgccctccaccccgactctgctctggggactcagtacgatgtgttctcgcctctcggggacccgtggtcacaccgccgggcctgacccctgacccccgcctctgtgtgacatctgaccttcccggtggctttgcaccacgggaagtcccctcttggagtctgtctgtcactgagataagagctcaggtttagtgtctacgatccacgtgaaagatatgttttaaagccccgttaactttcagatgggaggcaagacattaattgtcttcaggcttttttttattaggagagctacttttctctcgctcatcactaatttttacatcgagcttgtgtgacgttttataagtcagaaggcatgttacattcctttttcatttggtttctcataaattgaaatacacacttaaatgggtttcctaaagagtgtgttgaaacagttaacttccgacgaggttagagcggagaggttaaaaggtgggtttacctctagtttgacctagattctagtgtctgaggtgccatcgaagttccaggatctttctaagccatatccatctttatttgtttctaaaggacattacagtttgccatataatgtagctgagcattatgttactatattatttttattattttatttttatattatattatttttagtgatagtgtttgcacaacacttgacatataaggatgaattacttcagtagtgtttctaggagtgcctgtgtgtgggctagaattggaatttatcattgagcaaaccaggcattgtgtgtatccacccactcccccttccccagcagggagagacatgttttaaaacaacagttgcaacaacctgaagcagtgtaaggcaaaagaagggcatgcacacggaataaaaagacctagcatagatgggaaggaaagacaactctgatgccaatttagtgaagaaagcccaagatctaatagttccaagccaaagggacactgaccacattcaaccaacactgttgactttgtagtttacttcattctacagcttaaaggttaattttacttcgtggccttgactttggcacctggaagttttttccatgtgttggttaaatagataatttatacagtcatttttttttaaaaaaattgaactcagctggacatgcacatggtaggtactaaatatttaaattactgaaaatttactttagacctatatatgctgcatacataaatcacaggagtgcttcactgttagttttgtttgttactgttttttcaagataggatttccctctgtatcccctggctgtcctcaaactcactctgtagaccgggatagcatcaaattcaaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattgacttttctcacagttctaaggccacaataaaggtattggctaggttgacttgtttatattattattattttacttactagttgtgtgtgcacttgtaaatgtgggcatatttgtgaccagaggacaattttcttggggcttctgcctcattcatcagtaggttctgtggtttgaattcagactgtcaagcttcagggctagggcttttacctgctcagctgtctgaaggctgacttctgaggatttccttttgccttagagctagctgtcttctctcctgcttttacatggtctctctttatgactatttgtgtatatatctcttctaataatagacatcagtttaaattacatctttaaagtctgtgtttcttttttcttttttagatttattttatgtatatgagtacactgttgttgtcttcagacataccagaagagggcatcgaattcccatcacaggtggttgtgagccaccatgtggttgctgggatttgaactcagaacctctggaagagcagcagtcagtgctcttaaccactgagccatttctgtagcccaaagaccctgtttctattacgtgacgttctgaagtctttgggtttggagttcagtatgtgaattttggggaacacagcacagtctgtaacatgtttttgctatgtttgttgaaataataaggaaaatagtagtaattgtaaaaaatagtaaaaaaagagtagtcgggtgctcttacccactgagccatctcaccagcccccaggttaggattttaacccagaaacctttccagaagacagtgatcaaatcgtgtcttttttttttttttctttttaaacaggttcatcagtaggattgctttgctaccatcatgtcttggtttgctgatcttgctggaagggctgaagatcttttaaaccgagtggatcagggggctgcaacagctctcagaaaggagaataccagcaacatcttttatagcaaaaatactgactatcctgaacttcagcagcaaaacacagattcaaattaccagaccgaacagaaagctaactatatttcctcagctgctgataacatccgacatcagaaagccacgatcctagctggcacagcgaacgtgaaagtcggatccaggacagtcggggatgccacccatcccaccgagcatgcgtctgcccctaggccttcatcccagtttgttcggaggaaaaaatcagagcctgatgatgagctgctatttgattttcttaacagttcccaaaaagagcccactgggagagtggaagtcaagaaagagaagggcagagctcctgtctctccaagttctccgtcaggtgtcagttctgtcaacaccagtgtaaccaccaccaaggccatgggaggaaacgctgggagccaaagtcctggtagtcaatcagtctgtttctttcagaattaagtagatcgatgtgccatcctaagtcaagatgtttcaatagtgttcttcatcccctgtggcagtatctctccctataggtataagagaaggttctttgccagtgtgtagtgtaaacaaggacaacagcattgtctactactagtctatactgacttagagtagtgtttctaggccagcctggtctgcagaatgagttccaggatacccagggctccacacagagaaactctcttaaaaaaaaaaaaaaaaggaaaaaaaagaaaaagaaaattagtctttttgactccaaaaaaatttgaaatcttcatgtagtttttatttagacactaccctacagtctttcttttacaagcttatttattgaataacaaagatttttaaaaattatgtgataagtggtaaatacattctaaatttatgatttttctttgacttttgaattaaaattttctcttaattacaaataagagattttcctacttttcctatttttttaactttaaaacattgtgatcagataaaaaaaatcttttttgtttatttgatctaatgaagatgtcaatttttaaaaatatatatgtctattttctagaggtgtgtgagtactcatgagccacagagacatgtagagatcaaggacagtttgagggagttctctcctgctgccatgcaggttctgggaccttaactcaggttgtgaggcttggcagcaagagcttctatccgctgaacctcttaccctgaggaccttgacttttgtgggggaaaagtcttatttatttcttatttagtatttggagataagatctagaacttgtaattgttcgagttcttgtgattgtagcactcctaagtgctaaggattactagtattggcctggatctcattttgatgttagctttaagaaatattctatcccaatctggccttgaactcacaaggtagctgagcttaacatcactttcatggtgatgcttctgcctccgcttctaagaggtgggattatagtgtaccaccacacctgggttcttgtgtttttagtttgcatttactcaattaccaaagacaccgaggcaccatgtcattacttgtttatcgaaccttgtggaaagtccccttctgcccatataatttaaaaaataagttaattgtgaagctacagaaatagctcagtggttaagagcactggctgaccttaccgggggcctgggctttgttcccagcacccacatggcagctcacaactgtctgtaaccccagttctgggggagcaagtctcttctggctcccattggcacaatgaaatgcacagacatgcatataggcaaaatatgtatacacattaaaaaataaaaataagttaaatgtgaaattgcatcacacttagttaaaaagatagatttgaactcctgtggcatcctttggcaagacattttagattcagtttgggtgtaacaaattgctgtgacctgtagaattagtcttcttggcttgaacctcacacttgttctattgtgccttcttagtgttttcattgctgatacttctaccctgcttttttttctggaaacaagaaaactcagtttgaattatctctggcagccagaggcaggtggatttctgtgagtttgaggttagcctggtctacaaagtgagtttcaggcagccagggctgttacacaggaaaaccctgtctcagaaaaaaaaaaaaaaaaaaaaaaatctgtcttctcagaagtgattcatattctgtcctctttcttctagtatgtctagatttgagggtctttgtaggtctgtagacttcacttgtgagaatatattttcatgagaagggtatctgttgagaattaatagtatttttctgggatccagactatagcggccttccagaagcaggtgactgttgcttgcacagtgactgtgttcttgttttacaggagtgaacagttcggattctgtgcctgaagttcataaggaaccctcagaggagagcacggccccaagtgccaccagcgaggagcacagctctacacctagtgacggtagcagcaggtcgcaggagctgtccaatctccgactggagaatcagttgctcaggaatgaagtccagtctttaaatcaggaaatggcctcattactccagagatccaaagaaactcaagaaggtaggaccttaatggggcttgtgaaatgttatgtccatagaaatgtagggtctaaatttagaaatagaaccagttcttctacgagcataaaatagaatcttggctagtttagattcttaaaaaaccactaaatttaaaaaataaaataaaataatggagagtagagataaacaaccccgtacctcagcctaacctgagactcagtgcagtcttgtctttttgtttcaacctgacaagtactggattcatatgtataaattattaaatttaagaaccagtagaaaccatatattaataatcctctaattatttgatttatttattctgaactttaaagatttatttgtttatattgtgtataagtaagtacactgtagctatcttcagacacagcagaagagggcatcagatcccattacagatggttgtgagccaccatgtggttgctgggaattgaactcaggacttctgaaagagcagccagtcttattcgctgagccatctttccagccctattctgaactttaaaggagaaccaactatttcatgaaccaaagttaaggtatgttcagcgttagacactagtaggcatggtcacagtgttgccgctccagggaccttaaatgaacatggaaaccagtgtgaataatgaatgccttccagaaatgtgctgtgacataatctataagtagaaaaccctctaattcttcagaaatgattaattaaaattaaaaaaaaagttgggaccagagacatggctcagtaagtaagagagaattgactgctcttgctgagggtctcagctctgttctgaacacccacatggtggggtcaaaaccatctgtaactctaattctaggggatctgatgaccttttctcacctctaggggaatgtggcctgtatgtggtgaataaacatgcatgcacatttaaataaacatgcatgcacatttaaataaataaatctttttaaaaaataactttgggtctgtggtgtggtattgacagaaggggtatgagcatgtgtggctgaggagaggggacagggacaggaaatgtttgtcctggttccgttgggacagtgagaatagtgcagttgaacagtgggaagttttatttaggcatgaaacaaggccagaggggcataataaggttagtaaaaactgactagaaaatgtagatatgaaaaataagaaagaaaaaatgtagatatgaaatagagtatttcctgaaaccctgtgaaatttgtttcaactctttaaaaattgtttttagtggcagactacttatatcactttaaaaattgtttttggtggcagactacttatatcactacatatacccataaaaagatgtgttgttttgcttgacttaagaagttttcttttttatagaattaaataaggcaagagtaagagttgaaaaatggaatgttgacaattcaaagagcgatcgcataactcgagaactgcgagcgcaagtagatgacctcaccgaagcagtggccgcaaaggactcccagctggctgtcctcaaagtgcgactgcaggaggctgaccaggtgctaagttcccgcacagaagcactagaagccttaaggagtgaaaagtcacggtaggcaactctgctaatacagaaagacgagctggagtgtgttaagtgtggtaatagtgtagtgttttccaatttatgaagaatcatctttttagaaatttacaagaggaaagatttctaataaagtgaaaatgtgaatgattaaaatggattcacttttttgacccttgagatacatggttagcaaattctaaatttaagaggatttgaaaagcatagtgccaccatccattatttaatatattgtatgtacttatatgtggcctaaaactattcttttaagaatgtcttagaccatctttgcttgactaattcatagatgctctaaggattatggtgcctgattgcttgttccctgtggaaatgcattctttcatgtgatacaattttattttattttttttagaataatgcaggatcacaaggaaggtagtagcctacagaatcaagctctgcaaactcttcaagagaggctgcatgaagctgatgccactctaaagagagagcaagagagctacaaacaaatgcaggttagaggggagatactgtgtgtgttctctcagtacagagggagggagggagggatgcctctgtactatagcacctcagatcatccgccgaattttactgtacattttgtcaaacaaaaacctgggtgtttgaaaaaattatcttaatccttgctaaattatttttatttgaaagaaaattaaaatggttaatattcatcagagctgtgtatctgtcaatcaatttagatgtaacagtcattgctatttcactaagtggtagtttgtgacatcttatttatttttatttatttagtcttgtctagatctagtttaacctgattcatttatttcaagagaaaattgtggttttttggtttttaatttgtttatttgttttttgtctttttttttaagattttattttatgtatataagtacactgtaggggctggcgagatggctgtgcaggtaagagcactgactgctcttctgaaggtcctgagttcaattcccagggaccacatggtggctcacaatcacccgtaatgagatctgatgccctcttctggtgtgtctgaagtcagctacagtatacttatgtataataataaataaatctttaaaaaaataagtacacgggctggtgagatgctcagtgggtaagagcacccgactgctcttccgaaggtccaaagttcaaatcccagcaaccacatggtggctcacaaccacccgtaatgagatctgatgccctcttctggagtgtctgaagacagctacagtgtacttacatataataaataaataaatctttaaaaaaaaaaaaataagtacactgtagctgtacaggtagttgtgagcctttatgtggttgttgggaattgaatttctagaacctttgctcgctccagtcaagctcgctcactctggtctgcccggctctctctggcccaaagatttatttattattatacataagtacactgtaactgtcttaagatacaccagaagagggtgtcaaatctcattacaggtggttgtgagccaccatgtggttgctgggatttgaactcaggacctctggaagaacagtcagtgctcttatctactgagccatctagccagcctcttgtattttgtctttagagacagggtttctttgtatagccttggctcttctggaacttgctctgtagaccaggctggcctcaaactcagagatctgcctgcctctgctgaaagtaaaggtgtgtgccaccatatctggtttacaggtcttaagagttacctgtttgaatccaatgaaggtgttagtgcttgagggctgcttcgtttttgtttttatattgcttctgagacagggtctcaccatatagcctttgctgtcctggaactcattttgtaaaccaggctaccctcaaactttgagatctgcttgctctgcctcctagtgttggggtccagggcatgcccaatttaaatggtttagttttataagactcaagggtaataccagtgaatagccaaggttgtaaattcttattctatatctacaaacattctttaaaaaaaaatctgagatacttctttctggtcctgggaaatttttgataaggggcaaacaacctgtgtttcaatatataactcatattttaaaatataagtaagatattttgcattctcttctgtcttctgagtctttaaaacattgtgtgagttacacttacagcacattgcaatttagacactcagatactgaaactatcttcagggatatttggtctgtacttagattccttaaaatttacaaatgaacaagagtcttattacctaagttgttttaaaaatattcagaagtttttctaagaacaggcggttcttcaagaagctacacatagagacatagaattcttatatggtctaacagttctactttaggtatcgaccccagagattaaaaaaatgtatgttcacataaaaatttttttgattgtgtgtagagctatattcatattctggggaatctagaaatacaaatggcatttgctgctgggataaacaggttgtggtaatgttcatacaaggaaatcctattaaggccataaaaatataatgaagcggagtctggtgagatccttcagtaagttgtgtgctacgccagcacaaggacctgagtcgggactcatgtgaaaaggtggccatggaagcacatctgtgacctcagctctgggtcagcagggagacaggcagattccaggagctctctggccagctagtttagccatgctgagctgcaggctcagcaaaagactgactcaaaattaaattaactaaaatataatagaatgtggtcctcactaacctgtatgggttctacctcaacgtctgaagtactgaagttaggtgtgcaacactgtacctggctcacctgtcatatttcctagaaaacagagccctacaaccaaagttagaaattacagttcactaagcctagaaaagaacttgtagcacctggaacaaactcctacttgacttctagttgacccgtattgctcggaagccacaacttcatattttttctatttttttcctcctcatttttagtcagagctcgtaaattcccttaagatatttgaattcatggttataagtatgtttcaagctaaataattgaatatgtataatataaaatttaccacagagtgagtttgctgcacgccttaacaaaatggaagtggaccgtcagaacttggcagaagcagttactctggcagaaagaaagtactccgaggagaagaagaaggttgatgaactccagcagcaagtcaagctacacaggtcaagcttggagtcggctaagcaggagttagttgactacaagcagaaagctacacggatactccaagtaagcatgagtgcacactctgatgtgcctctctatgggagacggcagccctctacacactggggcatgtgctggctgcattgccctgctgcacactgaactctgatgaagggtagaaattctcaatcttaccactgcttgctcggtaagatcctcatctctgatgatgctgttgttgctaagcagctatgttgtgctcctgtggtggttcctataaaaactgtagtcaccagtgtagccctcaacatctcatcagagagaaaacacgtgcttccatttttatttaggttagtctgtctgtctgcgtggagtctgtctgcttgcttcaatttgagttgtttctttgtttttgtgtgtttgtgtctactgctactgtgttactgtgtcttagctcatgaaagcatgtggtggtcactagtggaagaatgaagactaggttggacccctcccaaaggagaaaaaataagttgttcttttgcgtttgttttgttttgctttgttgtagcccttcttcattgaactgtctgtcccctgtttttgtctcaattgcaaatgtatcagaatgcttggggctatcctgtcttcatttattaagtacttgttccctttgttccatcatataatttttgtctattgcatttctaaaattatcttctcaaaaaggtctagagtgacctgaatttatatttggtgtcatatgttaatgttgtttgcatacattctgactttgaaaacacagttggctctgtcattctccctccatctttgagcacctgtcttctgtgccacacaccaccttggctcctagtttgtcctcctgccattgtctccagctctctgggttctcttcctaggctccaaagactgtcgtgtcctagaccctctttcctaccttgcactgatgtgtgctcgttctgcttccacctgtcacctcagagacttcagccatggctctactcaactcctgacctctggctcttgctgcttgctgtttaggttttgcaagtctcaactcctaaaccaccttcctcattgttttgccctagtaaatatcactcaaacaatagcaaagcatgaacccacaaccatttacaaaactttagtagtttttttttttcttttgatttaagggcacattcagcttagcagaattttagaaatcaaaatatttgacagggtaaagtcattgatgcaatacaatgggacttggggaagaaaaagaagcctttaagtgctcaaggatgccagggttcactgcactgagctgacactataaagagaacattgaaggataggtacaaaggctcacacaagggtagagatttcagataagaagctgtgccagaggcagggttcctgagagaacacgatatgcctggggaactagtgctcattgctggagaataacgtgttagagattagatgagagagataaaacgcagtgatggctggagtcagattatggaggcccatgcaggttttatcctgtaagttagggaagagaggttctaaagaaattgagtagcaggatgagatttgaaattaagacgtgtagcagcagtgaagaacttaagctagagctggacattatcttgctcatcattgcatcccaaaacaatatctggtactcaagaaatgtaatgcaggacaagggagatggtgagatcagaggcaggtggatgccaacgggtgattggaggtttgtgaggtgaggaaggctagtgggggagctaagaggtagaagattgagtatttgagaaatttacattgaaattttaatcagaaaggaaagaagtcagatggaatctggaatgactctgggtctctgcttgcatgtaaggaggttgtttcttgtcctctgaaagatacaaataggaatgacaacatgttagggttgaagggttatgacaaattatgatatggttgagaaattgatgtgatgttgaagtgactgtcaggaaggtaattagaaatccaagcctgaagctcatcagataggtatggcattggccatgggagagcatcaagagtggaagtaatcccagcacttgggaggcagaggcaggcggatttctgagttcgaggccagcctggtctacagagtgagttccaggacagccagggctacacagagaaaccttatctcggaaaaaaaaaaaaaaaaaaaaaaagagtgtaagtaaaattaatcatgagtagtatgcagcttgagaggagaaagcctatggctaagtacattattataaacatcagcgtttacagactgggcaaagaaaactctcccaaatgagtggccagtatttggagaaccaggaagaagctgggccaggggagagagttaggcagcttctgtggcctgatgagggcaaaatagaattcttggatttggcatatggaatccctgggattctcaaaaaggggaggtgaagacctaaaggtagtgacagctaaactggcaacataacaaaaggccatgcacgagggtcttatgattgtagtgggaagcgtttataagcagtgatggtcattgtagcaaatttgaaaaaataaaatctaaaggaatggaaatgccaggctagagagatggctcagcggttaagaacactcactgctcttccagaggtcgtgagttcaaatcccagcaccacacgatggctcccaaccatccataatgagatctgatgccctcttctgaagacagctacagtgtacttacatataataaaattcttatcatcaccttcaaatgattactgggcctactagtacttttaagaaagaaaagggaaggaaaagaaaggggaaaaggggggcaaaagggggcaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccttctgaaatgctatttgtcacagcccttccctgctcactgtctggtaatttgatttagcctaccaagtcaaatgaaataattcggcctccagataatttggcacctgcctgttactttggcacttaagatactgaagcaggattttgacaagttcaaggccacccaggattgcagtgtaatactccatctctaacaaaacaaaaataaatgacatttagcctggcatcacccacacgaactccctgagctgcctcccatagtgctttcccacacagcaccatgcttctttgttttctctgtctgttttaaatatgctatattttagtctcactgggcatgttttcaggtaacgcctcctgtccagctcagaactctggcattctgatcaattcccccttgcgtgagtttattgctttcttctgctggtactactaatttcctgttgagtttgtgaagcagagtgtgctatctttatttccagcaaggaatgctatctttatctcacagagctcttagtgcagtaccaagtgcattatgcattatatatgctccctaagcataagctggagtattgttgggaaaagaacaagaagaaaaaataagagggaaatcttatgaaacatttgcaactataacatgatcatgggaactaagatctagggacagaacagcaaagttctcctgcatttttatccctacgacttcagtgagctatggattccctctgtggataaatgtctgggggctttgtttctgtatggtgagatgacactatgtaagctagtggggagaagtgtgcttagcatgtgtgctcagtctctggcatcattaaaaaaaaaaagaataaataaaatgcagtaaagtacaaactagagcctgaatagatggttcagaagttaagagcactggtcgctcttagagaggctttagttctcagtgcccacctgtactagttcttgaggatttgatgccctcttctgacctctgtggtaaccagaccttcatatggtacacagacatgcttataggcaaaatacttaaacaggtataataaataaatcttaaaaaaaataataagctgataccatctttgcttaattatgctctgtttcacaacagtctaaagaaaaactgatcaacagcttaaaggaaggctcaagctttgaaggcctagagagcagcacggctagcagcatggaattggaagaacttcggcatgagaaggagatgcagaaggaggagatccagaagctgatgggccagatgcatcagctgaggtctgagctacaggtaacgtccattgttcagcatcccagacaaccatttcccgaagctacatcagtttgaaatcaggttatgattcggtaatttagggggagatggaattattgaaacaatgtgtttcattctgctagaatgttaattaccatgtagaaatatgtctacaggagtaggtttgtctgttgactaactccaagaggtgacaaatacttgtgaagtatgaaccgtatgctgctatatacttaagcctaaagttgcaccaggaagccgggcatggtggcacacacctttaatcccagtacttggaaggcagaggcaggcagatttctgagttcgagctcagcctggtctacagagttgagttccaggacagccagggctacacagagaaaccctgtctcaaaaaacaaaaacaaaaagagttgcaccaggaaactgacaaggatctttaaatgtttagatcttaaattatgctacttaaaagtaaattagttggggcttttcttttcttcttcttctttttttttttaataggtttatttattattatacttaagtacactgtaactgttttcagacaggccagaagagggcgtcagatctcattacgggtggttgtgagccaccatatggttgctgggatttgaaattagaaccttcagaagagcagtcagtgctcttaccgctgagccatctcaccagccccaagattttctataaaactgaaatgtttccttgtattagcatgggttcagaaacttattacagttttatgcatagtcttataattgtagtttgtgtataagtgttgtgtttaatctaaaagtaaccatctggggatgtgactcagtaatagcttgcttgcctagcatttgggagccctcagtccaactcccctagcacaaaacaatgttaggccatttattccgcataaataggggatctttgatcatagggtagtctctggtgatagattaaatgcagggtaatgaaccttgtagtcctttttcttctaagtagaatcatttaaactttatatatgaatttcaaagaatttagtcatgtcaaattagaaattgtatagatgctaataactttactcattatctgttcaatcctttttgggtagaaaacataaaaccaacttgtattatttcatcccagcatcatgaatgacattgacccatttttcttacccctgctgaagaagtttataaaatctgtattagatctataaaaagcattacaactaatgaagtaaagaagctgttagtggagctggggagctggctcagcagctgaacaagcctgatgatctgagctcagtcccagaacctacataagggtagagaagagctgacttcacatcgtcctcttacctacatatacacacaggggtaggcatgcccttcgtcatccacagacaccgtcataataatcgtttaattaaaaatagatatacatatcaaatgttaaaaagctgctagtaatcattatgttaaatttactgagcacttaatgccacacactagacacccgtcctaacatcttcttctttgtagccctgagagggaggtgttactctctttttatctttgaagaaattcaggcacagagaagagaaaaggctgaagtgctggatggaggactggagctcagctccaagcacttgctcttgcccctgggggttctctctgacgctggagagttgacctgagttgttggcaacgtttgatttgctaccccatgaactccaaagctgggaaaaaataattgttgtttttttttttctttgagttcacaaaagtgtgtgagtttggaggattgtgttatggtctcagtgcttcaaagggtgagatgcagaaaatgttggctctcatctcctgctgcatgggctggtggttaacctgtgtggagaaatgcaggaacctggagctctagtctttgtacttggaagatttgtttgttgattttcatttcttgagacagggtttctcttgtgtagtcttgactgtcctggaacttgatctttagacaaggctgaccttgaactcacagatgcacctacttctgcctctccagcttctgggattaaaggcatgcaccgatacttctagcttgcttgtgagtttgaaaaatgggaaggtatgaaattgggcagatagaagcagctcacatgctaaccttggtgatgtcaggatagatattctctctatgtgtgctcatgggtggtacacatgcgccagcctacagcaacagaactattgtagtgaagtcgctttgggtattgttctttgaaagtgttaacttttcaacagaggcatgaatctcttagccaactgctgctcaatcataaggctaagcaggttgtgggccaggcagctggggcatcgtgatcattcactcactgctagccaaatcacatagtaaaagtagctgatttcattcctgtgatctcctgtccctctgggaactgctgagcccagtccacaggatgtgagactgcttcagtgtatgttgaacagaaccctttggcttttgctttcacctgtatggttcttcttaggacatggaggctcagcaggttagtgaagctgaatcagcaagagaacaattacaagatctgcaagaccagatagctaagcagaggacatctaagcaagagctggagacggagctggaacgaatgaagcaggtaaggggaggcacctcccgagaaagcttataacatgggctcagagagttagtattaggtgggagcttgcaggttcccttgcctttccatcccaccctctctggtttgaggttttgtttgcttgcttgttttgtttgcttgcttggttttgtttttttactgtttatcattattgtttgtatatatgacattgagtataggcacatgcatgttaccacatatgtgccagtgcttgcttgtaaagaagtcaaaaggacaactttgtgctgttggttctctccttccatgtttacatgggttctgggtttcaactgaggatgtcagacttcatgggagtgccttttctctctctcactttttttgggggggcatggattaaaggcatgcacccctcttgtttgttttttaagatagggtctctctatgtagtactggctttctctgaactctgtagaccaggctggcttcaaactcatagatacccacctggctgctgcaggcctgtctcccgagtgctgggatttggttttttttaaggtttatttatttgtgaggctgtgtgtgagaatgtatgtgcggtgcaggtgcctgtgcatgtcatatgctagaggtcaggtatctcctctatcaccttttttaaaaaaattattttaatatataagtgctctgctgcatgtacacctacatgcccaatgagagcatcagatccccttagagatggaagtgagccaccatgtggttgctaggaattgaactcagaacctctagaagaatagccagtgcttttaactgctgagccatctcacagcctcccttctttttttcttttttctttttttctttttttttttttttaatctttggttattttgatttctttatgtagccctgactatcctggaactcactctgtagaccaggctggcctcgaactcagaaatccgcctgcctctgcctcccgagtgctgggattaaaagtgtgtaccaccacgcctggcatgttgttagctcttgctatcttatttcatacagtaaaaagtcggtaccattcaatttatagaaaattattcttgtgattttttagtgtatcacccataatattctataattttgtgtattttaaaatctctttatcttcttaagtgaatttaaattctttaaatgggtttttcattaggatttttttatggaaattgtatttaaaattattttgtaactgttaagaaaagaaccaagcagagaccttcaaagcatgtgtatcacaggccgctttagttaatataattgtaagattagctgtcctttcagaattgcattgcagctaattcaaggagctgctatgtatcaaagggcagcagtttaatgtgattgatagaggataatattttactatgggagatgttttcctatagcctttctcaaatgccattttttaaattgtgaagtagagccgggcatggtggcgcacgcctttaaactcgggaggcagaggcaggcggatttctgagtttgaggctagcctggtctacaaagtgagtcccaggacagccacggctacacagagaaaccctatcttgaaaaaccaaaaaaaagacaaaaagaaaaaaaatgttttttaaattgtggagtagaggcacatgagctgactgtagctgtagctacttacttatcagagatccagtattaatttcagaactagatgtgtaccatattgagtaattcagccttgaactgttacagacctagaacatggaagaaatctggtaaccctcctggtaaacgtttatcagaccgtcaggcctgtaaccacagagccgtttatatttttaaaaattatttataaacattatattactaacagcatctatctttattatagatagcaaatttcttcagtctgtgttcataatcagtaataatactattctataataaatcttacattcataaatgatgccccattcttcctcattgctgtaaggtcagacaattttgtattttctaatgatttatcctagtagcagtgctacagcatcgtgctgaggaattgactttccatcaaacccacgcacatccatgtggtccatgcggtgtggctgtgatatggactgagtccttggtgtgaggcttgtgggtttgggctgcgaagatggcacagagcacactcagactgatttgttcactcctcacactaggaattccgctacatggaggaggatctgcatagaacaaagaacacactgcaaagcaggattaaagatagggaggaagaaattcaaaaactgaggaatcaggtaggaatggggaacgtgggtgacctgagttgcttcagtaaggctttctccttccatatccttcagaatttattgtgaggtttggggctgctatagatctttcatcttgcactacttgaatcttcatttacatacaccatggcttccttttgtggaagtatcttgtagccacttccatgtgaggttagatttatctccaaaatttatggtttctcaccctagtatgttcatgctgattatcacattcatggtttctttttcctatcaaaaatctactggttgatcttcacagtatcaattagtaggacatctataaagtcactacacttctatttcttaatataaagtaagccgggcggtggtggcgcacgcctttaatcacagcacttgggaggcagaggcaggcggatttctgagttcgaggacagcctggtctacaaagtgagttccaggacagccagggctacacagagagaccctgtctcaaaccaccaccaccccaaaagaaacccaaaaaacaaaacccccaaaacaaaacaaaacacacacacacacacacacatatatatgtatatataaaattgcacctatatatggttttcattctttcaagactattataaggaacaataaaaaaaaatcattgtcccttttgtaaagtttacttttttttccagtcctagctggtatggaattcattgtgtagattaggctggtctcaaactcaccgagatctacctgcctctgcctcttgcatactgggattaaaggcatgtaccaccataaccagcctcaaagattgtttttgatgaggctaggcctaagcttataaggactagagagaaagtgtcagatcccgtctatgcagtttagaagaaagatttcttagaggagacacaaaaggcctagtcatagaaaaaactataaaccgaattcatcaaaatttaaatttctgcttaccaaaaggcagtgcagacgtgaaaggaggacagttgaggcgcccaacacctcctctgccctcccggtgctgcctcagacatgtcatacatggccagctttggaaagcaaataaccagtgtaagaactcctgttgacaggaagctgccttaccattgttgttagtggacaggaggcttgaatagaccttccccaaacggtcagacgagcttgtgagcgggtgctcggggtcacagggttatcaggataggtcccactccactcccaagatagtagctcagctttgaagtgagaagcctgtgttgtggactgcacagcactggggaaactggctctcccttcattttttttttcaattgtattttgtttgtttgtttttgagacaaggtcttgctgtttagtcctgggtgaccttgaatgtactataatccttctgcctcggcctccaagttctaggcttatagtcatgcagtcatgcaccaccacttcttgcaggcagctggctgtttctgctgaggttgtcatccattgtccctgtgactccaggtgtatcccacaaaacactttgagttctgcatttattcatgaacagttccaactggaaataaaccaggagttcttaggggtgaatgaataaaccagttgtgagctggtttatacaggagctggagagagagctcagtgattaaaagcactggctgttcatccagaagacctgggatgcttgagtcccagcacccacgtggtggctcacaattatctgtaactctggttccaggaagccctctactgacctccaggagcactaggcatgaatatgttgtacagatatacatgtagacagaacactcatacacatgaaatcataaaataaaaacagaaagataaaatccataatgtgctattcttctaggaaagttgttcactcaggaacaggcaaaagcaaactctggtgctagaattgaaagtggcttgtgtatgctgatgggaatgtcccgttctgtctgaggccacatggctagggggccatagagcacggtcttcatggggctacacttcgcagacacactgttgaactgtggcctgtaaacttgaccatgtcactagtaagacacagtttacagtgtcttcatagtcacgtgtattcttgatacaaaaccagaacagaagcccagtttgatgggcacctgcctgtaacctctgcactcaggaagctgaggcaagagagtcatgaattggaggccagcctgagttatgtagtgaacttaaagctacaaaaggagaccatttcataacagcaacaacaaagacgttaatacacagtaaaagtcatacttgtatacagtgtattatatgactttcaagaaatatcccttctattacattccctccctgctggtgtgtggcctactgacttgtttaagaattacttctagccagtgaaaacagtcattatagagagtcaaggacccaattcatgacctttctataccatccaccttagagcctgtgtactgatttagtgaacttactcttcagcttaccaacaaaactttaagcaacagcagccagtcagagctagaaagccggctccatcagctaacggaaacactcatccagaaacagaccatgctggagagcctcagcacagaaaagaactccctggtcttccagctggagcgccttgagcagcaggtgcattctgcctcctcggggcccaacagtggatctgccattaacatgcctggagtcgacagtggtgaaggtaatcctagagaggacagggtgccaaaacatcttgaaaaattacagaaagactgtttttattgaaaagaaactttctctggtgcttcttccagtgtaagacctgggttctgtgccattagtaaaatcatcagaaataggtgtattggagtaatatctcacgaggttaaacttggataaagagggccagaggttggggagcgttggaataataagatacttgacaagacagaggcaaggcaggaattcagtagcatagaaatttcaggacagttgaaggaaatgtgttttcatgatcccttagtaaatgaccgttagtattgaagtctttattaatttgcatgtttgtccatgtgctttaattatgatagaaaagtctgtagatttttaaggtgcacgttcaaagagtatgtcagcaccaatatcaacatgtctgcatttttaactttagaacctcataaagcttgtacagaatcatggagcaaatctctcaggtctttaacattaatttaaaaataaaaaaattaaagagaggatgccaggtttgtggatcagttgtaatttaagtagagtgtccaatgaaaaatccagttgaaaagagacagattatcaaagttccaaagagtgtgataagaaagtgaactatgaggaggtttggaaggacagtgttccagttagtcagaggctgagggtagtgtgcgatggatgcagagagcttggaggaagctgcatgcctgcacaaggaggttaaacaggcaggctctgattgcactgtgtcgggatggcccttggtgacttagacttgctctgctgatgtggttcggtgatgcagcatttgcgaacatgtaagcaacctgggtttttccccaagtaccacaaacaaaacaaacaaacagaaaaaaaccagaaatctcagagggctaagaatagaggcagagagtccagggtgcctttgcattaatccatgtaagggatggtagttttgatcagagtgggattagtgggggatggtgggatgtgagaatttacttgaaaagtgagctgacagaacttactgacagattggatataaagcttgaaagaaaagagtgaaagatttggcctgagtggatgcaagggtgaagtcgttatttactaggatgggaaaacactgagagggagtttgccaaggagagacagagataggaatcgtagttctagggacatgagccgggtcctgatgcatgcaggggaaagggtaagcagtgatggctgcagcgggtggagctggatgcactcagctaggaaccagcaccagatagtgtaaagtttttattgtctactaatatcttgtggacattgaagcattttgtttggttgatctttgttttggtttctttgacactggcagtagtgcttagaaacttagtcttaagaaattcttcttcatataatctgatacattttcaactctagttttcttagaaagtcaattttagtgttactatattaatcttttctcttatttaaatagggacacgcctgcgaaatgttcctgttctttttaatgacaccgaaactaatctggcaggaatgtatgggaaggttcgaaaagctgctagctccattgaccaatttaggtaagcagtgccactcagcaggagtgatgggcactcaactggtgtcttccagttggtacagtcactctgagcccattgggcagaggtaatatttaaagtgccagttccctattcctttttcatactcccaagctctgccagtggctaagcattgtgaaaagttgttaatcctggccatcctttctccaacaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaaatgttagcagcagaaagagagggaaaggtgtgtctatgcaggaatgcacacacgaacatgcacacacacacacacacacacacacacacacacacacacgcatatcttgataaggaaaagcctgcaaagagctgtgagcactgagggtggacatcatactgctctgtcacattcactcatgtctgcctgagtttgttcatcttccttccttccttccttccttccttccttccttccttccttccttcctgccttccttcctgcctttcttccgtcttcttctatcttgtttgtttgttttgtcttgttttgagacagctttgtaacactctatagtccaggctagcctcatacacacagagatccacctgccagtgctgagattaaaggtgtgtaccacacctggccttgcctcagttcctatagcttagtcctctggaaaagtgtgtctgtgcagaaacttctagattaaccatttccaagtaaatgcttgtgctgaagtcttaattgctaactccaaataatgatagaagtcttcctgtgtcaccacattttaagtgatcatgtgagtcatttttctgtggtagtcacacggatagtgtgagtggggttttaaaagcattggatgttagttcaggaagattggctttgagtgtaattccctctctcatcgtttgcacagtattcgcctgggaatttttctcagaagataccccatagcacgagtgtttgtaatcatctacatggtgagtaatgagtaatgccacacttgaatttctgtctgttgttttagctactaatcatattcgtattttaccaatcaactttgaaagagaatatagctcattttttgaccattaagcttttcttaaaatactttacaagttagcatttattatgttgaaaacataagtgctgagttttcctgctgataaaattagctgtaatgtaggttaacggtcacttccttttttttttttttttggtttttcgagacagggtttctctgtgtatccctggctgtcctggaactcactctgtagaccaggctggcctcgaactcagaaatcctcttgcctctgcctcctgagtgctgggattaaaggcatgtgccaccacgcccagcagtcacttccatttttaagcctgtctaatgacaaaacagtatagaacagctggtttaatttttatcttaatgctgcaaagttgctttgattattttcatgtgttttactttatttttctagaaggatctttaaggccagtacattttcctctggatttttagttgcaaaatcagttgcagtagtttgtggtattggtttatgtgtgctgtgcctgaaagcccactcactatgctgagagaggatggctttaacaggttaggctgagttaaggctattttcttaagaaagagaaacctacttttaaaggaaatttctgtgctccattagagggaagaattctttctctaaataaaaagatttaagaaagggggatgagtggggaggaaggaaaaaaagaaggatatcagaaaggatttagggtgcactccatagggactgtcaggtgtgaacagacaccatgaccaaggcaactcttataaggacaacctttaactggggctgacttacaggttcagaggttcagtccataatcaaggcaggagcatggcagcgtccaggcaggcaaggtgctggaggagctgagagttctacatcttcatccgaaggttgctaggagaagactggcttccagtcagctaagacaagggtcttaaagtccatgcccacagtgacacgcctactccaacagggccacaatttctaatagtgccactccctgggccaaaccatattcaaaccaccacaggggccaactgcccaggtactggcagccacaagtgctctgggtacctgtcagtgtaagatgctgtgtgttgtatcctacagagtttacacagcccaaccaatgggacttcatgacattcagactgccctgagtatcactgacatgttgttcctgtcgggtgtacttccccgtctcttcatcagcaaagctggggaaactgtcccgtctacttactgttgtacatgaactgttctacaagatcttgccagcccagccgaaatctgtctgtctgtctagcagcgctatccaagccctctttgcattcgagtcacgaacgtttggtgttcaggctttcctctcagctgagaggtctgcagtgtgcagctctgtgcctgagctcattgggtcacacatttctccattattcagccagtaaacacacactgagccccagctgtgctccagactctgtcccagatgggtatgaagacaagcatggccccgtcctccctgtacagtcctcaggtaaagactgttttcttggccggcacctgagttgtgttttctccctctaggctttgctgcacctctgggtcatgatcgtactgctgacttactcaccagaaatgcaccatgaccaaccgtacggcaagtgaacagagccactggttcccatgagtgcctgccattgtccagagctgggatctgcagaaagaacagcactaagactgctaggaaccatgcacaagatggtttcttcatggagagcttttaatcttttaacttatttctctggtgtctgactctcccctattcccataagagtctctaaatgcagacagtaatttgacaaattaagctcaactttttctgagttcagttccctagatatgtatagagaaagagaaaaggcgatttgggggtgttcacctctgtacagacctttctatattttaggtgacactgattatgggttataatcagggaaactaattgtatttagggataaaaataaaaagatttcttttttaataatttagagtgctttatattttcatatatttaactgcaaatatttaatgttttcatgttagattcttggcataattcttttgaaatacataaataaaattcactgtgcatttttcttttttttttaaataacgactttaatcccctttaaagacatttctgatggttatcagtgagtgcaactgaaagtcacagctgcagtcactaggtggctatagtagttccccactgctttcctttctacccctgagttgtcttgcttcccccagtgtgtatctcatggagtgtatagcccctgcttgtagcatgtgggagatgtctatttaccaatactgtagccgggatactacagttacagtgagtaagtacacagttttctgtatgaccagcatgttctttgaattgtccttcctcttcatcttcgtctgtagattcacacattttgtcacccaagtcctggtggtctctttgtatatagttaatgcatgtggctcttggacagtgagtggcagcagtcccctcttgggtctgtcttggtgtggtcacttgaatgcctgcggagaacctcggtgacaccattgccacaacttgaactggcacacaggtcatagaaaccttgcatatcatgaaatttatgtttcctgttttctataattagatgttaggcatatttgggcttttgttttcagtgtatcgggaaagaaaagggcaggatgtgccacatcatataaacgggggcttggcgtagagacgaggagatcgatagcaggattctcactggcatgagccacgacagtgggagctacggagttaggaagagtgcagtcttgttaatggattttaggatttgctttttttctcttcatttggaaatgtttcaggaaaatgattaaaaccaggttccacccttaaatggaagcagcacaagcgccgctgccagacttcccgtctctgtggagtcctggcttttgttgggacatctgtaagtcttttgtccagtctgcacattcttggcttgggcaatgtttgactaagtgtttccggctctgcactcacttgccgttaattgagtttcagattcattactcttgaccactcacaaactgggcaaggtaatgtgaaaccttgacctcattagaaggcttgcgggaatgccaagtcagtgtcttcttgttcccagtacgtgtagtcaaagggatttcaaacatgcaaacatattcttggactgccttgtattaataggtgtccgttgaaaaacattatttttaaaattccctttctagaaattgccctttatgaaaaccaccatttctactgctacagagcaaacctttccaaggaaagattttttttttcaaaaatatggtctctgttgagtagctggagcgtctaaggtaaaggggctcaaatccagccagatgctcagcttacctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaggcgtgcgccaccacgcccggctatggctttttcaaagtgcactttagagaagaatgggtaaccttttgtaagctaccttgacagtaaaaattaagtggcaagattattttatttttcaatgtttaaagtctttgagaatataatatgaaatatatagaggggagagtttatttgggaatttggtcccaaagagttagatgtctagatgtccgtgaatatggtgagggcatggcaaaaggaacaagaagctaagaggtcatgtctcaattgcacacaagtagaagagaacagtgagggtgaggctataaaccctcaaagctcaccacagttttgcacttcctccaggattcgtaacttccctaaacagcagctaaggactaagtattcaaatccaccagtccatggagggcatttctcatccaagccacacaaaggtgggtgccatcacctcctggcatttatttatatatatattttaaatatttttattaggtattttcctcatttacatttccaatgctatcccaaaagtcccccataccctcccccccactcccctacccacccactcccactttttggccatggcgttcccctgtactggggcatataaagtttgcaagtccaatgggcctctctttccagtgatggccgactaggccatcttttgatacatatgcggctagagtcaagagcttcggggtactggttagttcatattgttgttccacctatagggttgcagatccctttaactccttgggtattttctctagctcctccattgggggcgctgtgatccatccaatagctgactgtgagcatccacttctgtgtttgctaggcccctggcatagtctcacaagagacagctatatctgggtcctttcagcaaaatcttgctagtgtatgcaatggttatttatatttttaagaatgaaaaatatttggaataatcttcttttaaatggtagtaagactacaacttgaatttgaatcatgagtgtggtgtgtcccagctatagaatgtgaacagcagggatctgccctcagggatcttacagttaagtgggaaggcaaactgtaactgtcatttagtgttaagtcactaaacagaaagaagtgggccatgggtgtgaagtggggcagcagggggtggcacttgtgtggtagtgcgggaaagaaggatatgggtggactttctcactgaaggttcagtgtgtatggaacatctggctgagcacacacagtatgcttagaaccacaaagggccagtgtggccggaacagaactggagccgaggacatgcacagccagcctcaagggactgtcagccaatgaaaggacttaggtttcaaaacctcctctgtgcctgaatagtaaccctgtgtaccctgagtcaacagcacttttaagcagagaacctttaacaccccatgttagtccagggtctggagatttcagttgtgtcatatgagcatttagagtgtggcagttggctttgctgaggtgaagacagcctttatcagtgccgtcacaagtactaaccagaaagacggaaagcattgaacttcgcaccagtgtttagaacagctgcataagcaacttatggggaagatttatgttggttcacagtttgagaagggtcagtccatggcggggaaggacagagcacagtggaaaggggataggtggacaggacagaagacagagcagcatgtggcctccaagaacacccccttctaacttcctctagctaggccccgccttctgcttagagcacttctatattacgaacctatcaaggaatcaatccatttattaggtcaaggcccccaggacctaatcagttccccaaatcctagcagcttgcaaccaagcccctggaacataaccctctgggagaaattttgcattcagatgacaccaaatcaaggaaatcaagcaatccttccaaactgcatgatctcctcatctttgttcaagttggaagacaagcagaagaacaaaatccaaaagtacaaccttttgcatctgtaggccagcatctctctccctctcactgactaactttagtgggaggcactgcctgacatctctgtggtcaggccgtcagaacttagacatacctgatctcttacatgacagccatcgttagcccctgtggtgtcacagaacacggtacataagcgatgcttctctatcccttcatagtcacacagcttctctgggttctaaagccacaggcaagcagggaaacaaaatggagaggtgtgtgaccggttagggggcatttagactggacagcttgagagtgtctccaagagggagagcatcaaagatttaaagcatcaaagtaggggctggagactcggctcagcaggtaagagcatgcactgctctcaaacgggactccagttcaattctcagacccgtgttaggtggctcacttgtaactccagctccagcagatccaacatcctcacctcacagacagacagacagatgcacagagagagaaaagagagagatgggagagaggagagagagacaggagagagaggggtggagagagaaagagagacagagatagaattttttaaaaataccccagagcagcaggctggagatgtgacctagtagtagaacatgtgcctagtttgcgtgagatctggaaaataaaacacaaaggtctaaattgtataaattgagctgaaaatattcctggatgatcaatttgagctattgattgttttattttttttttaagatttatttatttattatatgtgagtacactgtagctgtcttcggacactccagaagagggcgtcagatctcattacagatggttgaaagtcacccttattttcattttttaaaaaatgtgtgtatggaagggaaggctggagagtatggctcagtggttaagagcactgactgctcttccagaggtcctgagttcaggtcccagaaaccacatggtggctcacagccatctttaatgggatccaatgccctcttctggtgtgtctgaagacagctacagtatactcacataaataaatcttttaaaaaagaaaaacaaaaactgtgtgtttacgtgcccatgggggcaagaaccggtttcaattgcctggagcgagttacaggttgtaagccactggatctcggtgctgggaactcagtcctctttcaagaagagccagtgccatgtctctccatgtctctctccaccccaaggctgttgctagtgaagttctatagatggtcccttagtcagggttctctagagttgcacaatgtacagaagaatgtctgtatgtattaagggaaagtattggaatgacttacaatctgcaattcaataaacccaacaatggccagctatgttgctcagtcccccgaggttaggtgtctcagcaggtcttctgtataagatggaatcctgaaggagtaggctccaacagatgtgcctgcaaggaagtgaaaataggtgaagaagaggaagccttccttcttccataatccttatgtaggcttccagcagaaggcgtggcccagattaaaggtgtgcaccaccacatctggacctaaactgctcgttagttggaattgttctgtcccaggctggccttgaactcagagatctgcttgtctctgtctcctgggattaaaggtgtgtaccatcttgcctgggcatcatggccactatgcctaaagatctggatcacgggcacgtcctccatttctgggttatagttcatgccaggtacagtcaagctgacaactgggactgactagccatcgcagatggcagttcataacagaaactggtctctcagttcttcagctgaggagtcctaagctgtttcctgattcagacagctgcctcacaactgcttcaggtaggttctgccctctgtaacttacctcctaaagaccttcccctccagacacccttaccatgggcatcaggtttggacaggaattttgcagggtactcaaaggctactatgtacatcagagaaagtacaactctgtctacaagactctcccccaaagacaggccaggatgtggtatggtagagaaggcgtccaaaagcaacagggtcttttgataggattttgcaaacattctgtgaagtgggacctaggtataggaggttccttcctctgccctgccctgcctctccaccacagaggctttgattctttttgtatttggtgcctgctttgtggctgtttccgtaagtggccagcggggggtgggggggggtgggtggaagaagcccccttttatagtgggtcaggcctacctggctgttgccaggtaactgtggggtggagtttagacagaatgctaatagctactgtccctggctggtgggcacaggctgtaaagtcccataggatgctgccccgccctccctcaattctctttctttgaaatggacaacattcttactcaaatgtcactcttgtgagttgatttgttctcaactgggagaagacagaagatggcctccatgacaaccagttatcactgccccagtggaacgaacacagaccttgacagagatattgatgagcgcactgtcaggaacacaaaacccggaacatcccactcggcactgcttctctccaccggaaggccactgttgctccagagataacagcgtggcctccctctgggtcagtgtttctcaacctgtgggttttgaccttggggagtgggggagtgaatgaccctttcatcagggtcaaatatcaggtgttccacatatcagatatttatgtgatgattcataaacggtagcagaattacagcaatgaagtagtaatgaaataaagttatggttggggtcagcacagcatgaggaactgtattgaaggattgccgcattaggaaggttgagaaccactgtgctaagctgacctgctgtttttgatggttcaggactgagaggacagtagacttgtaaatgaacccgaggacagttgcagattcatcctacccttagccatcaaggaacagataatcccaaagcaggcaaataagagcatttgctgtattttttagccataaaattggatcaaaaagcatttcaaatcatctgaagtggggatttcccccctgattattagagtagcaatttttaattgtggaagacacacatttaaaaacaaaaatatcactcgcgcacagaccacttatctacattagccagccagcatgctttggcctgtccccttccggacgcttttctttggctgtgtattcatgtctatagaaaggcctagaaatagaggaagaaagctgtaagtcaatgagtggttcccaaccttcctaacgctgtggcccttgaatacagttcctcatattgtgttggccccaaccataacattattttcattactacttcatacctgtaattctactactgttataaattatagtgtttatctgtgttttctaatggtcttaggtgacccttgtgaaagggttatttgatcaccaaagggggtcaaaacctacagtactacagaacatacagctctctctctctctctctctctctctctctctctctctctctctcacacacacacacacacacacatacaaacacacacactttctctctctttgctaagttctatcacaaagctccatccccagcccataatctccatttttaattgattttttaatcatgcaatacacaaatacacgctcattgtagaattctgaacagcccatgtccctcagccctgtccctcctcccatttcctagtgacaacttaggaagaagcaggatagctatagatagtgcaacaaatatgtgttgagggcagggaaggtagctatggtgatttggagtggatttttcctgtccctctgtgatggatggtctagaggtgtagtttggcggcagaacatttgagtggcatgtgtgatgtcctgggtttgattcccagcagtgtctaaaaaggaagtgagataaagactcaatagaaacaacagctttctacccagataaacacacaactgtgtgtgtgcctatatgtgtgagctcacacacacgcatatgtgcacaattatgaaagccagaggtcagtgtggggcgtcttctaccactccccacctgattttttgagacaaggtctctcatggaacccagagctcactgcttcagctatgctgcctggccaacaagctctggggacccatgattcagaaccaatattttgggggagaatgtgccacagaagattccatacaatgcatcaactcgagaggcgtggccatcagcgaagatgcttgctcacttagtacaaacagtctctgggctctgcggagatgggttatcaggtcggaatgtcttctgacatgcaagaggacctgaatttgaatctacagcatccatgtaaaatgccggtcatggccacacacatacacacacacacacacacacacacacacacacacacacacacacacatacacacacacacctacaaccccggcattgtaggatacagagacaggaagattcttgggactttctggctgctagttcaagctccaggttcagtgagagattctgttgcaataaggtagaccctgagagagttggacacctgatgtcctcctctggcctctgtgtgtgctctagagcacacacatgcacatacattacacaaacatgtacatcggtatttcatctgtagttgcaaaccgtgctttccacagtcttatggtttcttctagcatgggtagagggtcttttcttttgctatgtctccattttaaattctgaccttatgctgctcacagacttctttcggaaattcaattcactgaaattcactatctttatcagtcttgatgatagtgaaatttccctaatgcgctctgctgtggcttgttccccaggaactcgggaagaggccatggccatggaggaacactgctcactggcttgctcctcatggcttgctcaacctgctttcttataccacccaggaccacctgctgagcagtgacaccacccacaatgagctccccccccccatcaatcattaactaaggccctgcaagatttgcctaaaggccattcttacagaggccttttctcaaacaaggttctttcttttaaaatgatctgagctcgtgtcaacaacaaactaacacactgtacaagtcttaaaactgttaatcacctcctaagattgcttttttatattctcagccactgctggggtaagtttttcccattgcactaacactggatgtt

SEQ ID NO: 830 - DNA, 2828 bp, Mus musculus
cctggcgctagggccccgcggccgccggcgccgccgcctgagtgacctgctaggcggccggcggcgctcagcttccggccacacaggcagctcgttggccactctgttttgaggtcctcgccgcccttccacgtctcccggaagagctagccggcaggtccgggagcagcgggttgctgtggcggcccgggcgggcgacgaggccgcggtgctgccgctcggcgtcctcaggttcatcagtaggattgctttgctaccatcatgtcttggtttgctgatcttgctggaagggctgaagatcttttaaaccgagtggatcagggggctgcaacagctctcagaaaggagaataccagcaacatcttttatagcaaaaatactgactatcctgaacttcagcagcaaaacacagattcaaattaccagaccgaacagaaagctaactatatttcctcagctgctgataacatccgacatcagaaagccacgatcctagctggcacagcgaacgtgaaagtcggatccaggacagtcggggatgccacccatcccaccgagcatgcgtctgcccctaggccttcatcccagtttgttcggaggaaaaaatcagagcctgatgatgagctgctatttgattttcttaacagttcccaaaaagagcccactgggagagtggaagtcaagaaagagaagggcagagctcctgtctctccaagttctccgtcaggtgtcagttctgtcaacaccagtgtaaccaccaccaaggccatgggaggaaacgctgggagccaaagtcctggagtgaacagttcggattctgtgcctgaagttcataaggaaccctcagaggagagcacggccccaagtgccaccagcgaggagcacagctctacacctagtgacggtagcagcaggtcgcaggagctgtccaatctccgactggagaatcagttgctcaggaatgaagtccagtctttaaatcaggaaatggcctcattactccagagatccaaagaaactcaagaagaattaaataaggcaagagtaagagttgaaaaatggaatgttgacaattcaaagagcgatcgcataactcgagaactgcgagcgcaagtagatgacctcaccgaagcagtggccgcaaaggactcccagctggctgtcctcaaagtgcgactgcaggaggctgaccaggtgctaagttcccgcacagaagcactagaagccttaaggagtgaaaagtcacgaataatgcaggatcacaaggaaggtagtagcctacagaatcaagctctgcaaactcttcaagagaggctgcatgaagctgatgccactctaaagagagagcaagagagctacaaacaaatgcagagtgagtttgctgcacgccttaacaaaatggaagtggaccgtcagaacttggcagaagcagttactctggcagaaagaaagtactccgaggagaagaagaaggttgatgaactccagcagcaagtcaagctacacaggtcaagcttggagtcggctaagcaggagttagttgactacaagcagaaagctacacggatactccaatctaaagaaaaactgatcaacagcttaaaggaaggctcaagctttgaaggcctagagagcagcacggctagcagcatggaattggaagaacttcggcatgagaaggagatgcagaaggaggagatccagaagctgatgggccagatgcatcagctgaggtctgagctacaggacatggaggctcagcaggttagtgaagctgaatcagcaagagaacaattacaagatctgcaagaccagatagctaagcagaggacatctaagcaagagctggagacggagctggaacgaatgaagcaggaattccgctacatggaggaggatctgcatagaacaaagaacacactgcaaagcaggattaaagatagggaggaagaaattcaaaaactgaggaatcagcttaccaacaaaactttaagcaacagcagccagtcagagctagaaagccggctccatcagctaacggaaacactcatccagaaacagaccatgctggagagcctcagcacagaaaagaactccctggtcttccagctggagcgccttgagcagcaggtgcattctgcctcctcggggcccaacagtggatctgccattaacatgcctggagtcgacagtggtgaagggacacgcctgcgaaatgttcctgttctttttaatgacaccgaaactaatctggcaggaatgtatgggaaggttcgaaaagctgctagctccattgaccaatttagtattcgcctgggaatttttctcagaagataccccatagcacgagtgtttgtaatcatctacatggctttgctgcacctctgggtcatgatcgtactgctgacttactcaccagaaatgcaccatgaccaaccgtacggcaagtgaacagagccactggttcccatgagtgcctgccattgtccagagctgggatctgcagaaagaacagcactaagactgctaggaaccatgcacaagatggtttcttcatggagagcttttaatcttttaacttatttctctggtgtctgactctcccctattcccataagagtctctaaatgcagacagtaatttgacaaattaagctcaactttttctgagttcagttccctagatatgtatagagaaagagaaaaggcgatttgggggtgttcacctctgtacagacctttctatattttaggtgacactgattatgggttataatcagggaaactaattgtatttagggataaaaataaaaagatttcttttttaat

SEQ ID NO: 831 - protein, 735 aa, Mus musculus
DCFATIMSWFADLAGRAEDLLNRVDQGAATALRKENTSNIFYSKNTDYPELQQQNTDSNYQTEQKANYISSAADNIRHQKATILAGTANVKVGSRTVGDATHPTEHASAPRPSSQFVRRKKSEPDDELLFDFLNSSQKEPTGRVEVKKEKGRAPVSPSSPSGVSSVNTSVTTTKAMGGNAGSQSPGVNSSDSVPEVHKEPSEESTAPSATSEEHSSTPSDGSSRSQELSNLRLENQLLRNEVQSLNQEMASLLQRSKETQEELNKARVRVEKWNVDNSKSDRITRELRAQVDDLTEAVAAKDSQLAVLKVRLQEADQVLSSRTEALEALRSEKSRIMQDHKEGSSLQNQALQTLQERLHEADATLKREQESYKQMQSEFAARLNKMEVDRQNLAEAVTLAERKYSEEKKKVDELQQQVKLHRSSLESAKQELVDYKQKATRILQSKEKLINSLKEGSSFEGLESSTASSMELEELRHEKEMQKEEIQKLMGQMHQLRSELQDMEAQQVSEAESAREQLQDLQDQIAKQRTSKQELETELERMKQEFRYMEEDLHRTKNTLQSRIKDREEEIQKLRNQLTNKTLSNSSQSELESRLHQLTETLIQKQTMLESLSTEKNSLVFQLERLEQQVHSASSGPNSGSAINMPGVDSGEGTRLRNVPVLFNDTETNLAGMYGKVRKAASSIDQFSIRLGIFLRRYPIARVFVIIYMALLHLWVMIVLLTYSPEMHHDQPYGK

SEQ ID NO: 832 - DNA, 65621 bp, Homo sapiens
attgggcatggtggctcatgcctgtaatcccagaactttgggaggccaaggcgggtggatcatctgaggtcaggagttcaagatcagcctggccaacatggcgaaacctcgtctctattaaaaatacaaaaattagccaggcgtggtggctcactcctatagtcccagctatttgggaggctgaggcaggagaatcgcttgaacctggaaggtggaggctgcagtgagccgagatcacaccactgcactccatcctgggtgacagagcgagactccctctcaaaaataaataaataaatagataaaccttcctctcactcctgttacctagctaagccctcctctctggatgcaagcaaggtgtccttcaagacatagactctacctataaaaagtatttttacacaaatgacagtgaaagcacatttgcaagattatgacagtaagaaaaatctgacatagctgattccatcttgcttctaacttccaagctatccttgtttattcttgagcataggccaagctggctcttggagaaatttagtttataatttaaccttaaagcaaggatgatagtatcccttccgcaaactaccccctccttttctggagactaaaaccaccttttaaaaactaacgaaaggctggctaggcgcagtggctcacacctgtaatcccagcactctgggaggccgaagtgggcatatcacttgaagcctgagttggagactagcctgggcaacctggcaaaaacccatctctactaaaaatacaaaaattagccaggtgtggcagtgggtgcctatagtcccaggtactcaggaggctgatgcaggagaattgtttgaacccaggaggcagaggttgcagtgagccgagattgcaccactgcattcacctgagcaacagagcgagaccctgtctcaaaaaagcaaaacaaaacaacaataattgaaaaaaagtaaaaaaaaaaaaaaaaaaagcgaatgaaaggccgtaagattagtattatgggaggggcctacacctgctaagatataagtgtagttaaactataactagccattgttctggaggtcacaatatttgtaacctccccgtttgctcctgtagacaccaccactattgttaaaatctgagattggtgttgatggcatttttcagaccccgtattctgatggaccagctggtgttgttgtagtctcaccaacgcaccacagtgtagtgatctctcttgtgaggtatcactcggagttctttatctcatgtccaagatgattaaggagcacagacacaaggatgaggtgggagcgaaagtttaataagcgaaagacgaaaactctcctccagcagagagggaagcctgaatgggttgcccactaggaggctggggttcagggattttataaactgggaaggggaaggaatgtgcttagtctgtgggctgtcttggagaaagtgactcagcttggcccaaggaccttagcctgggaccaatcaggggctgaagtgatgattcatagaggctagtctcacaatccaaaaaggaaaggaaaagtgcccaccagaacccaccagagcccactgtgttcatgtcctaaaaaggagaagaaactttttcccaggagcccactgattatgaaaagaaaaagtcatttctatgtcaggccttgttcccttatctgagtgagctggaggtttgtgcaagtttttatctgaatgggctggaggttctcctatctgtgaagcctcgggcatgtctccaggcacagccctctgtgctagttgccttgttgttgcttgcagcttgatttttttcccaggctgctttttctgttatgtggggatgagacaggtcatcccctgtgggttgggggctctctggggacccttcccttgctgtctacataaggcaagctggctaactcctctcagtgccacctggacctgtaacccataccaagaaactggctcatctggtcttgcgatccaccaggaaatgactcagcacaagaagatagctttgaccctctatgatttcatccccaacccaaccagtcaacatccttcattccctagaccccaggccaccaagctatctttaagaaaccctcacctccaaattttcagggagactgatttcaagtaataagctcccatcttccacttggctagccttgtgttaattaaactctttctctactgcaatactgctgtctcagtaaatctgtgcagtgggcaagaagaacctgtcaggcaattacaaaatcacactatatacaccattattttccttttgtgtttttttctaatttaacatatattcttaagatcttagagcttttttcgtatccttgcataagacatcctgtttctttttaaaaacagccacataatattccactggaagaatgtaccaagagttttaaagcaatgaacatgtaacttcttatttgctgttataagcaacactgtaattaataacttcatatatgtcattttgcataatgtgagtgtatctgtagggtaatttcttaaaagtggaactgccttcttaaaggtatgtattttttgaaattgttttaagtataacatgatatatgtaaacaactgttgttaaataaagtgttggatggatttttacatatgtatctacacctataatgaataccaatgttaagatgtagaacactatgagcacctccaccttgaccactcccagtcaatatctgccctcccaagagataactgatgctgtaacttcttcttttcttttcttttttttaattttatttttttgagagagagtctcactccatcacccaggctggagtgcagtgtcgcaatcacggctgactgcaacctcaaactcctgggctcgagcaatcctcctacctcaacctcctgagtagctgggactacaggcacataccaccatgcctggttaattaaaaaatttttttgtagagatggggtcttcctgcattgcccaggctggtcttgaactcccaggctcaagtgatcctcctgcctcagcctcctaaagtgttgggatcacaggcgtgagctactatgcctggccttattataacttttgtaatcacaaatttgctttgcctgttcttgacctgtagagaaatagaattatagtctttttggactggctttttaaaggcaaaattatacctatgagtttcatctatggtgttgcagtgtcttgtttttcactggtgtgaagtatcatgttgtagagctataccacaattttgtaatccattcaccagtttattaccatttgagttgtttccagtttgcgttattatgaataaagctgctttgaacatccttgtaaataaatgtctttgggtaggtacttgtattcatttctcccgagcagaattactgactcatagggtaaatctatgctaggtcatagagtaggcctctgtttaattttagcaggtatacccaatgttttccaaagtggtcctatcacttacactcctctcagaaatgtatgcctgttccagtggccttatgtcctcatcagtacctggaattttccatctttttacattttagccattctggtgggtatgcaaatgtatttcattataattttaatttgcatttctctgatgactaataatgttaacaccttttcatgtgcttttggatattttctcttgcaaagtgtttatttattagctcattcttattaggtggattttttttaaaattttgatttgtaagagtgcattatattctagatatgagtcctttgtcagatacatgtgttgtaaatgccttctcccaatctgtggctttcctttcattcaatttttatgaacagaaattcttaattttggccaggcactgtggcacacaactgtagtcccagcattttgggaggccaaggtgggtggattgcttgagctcagtagttcaagaccagcctggttaatatggtgaaaccctgtctctacaaaaaaatattaaaattagccaggcatggcagcatgtgcctgtagtcctagctacttgggaggctgaggtgggaggatcacttgagcccaggaggttgaggctgcagtgagccaagactgcaccactgcactccagcctgagcaacagaatgaaattaaacactgtgctgttttaacttaaaatttaaattaaaacaaaatttaatttaaaacaaaacaaacaaaacgaaagcaattaattgaggctgcagacttgtgatccctaattctagttcaatatctccatttaataaatgatgcctgggaagagaaggggtttgctcaagttcccacagctagaaactagagaatcacaattagaaccaaggttttcctactttctagcctagatatattctagttgagtacagtcttttttcctgataataaaattgagggtcagaaagattaagttacttgaggataattaacagccatttttaaaaaccagttcatctgatttctgcctcttttccatgctatctcaatttactgaacattatcattcattcattattcagtatgtaggagtatcttcttgtgccatgtcctttgctgggttctgttgaaacagccatagacaggacagacactgtccctgccctccctcatataattacaattgtgtaaatgttatgaagaagtatagagtagaagaaagagtatattggttgtgatgccagttaaatgggagactcagaaggggagttactcccaaaaaggagcttatgtttccaccgctggaggagggaaacactctgagatattagtttaattgcttattaggtagcctcaactcactggggacactgacaggaaatggtttaatttcttccaataattctcaaagatatttatatcaattcccattttttcctctgagccatagtttccttgatgacatcttgcctgcttccataattttcagccacttttagtaattagaacagacttgtttcagtatttaacactctgctctatttaatttctttatgctcgatttgaattaccacctggtgtcacttcctttcaggttgaatgattttctttattatttcttatagggcaagtcttataggactagccacaacttctctcagtctctgtttatctgggaatgtctctatctagccttcatttttgaagaatagttttgctggaaatagaattcttggttgacagtttttttcccctttaggattttacatgttatcctactgccctcttccttcattgtttatgatatgaagtcagctgttattcttgttcctctatctttgatgagtcattttcctcttacagcttttaagattttctttgtctttcaacagcttgactgttatgtgccaggttgaatgtccttgtgtttgtcctatttgaagatcattgagcttcctagatgtacagattaatgttttcatcaaacttggaaagtttttggctattttttttcctcaaatatcccccctcctccaaatccttctctccttctgaaattcccattacatacatgttggtatatctgatgatgtcacacagatctttgagaatcacctcattttttattcttttttctttatactgattggacaaattctattgatctgtcttcaagttttctaattgtctcttcagcccactcaaatttgcattgaactcctctagtgaaattttttattttttacttattgtacttttattctagaattccattgctttttaaaataatccctatctctttactgatattccctattttatgaagcattgttgtaatttttttgtttttgtttttggtttgtttgagcctgggtctcactatgttccctaagctggtctcaaactcctgagctcaagcaatccttctgccttggcctcccaaagtgctgggattacaggtgtgagctgccacagctggctgccatattttcacttagttctttggacatattttttttctcttttttttaaaatagagtagatgtgctgtgtgagacttgatctcatggttgagtaacttccttgaagtccttatatgctaagtccaacatctcacaacatttatactgattttcacctctgtgtatggtcaatttttctgttcatttgcatgtctgcttttttttaattgaaaactggacaatttagataatatagtgtagcaactcctgtgttttggtgtgcccctcagagggtgttttttgttgtttttcttagtttatacatttgttgtgtgacttgcctggactaattctgcagagtttctcttccatagtgtgttgacattgatgtttctgctcagttttatttttttctcttttacgtttatttctaaggttggttttctaaggttttcaccaaggtcaatatagcttagaatttagtcaatgattgatcagatgtggtaattagacacctcaagccagtaagacttctaccctttcttgatggacctgtgtcatctaaatgggttgaagaacattaaaaattcaggcaatttacaagactgctctgacttttgttttgctgggttttcttgtgtctcctctgcatctctgcaaggcttctctggcttttgttttcctgtgtctcctctgcctctgtgcaaggcttcatgttccgccagggttgagtagatgactggggcttttgccagactctcctgaactgacacagccttccagaccataagcgcatcgccaaagcccactatggctatctgattccctggatctcactgctaaacttccagcaggctttctaatcagttgtttgctcaaccagtcttgcagcccaggtaattgtgatgttggcattcccaatcaacctttctccttggccatggggttttgctggcaccactccttaccaagtcagccccctctggcagcaaagctgctggttttcacatttacgcagccctgacagaactattcccatggaactggaggagagggattgggaatttccccatggtaacgtgtcacagactctcactgttgttacccaaggtttaatagtttttcttgaataaatgcattttaatttatgttatacctgtggtggatttccaggaatttgaaatggttgttttttacaattgtgtccaatttcatcattgttttttggggaagagaatttgctgaattccttactctgccattccagaagtcacaatatagccccatttgtttaaaacttcatccttaagctctattcaaagttctttcccctgatctctggagcagactagcttggttgccctacagctctagagacttccttcttcccctttcttttctaggctttagctccactggtggcattagggcagggaggaggtgggaagaaaagagcaaattttctgacccattgggcaaggttgtagcctctctctgttgtgctgtttctctggctaatccaccctggccccaataatgtatgcatggcaggcatctatatgctgacctcttagggggtatatgtgggaattcttgaaatactcttttttggggcctgcccattgccattttttggaatatctgaattaagtctaaaatccacattcaataattcaaatactcaggacccattatgtgcacaggatcaggccaatttggccctaatgacaagcctacaacatggcccctagtcttcatcttcaagttgaggaaagtaagactcaaacaggttaagggctgggcacagtggctcatgcctgtaacctcagcactttgggtggctgatcaggcagattacttgaggtcaggagtttgagactagcctggccaacatggtgaaaccccgtctctagtaaaaatacaaaaaattagccaggcatcatggcacacgcctctagtcccagctactcagggggatgaggcaggagaaacacttgaacctggaaggcagaggttgcagtgagccgagatcgcgccactgcactctaggatgggcgacagagcaagactccatttcaaaaaaccaaccaaacaaacaaacaaaaaaaacccaaaaaaataggttaagtaatttgtctaagatcatcagtcctaacaaggagtccacattactccgaagcctgtacccttagactcaaagttttgtctccagattaaatattgggagtaattacagctcctgcttttcttcctctcaggtcaggtttcgtccaatacagtggaagactggttcctcctcaacttatttcattctcatcccttcgacaattaaaacactgtttctagagtcacactgacccaagtttgaatcccagttgttctacttttgcttctatgtggccatgggcaagtaactaaacctcactgaatctcagtgtcttcatctgtaaaatggtttaatatattaatagtagtatgattttattaggtagggctgtgtaaaaaacaatcctaaatctcagtgacttataacagcaaaagtttatatgtcactcatgtgacatctcaaatgtgagctgcttcacatcccctttttcttccaggaccaaggctgaaagagcagccccatctgacacagactattctcatgaaaggaaaaatttctctggttgaaatacgtaataactgttaatactactgctcagaaagaccccctgccaaaagaagatcatacaatcaagcctgacatcagtgaggctggaaagaatgctcctcctacaggatgcactgcagtcgcatggcaacaggcgatgatgtgtaatccttaactggaaaagcaacttaatagttaggaacaacaataccacctaccagagaataatagtaccttccttatgcatgtgagattaaaatgaagtgaggcacatgcaatgcttaacacagtattctacacttaataaaaggtttgataaatgttagatgccattattatgattaccacctcctggtgctgctgaaaatttttctcttcaccgtactgggctaaacctcacctgagagcaataaaagcaggagctgtaattacttccaatatttaatttggagacaataaagctttgagtctacgaggaacaggctttggagtaatgtggactccttattaggacagatgatcttagacaagttacttaaactgtttgaaccttactttcctcaactcaaagatttgagacttggaactgtgttgtaggcttgtcattagggccaagttagcccaatcctgtacacatagtgggtgctgagtatttgaattagtgaatgtggattttagacttatttcagatagtcaatgaactgtatgcataacataaccacagtactgccttttccatcctttgggtctcagctcaaatatcatcttctcagagagaccttccctgaccacctgatttaaagtacctcccgtgcctccagtcacttttccccgttttcttgtcgttacaactctggtaacgccctgaaattgtcttgtccattcactgttacgtaatatctgtctctgccactagaaagtaagcgccatgcaatccggatcatgttttcttatttccaccttctgccgtggacctctggcattctcgtctgtaaaacttaggggagatggtgaggaaagggagaaacacgaggtctagccggtccacccgggtctcaagccccgcccaactcaggcctcgcgttccttccaggctgggcaccgcctttggtcacccacgtggcccgcagtaaggccccgccctttgtgggtgtggcctttcacggcgtgcgggccgtccaccggcggcgagccacgtcacacgcacgcaggccatgcgccgcgcctgttctcgccgcgggcggaaaaggggcgtggccatgcgcgaggaccccgtagccgccagcgccaccgcctgagtcgcctgcaggtggctgttcgcgtctccctgccgtgcaggcagctcgaaagccactctgttgtggggtcctcgcttcccttccacgtctcccggaagcggtagcagggccccggcgggtcggggaggaggtttactcagcttgggccccctccgggccagccgccgagggggcgcggcccaggacggcggctaggccgtagtgcagcctctccggagtcctcaggtgaggcggaggcgagggcccactggacgagacgggggtgttaacggtcctaggagcgggggcgcagtcccttcagtggagaccctggtctctccgttttctttcgggtcgcgctcatcttcgccctgttaggggctgaggagggtaactggagagactccttgggcttcagccgacgtcgtttactgtcctcctctgtcttcctttctcctgacccctgcctggcctggccgttcttcccgcacggaacgagatgggtggggagcagagtgggggtctctgctcgcttacctgagattccccaaactgacagaccccagggctctacggactgggcctgaccgactgacctccagcctccctccctctgtgctgacgcctggccttcgaagcaggccctgccgcagccctttgcagacccatccccatcccacgcactctctgcccctgggcagtgtctggggaattgacgggtgcctctgaagtccttcgtgtctttgagatgtttgcccagggcccgtctaagtatttaattaggtaatcgacattaattgcaacattagtagcagttgcatggtatgttttaaagcccaattaattttgaaatgggaggcaagatataaagaattaatgagcgtgttttgattttttattactttttttgtagagacagggtcttgccatgttgcccaggctggtctcaaactcctggcctcaagtggtcctccccgctcggcctcccagtgtgttgggattacaggcgtgagccacagtgcctggcctgtatggtgttctgtatgttacagagcatttcatctccattttcatttgattttttataaactccgaaatacataggcatttaatagtcacatgtgtaaagaacagatttaaaggatgagtttcttcttgaggttttttagattttgagctgtatggtatagggaggcaagggttaaaagtaggtttggcactagggtaacttagacttgagtatctgagctgctgtctaaactctgggatctttctaaaccctttccacatttgctttaaaaaaaggatattgctgtttaccacataacgtggctgtgaaaattacatgtgataaaagatacatgtgtacctgtgtacagcatcagtcatataaaaattccactcagcagtatttgtgagtgcctactgtgtgctagactctgggaattcattggtgagcaaaacagacataatctttatccagccactgcccccctttccccaagaacaagaagcatgttaaaaaagatacgtaattataaaacatgaaggactgtgaagcaaaagaatagggtatgtacagataatgattgacctaacttagctggaaaggagaactctgaagcaaatgacatttgagtgaagaccaagaacaagaaagttaaccatgaaagagttcttggcaaaaggaacaacgtgcacattctagaaatggttgtggactttattatagagcccttctgtatctatatcttcatcattactttgatgtattgtggcacacaataagtactcaaatatatgtatggaatgagtggttatgcaattttggtttttattctggacttagcttaatgtgcacatggtaggtattgagtatgtgaattattgaacatgtactttagataaattatgtgcacacctaaattatatgtaatagtgctgcagtttaacattaagatagcttttgtatttaacggaaacgttttttcaagttttagcactttaaaacaaacttcagtgaattttatttttatttggttgtactggagttttgccatattggttatttgctgtttggatgttgttttaatttgctgctgtagcaaagtaccacagattgattggctgggccaacagaaatttattttctctcagttctgaagacttgaagtccaagatcaaggtattggcagagttggtttcttctgaggcgtacttcttttgcttgcagatgtctgccttctccctctgtcctttctgtatgcctgtttgtgttgaaatttcctcctcttagaaggacatgccaattatatttgattaggggccaccctgacgactcattttaattatccttttagagatcctatctccaaaaacagtcacattctgaggtctgggggttaggacttaaataaaggaatttggagggatgcagttcagcccataacagatgcttttgctacattaagatttgcccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtgtcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagatttgcccttctttgaaatagtaataataaaaacagtaatttattattactttgaaatagtaataataaataataaaaatagaaataataataaaaacagtagtggtagttgtaataatggtaatagcagccactaaaatgagtgcttattatgtgccaagcattttgcaaagtgttttttatatattatttcatcataaaaccatcctataaggtaagtacactttcccccccattttctagataagatttctcagcctcatttaagtagttttctcaaggttacctagctagtaaaaggtagggttaggatttcaacccaggattgcctgactccagagtctggtcttaaccatttatcatactctgccactatgccacactgatcattttatgtcctttttacaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacggtagttaatcagtcctcttatttcttttagagttaagcaaattgaatgtgtcatcatatgatccgatggtgtttctcatctactgttatggaatctgtctccactggtgtaagggcagactctctgcaaatgtgtggtgtaaacaagggagacatcattgactactattagtcaatagacagttgtagcagggacttcatgttgtctggagggcaactttacccactcagcatctaacaaagtatttcaaatttgtttctctaagacattttaagattaaaaaaagaaaattttgaaatctgaaagaaaacatgtcagtttggatcggggactatcccagttgatatctttttgttactaggattataaaaatgacaggaggctgtacttcacgtattttctgggttgtgttttttgtgtgtttttccccccacatcctccacaaataaagctgagagactgaactttgatccaagttgaagagttgaaggcattgacctagtagtgaagcaagagcttagaactcttgttttcaattgtttaattccctctgagattacctctacaagtacaccttctttcttgtgaaatgagattaacgtggtaaatgtggctaattcaagtacctactaactgttttaaaatagctataggctgggcgtggtggcttacgcctgtaatccgagcactttggaacgctgaggcaggcagagcactcgtgcccaggagtttgagaccagcctaaacaacatagcaaaactttgtctctacaaaaaatacaaaaattagccaggcacagtggtgcatgcctgtagtctcagctacttgggaggctgaggcgggagaattgattgagctcaggaggtcgaggttgcagtgagccgagattgtaccactacactccagcctgggccgtagaatgagacgctgtctccaaagataaaaatagaaaaaaggcaaaaaacttgatagtaggttcttgcagggattcttttgttgttttgagacagggtcttgctctatcgccgaggcttaagtgccgtgatgctatcacagctcgcactacctttgacctccccaggctcaagcgatcctcctgcctcagcctcctgagtagctggaactataggtgcacaccactgtgcccagctaattttaaaaaattatttttaatagaaacagtgtctcactgtgttgctctggctggtcttgagctcaagtgatcctcctactttgacctcccacagcattgggattatgggcatgatctaccgtggcctggccatagggatttttttttttttttcttttttgagacggagtctcactctgtcacccaggctggagtgcagtggcctgatcttggctcactgcaagctccacctcctgggttcatgccattctcctgcctcagcctcccaagtagctgggactacaggcgcctgccatcacgcctggctaattttttttttttttttttgtatttttagtagagacagggtttcactgttagccaggaggctcttgatctcctgaccttgtgatccgcccgcctcggcctcccaaagtgctgggattacaggcgtgagccactgtgcctggccttttttaatgtttttatttatttatttatttatttttttgtgagacggagtctcgctttgttgcccaggctggagtgcagtgacgctatcttagctcactgcaacctccacctcctgggttcaagcgattctccatttcagcctcccgagtagctgggactataggtgtgcaccaccacccttggctaatttttgtattttttggtagagatagggtttcatcacgttggccaggctggtcttgaactccggacctcaagtcatctgcccaccttggcctcccaaagtgctgagattacaggcgtgagccaccacacctggccagggattctttatagagttgattattgatgggagattgtcatgttcttggatgttatagcttctttcattgtcttggctgttagtgaataaaatctttcttgtattttcaagacaaaaacttgtatagaagaagacgttttgggttgtgaaaataggatcaggcagtagcagttgattaatatgttcacatattccaaaatttcttctcagctatctttcaattaattacacaaagaacctactaggtgcaaggatatggaagtgtccagtgggtgagctagacatgtaaacagataatttacttgtggtctagtaaatgtagcaattaagtatggtcagagtgttgtggaagtatgaaggaggaagtaactaattgcctagggtattcagaaaggattcacagagggtctgtatttttagctgggtcttaaagaatgaacaggagtttgccaggtaaaaagttagagacagcattccatgcagagagaacagactctaagaggctagtagagtagaaaacattgtaacaaagttggaaacactgagtgagttggagggtgatgaagaaaatgtagctagcaaacaaagttgggacctgtttgtgaaggcccttgtgtcatactgtttatgcaattaaacccattacttctataatcattgttaaagattgattcctgaacaacaggctttagaatcgcttgtgtgttgttaatttaaaaatgaattattgagtgccttcccaggcttcctgaatcgttattttctggggatggagccagggcatctgattttgttgttgttgttctgtgggtggttcttagccaataaaagttgaaagtggctgccatagccagtgtgatgctagtagagatctttaagtcaagagttgacatagcttatttttgtacttttaaagaaagcagcttgcatttaattagaaagaatggacctaaagggaacctcgttgtcagggaaatgaattagaactggttataatacacaggagttataaaaattgtttctcttgggtaggacctctcaaccttgagacttggtgttttgggccaaattaattcaatagtgtgggaagccctcctgttctttgtaggatgtttagcagcatctctggcctcttagcccattaggtggtagtagcacccccaattgtgacaaccaacaatgtctccacaaattgccaaatgtcccttgcagggcaaaatcatcccagttgagaaccaatgtcctgagatgcctagaaatgtgtagaaatgggattgctgagctgtagggtttaacaatgttcagctacactagtaatgccaaagtggctttctgcagaggttgtgccaatttatactctaaccagctatggttaagaacttcttttgctccacattttcaccaacattttttattttcaatttgactttttactttttgctgatcagatttgtcgttgatattatttccttcattactagtgtggttgaagatcttttcagatatttgactattgaactttcattttctggaagtgtcaagtcttttttatcaacttttttctgttagattatttgtcttttttcttcttgattcatagacattctttatatattctaaattctaaattcttttcctcctccagttttaccttggtttttcccctcccctctgtctatggcatctcaatgaatagaagttcttaatgtagatggcatgtggcttgtgttttttgtgtcttggaaaatctttccttacactgagatcataaagatatttttctgtattgtcttctatagtgtgcgataggcattcaattccctttttctttttttttttttttgccatagggaaatcagctattctagcatcatttattgaacagagtctcttgtccctaccaatttgcagtaccacctgtcttatatatcaagtattcattagtgtgtttctggccacttaattctgttttattggtttatttgtgtatccttgtgccagtgccaccctgttttaattaatgtagttttatgtgtcttgataactgatagggtagcttcttccaccttgtggtctttcttcagaaatgttttggctgttcatggacttttccactcctgtatgcattttaggatttgctcatcaagtttcacagaaactctgttggtctttttattgggaattaattgcttctatatagacagtttggtgagagtcagcacttttgctatactgagttttcttatccaccaatgggatataatttcaacatattttgtagtgtctttcattaaaattttattgttttctccataaagatcttatatactttatgttagatttattcctaagtagtttatattttttgaaacaattatatgtggtattccttaaaatgttttgctttgttattgctggtgtattttttgttgtttttttgtgtgtacatacatagcaatctagatggctcttaatcttcatgtttttctggacataaatttagattttcaacaacacaattatctgtgtataatgacagtttgtttcttcttagcccttttatcttttaaaaaatccttttcttcattggctaggactcaacgaccagttttgtatcttgttctttgtcttagagggaatactttgtttcactaagtatgattttacattaggtttttcatagtttttttatttgtttaaggaagttcccataaatgtctagtttgaggttttatcatgttgaattttagcaatgttttttcctctacccttggagataatatagtttttcttctttaatattaatatagtatacaaatcaatttatttatttttaataaatcaatttatttatttatttttaatagagatgggatcttgctgtgttacccaggctggaatgtagcggctattcacatgtatgatcatagtgcactgcagccccaaactcctccctcaagtaatcctcccacttcctcctcccaactcactgggatgcaggtgcacaccactgcacctagctccagctccagttgatacttttaaatataaaaccaaacttaactttcagtttgctaatattccctttaggatttttgcatttatttagttaatttaatttttatttattattatttttattattttgagacaggatctcactctgtcgcccaggttggagtgcagtggtgggatctcagctcactgcagcctcaatctcccaggctcaagcaatcctcccacctcagcctcaatagtaactgagactgcaggcacacaccgccatgcgtaggtaattttgttcattttttgtagagacaaggtctcactatattgccaggctagtcttgaactcctgagctgaagggatcctcctgtgttggcctcccaagtgctaggattacaggcatgagccaccacacctaaccttttgcatttattttataagcgaaatcggcctgcgatattgttaggttttagtattacagttatattagccttatcaaatgaattggaaagtattccttctttttctgttgtgttaattaattggtgtaagactgagattatttatttcctgaacgtttgctagaactctgtgctaaaaccatcaggacctggggtattcttactgaaaggttttaactattgattcagttggcttttcatttcttcttgaatctgtttttggtaagttacgtttttttccccaagaatttgtcaatgtcatacacattttgaggggttatacttatttaatttcaggaaaataatgtaggggtcacagctgaaactttcaacgcaaccaaacattagttattcataccaaccctgcaaaaaccaatgcttgatcatgcatactgtgtgaagaatatcagtatctggcatatattgaatccttaccctgtttctggcactgcactaaatgcctgctttttaaaacagctttaatgaagtataattcacatgcaataaactgcacgataagtattgtgcaattgatagatttcagtatcttgtacattttaaaatttgatggcctaatgttgtttatatctgtcccagggaaccacttttggttatgctgatcctctctagtatgtttatttcctcttttgttagtttttgctttctttgggtttgttctgctgtttttatagtttttaagatggatatacaactcattagttttcttccttcctgcctttcatctttaatgtaaccaaggctataaatttccttcagaatactgccttagatatcatcccacatttggatatatacttaatttattttttgaattttaatattttattttttatattatttaaaaattttttgtagagacgagttctcactgtattgcccgggctggtctccaactcctggactcaggcagtcctttctcctcggcctcccaaagtgctgggattacaggcgtgagccaccacgcctggcctacttcatttctttttaaaatctttattttagaaatttcaaacataccaaaatagaacgtaatgacctcctattatccaactacagtaatcactcatggccattcatgtttcatttataccctcccatttcccatcgctttcttcacctgcaccctccgcacaattaatttgaagcaaatcacagatcttatatcattttttctataaacatttcattttcttactctaaaaatactctaaaagcaaatgttcacaccattatcaccttaaaaatataataatttctttctttttttttttttttttttgagacagggtctcaccttttgcccaggctggagtgcagtggtgcagtctcggctcattgcaacctctgcctcccaggttcaagcgattctcctgcctcagcctccgaagtagctgagattacaggcacccgccaccatgcccagctaattttttgtatttttagtagaaacagggtttcactatgttggccaggctggtctcaaactcctgaccttgtgatccgcctgcctcagcctcccaaagtgctgggattacaggcgtgagccaccacgccctgccaacactcccatttttaagtcacgtcttaggtgcccattccctaccccacttgattattagctttttgtggttattttttcttttaggtaaaacgtacatatattaagatgcacacaaatcttagctatatgacgaatggcaatacctgtgtaacccacacctttaccgtgttatagatttcctttgccccagaaagttcctcatgttcctttccacttaatctcctcaccccgtccctgaaagcacccagtgctctgatttttctctccttagttttgcttgttctaaaacttcatataaattgaatcatatagtatatatactttctaatctggcttcttttactgaactgttagtgagattcatccatgttactgttctttttttattctgttttattatgtagtactctattatacggctgtaccacagtttatctattctcttttatggacattgggtttgtttccagttttggattattgtgaataaaactgctataaacatttttgtacttgcttttttgtgggcaaatgttttcatttctcttgtataaatacctaggagtggaattgctgggtgaaacggtagctgcatgtttaatttcataagaaattgtaaaaccttttcccccagtgattgtaccattttatagtcccaccagcagtgagaggtctagttgctctgcagtgtcaccaacatttggtgtttttaattttagccattctagggggtgtctgttggttctcattgtgattttaatttgcatttccttgatgactaaacatgttcagaactttttcatttgattattgatatttgtttatataaccttataaagtatcaagtcttttacccatatactgattgttttagtcagttttattatttagatatatagttcattttcatcacataatttttagagtaatttaaaagtatacttgcattatatttagtaacaaaaacaagattaatctgaattcatgtgtctctatctctttgggtaagacatgttagattccagtttgattaaaaaaaaaaaaaaaaaaaaccttgtagtgacctgttattactcttcttgccttgaaacctgcagctactctattgtgccttcccaatttttcagtatttgagacttctcctggttttttttcccaaaagcattttggagacaaaaggaaatccaaacccattttacctgaacccaaccactcacatgatctctgatgttctccccagaatggtgttgtactgtctgttgtcattcattcagtgtatccagacttgagtatccttagaggtccatatgccccatttatgagaatgaaatttaatcagagggaagactattgaaaatttgtttatttatgtattttttttgagatggagtctcgctctgttgcccaggctggagtgcagtggtgcaatcttggctcactgcaacacctttggcctcccaggctcaagtgattctcctgcctcagcctcctgagtagctggcactacaggtgtgtgccaccacacctggctaatttttgtatttttggtagagatggggtttcaccgtgttggtcaggctggtctcaaactcctgacctcaagtgatctccctgcctcggcctcccaaaatgctgggattacaggcatgagccaccgcgcctagctgagaatttactttttatggtgttttagctgtagcagtcaacttgagcatcctaccaaagcaagttgttaatgcatatgtgatgaacacgccaatgtaacaaaaacgtattcttttttttacagaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaaggtagaggcttaaattgttcaggattaggaatttaacttttaaaaataaacttaaggctggacgcagtggctcgtgcctgtaatcccagcactttgggaggccgaggcgggcggattgcctgaggtcaggagttcaagaccagtctggccaacatggtgaaaccctgtgtctactaaaaatacaaaaaaattagtcaggtgtggttgcaggcacctgtaatcccagccactcaggaggctgaggcaggggagttgcttgaaccagggaggtggaggttgcagtgaaccgagattgcactactgcactctagtctgggcagcagagcaagactctatctcaaaaataaataaataaaaataaaataataaacttaaaaactttaaactgttagaaatatttacatttaaactgtgagaaattagatgcgacttgtaaaatgatattttcatagaaaaactgcccagatttggaaatgggaccagtcatcctaccaccaacccaaaacataagagtattcgcttctttggtcatcctttaagaaccatgaaattgaagaactgagaggaacaaactagtagtagtctagttcattcatttattctgaactttcaagggaagctgttccattaaacaaagtagtaggcgctaatagagttgcagtgttgctgctctagggcacataaaaggtacatggaattcagttcagtgcccttgggaattgtgcagtgaggtggccctggagtagaaaacctcaagttcctcagaaataggtaattaagaaggaaataatctcattatggaggtagtgactgaggaagatgtgaatgttattgtaagtgtggctgagaagaaaacaagagtgacaaaattgctgccttggttcctggggctaattagaagggagtgaggggatggtgggaaaagttttgccaagccatggatagagcctagaagagaggaaagggaagatagttgaagactcactaagctaggcgtggtggctcacgcctgtaatcccaacactttgggaggccgaggcgggcggatcacaaggtcaggagttcaagaccagtctggccaacatggtgaaacccgtctctactaaaaatacaaaaaaattagctgggcatggtggcgcgtgcctgttattccagctactcaggaggctgagggaggagaattgcctgaacccagacccaggacccaggaggtggaggttgcagtgagccgagatcgtgccactgcattccagcctgagctacagagcgagactcgtctcaacaacaacaacaacaacaacaaaaacaaagtactcactagtcaggctgactttagaaaaagctttactttacccacactaatttagacatagaaatagagctgtttggccaggcacagtgactcacgcctgtaatcccagcgctttggaaggctgagatgggaaaattgctgaagccaggagttcaataacagcatgggcaacagagtgagacccctgggctacaaaaatcaatttttttttgttttaaattagctgaatatggtggtgtacacctgtaggctgagctactttggagactgaggtgggaggattgcttgagcccaggagttggaggttgcagtgagtcatgggccatgatcatgccactgcactccagccggggcaacagagtgaggctctgtctcatgtttttgggttttttttttttttctttaagaaaggtgtgtctcactggaaaaaaaaaaaaaagctttgagaccctataaagtttgattcagtatttttaaaatgttgtggtggctaactgcaattacatatggtatgtgagggtatggaaatgccattgtattctgaaatagagcactactttgctctttttgcattgatttcctaggtcaaaagaataacatctttttgcaacagtaattgaaagcaatagattcttttctgtgtttaggttttgttttgttcttactaggatgtacctttgatttggatttgcattcctttccctgtcactagcagaactttacaaaatatactctgctatctattaatactagtttcggctcccagatgctttatcatatagaaacagcattgtagaagagcagctagcttcacgcccctttctaatcaattaactataatctagctgtgaatattgcccttgaaaagtggatgaccctttggggcaaagaaaattgaagacgtgtaagttcccaattttgtcaataaggaaagtactaaaggcactcaaagtagaaactgtacgtgctctgagaaaaatgtgtttggttttgcttgtatagagaaatttaaattttttaatagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacggtaggtgattctatgaataatgaaaaaaatgagcaagtaatggtaaacattgtagtgtatccacttatgaaacttagctttcttggaaatttacaagagggaatatttcttttggtagtgttagaaatgtgtatgattaaaatggattcattggctgggcgtggtggctcaagcctgtaatcctagcactttgggaagccgaggcaggtggatcacctgaggttgggagttcgagaccagcctgaccaacatggagaaaccccgtctctactaaaaatacagaaaaaaaattagccgggggtggtggcacatgcctgtaatcccagctactcaggaggcgaggcagcagaatcacttgaacccaggaggtggaggttgcagtgagctgagattgtgccattgcactccagcctgggcaaaaagagcgaaactccatctcaacaacaacaacataaaatggattcattgtttgaaccttgagatgcattgttagcaaattctgaatttaaaagcatttgttgtgtcattaatctttcattatacggtatgtacttaatatttggatgcctaaaaatgtagattatgttccattagaaaggaaagatttatctaagaatatttcagtcaaattatcttttttgtgcttgactaaagctgacgctctaaaaattattctgccttatcacttgtacactgtagacatgagttatttcacatgatgcattttcctttagaataatgcaggatcaaagtgaaggtaacagcctgcagaatcaagctctgcagactcttcaggagagactgcatgaagcggatgccactctgaagagagagcaggagagctataaacagatgcaggttagaatgagagacagcagattcctattgttacttggacacggaaaaaatgactttatgctgtttcatagcacattaactgtttaatataattctgcaatgcatttcagaaaattctgtttctgtgacaaaaatcagatatttgaaaatttagcttgatccttgctaaatgtatttaattttatgtgttgagagacaattaaaatagttaatgtgcattagagatatacatcttttacttaatttttgcaacaatcattgtcattatttgattaaatgctaatggttgggggatcgtatttgttttttattaatttaagtttttctgattccagattaatctggctcatttatttcaggagaaaattgtatgtaatatgtaaagagttttactcttagatgaatatttgcatttagttcagtcccagccctgtctacacgtgggaatcacttgtgtgataccttgtgctgtctgagctccatatgcagtcacattccattgtatgaggtagggactaggtattgacactttggttttagaaggttcacaggtgtatctaatgagcagtcagggttgcaaaccactggtctgggctagcttttcaacaggtgaaagtagttcagtcctgaaagtaaatatcaggtagtgtgtgtctcttaattttaacacaatatatccaaagtattaattatttcaatatgtagtcaatattaaaagttattaatgagatattttacattattttttgaatactggttctttaaaatatggtgtaatttacacctatttatttacttattaaattggaaacagttgatcagctagtatcagaccagacctagtatccaagtgaccaggttcacctgggaaatttcttaaaaaacagattcccagacccatcttgaaaattccagtttagtaagcttgggaaaggccttggatggctatatttttaacaaacttcctggttgattttaatgcattgccatgtttgggagttacaactttacatttcctatactttagctcctaacaaattaagaattttttcccatccctactatgttgtttggctgagctaataaatcccataagatatccgaatggatggttgtaaaatatgtttcaaagctaaatgatatcattaattatgatataaaaatttgtcacagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaagtaagcatgaaatgtacacttttggatgttaagatgtgcaagttaactgaaaggcaatttgagactgtgtagatactgtgtgaggtgctttgttcatgttcgtctgattggctagctttaggtgccttactctactttagaaattttattaaaggatgcagtgtttcttgttcctaccacttcttttaaaaaaaaactcattctgccactgcctagttcaggtcttcaacctgtcaccttactcactgtgatgatattaatgcttgttgttgagcagctgtttattcttccttgttgatctcctattgaatttttgcagcaactgctttaggactcatccagttctcagaattgtctcacccagctttttttcccctccttcagatctaaggtgatcttaccctctactttactaagaaagactacagtcatctaatgtcgtttttgaattctctttcctttgtccctcagagggaaaacatgtcctttcatttttttctaggatcattttcctgcctgtgcattgattccatctcccatctcatgtgtaagccctttctccgtagatctatgcccttccttcctgtgtgtgcctctctgctgctgctgccttctggctcagcttactcaagagcacatggttatttagtggaaaaatgaagactagatctcggactcctgcctaagagaaaaacagtctcttttagctttgtgaccactttgcactatttccctatcttcctttctttcagtgtcatgcttaccagaattgtgtacgtgctgtcttcatttctgtagaacttgttaactcttatctccttcttttcctactacatgtctgaaatttcttctcaaaaatatttgatgacctaaataaatattctctgtccttttcttagtctccataccttgtattttggtagaacatttggctctgttaaccctcccacttccttggaactcctgccttctatgctattcacatctccttggctctctttttgtcctcttctactgctgtttctgtctctcttgggcgctcttcccaatctccaaagagtcagagtcctcctaagctctgtcctgaaccctctttcattgtcctttcttaccttgcactgctgtatgctgcctctgcttctaatagccgcctgcatatgacttcaagcatgtttccaagcctgacctcctgacctcagtgcccagctgcctactgtgcaggcatggagtgttcagctcccagaccaacttctccctcattcttctgttctggtcaacgttactgccatgtggcagtaaagcttgaaacctcagggtcatttttgactttaccttttttctttagtctcaaacttctaatggctatgaatacctttttttaatgctacttccatgaagtatcatattgatctcctcctcaaactcttctttctaagtacttttttgtatcaccctaatttgttaattcattgaaaagttacttattgagcacctaactactcactaggcacagaagatacaaagctcaaaagatgtgtcctcttcctttaagaaaacattcatcttagtggaaagaaacagataattgacgtaataaggttattaatgcagtacaatgggagcttgagagaagaatcccttaaaactttcctgaggctgtcaaagatcactggactgaggagatgtggtataaagagaaacttgaaagatgaataggaagactcatgatagggaagagatttccgagagaacaacctgtgccagagcaagggggccagagagaacatggcatatttaagggactgcagctagttccatactgctggaacataacgtcttcagagatgggaggcaaaagactcataaagttcaacggcaggcagaagccatggtcaggtttgagtgtgagaactgtggcagcctgatgaaaaggttaggggagatttgggcctctgtcttgttcatcgttgtatccccagcacagtgcctggtattcggtacattgttgaaaacatggaagtgataaggggtggcatcaatggcatgtagatggtgaagaggtgatcataagaaataatgaggacctgatcaaagtttttggcagtgaggatggcaggcaggggacagctaagagatatgtgggagatagaatatatgacatgtggagatttaactggaaggatgggggaaaaaggcaaatggaatccaggatgactccaggtttttggtttaagtgtatgaatgatgtttccttgtgttaataaaaggggaaacaggaaagagaacaggttagggttaaaggagagtatgacgaattatggtaagtatgcaaaattgatgcaacattgaggtgacaatgttagaaaggtaattagaagtaagttgggagagtaggtaagtttaggcaagagcgatgtgtaacctaacggggagaaaggctgaggtctaaaaacacagtcttaaacatcagcatttacaaattgggcaaaaggatagcctgcaaaagaaaaatactgagaaggtgagtggtcagagattggagagaaccaggaggagactgatgccatccaatgaagccaagcagagggagagtttcaagtggtgcatgatcaccaaccacagcacgcggctctgatgtgacaagtcccgagctaaattcctggacttggcaactaggaggtccctggggacctctcaacagagagttccggggtgcgctgggagctgaagacatggaggcagggtacttgaccatggacatgaggacagtagctagatgggggaatgaggttgggaggtttctggttttttattaaaaaaaatcttaaaatgttataaatgatcatgtttattatagaaaatttgaagaatacaaaagaagtttgaagaaggaaatggaaataacccataatcctaccacccagaaaaggaaaaattatttttgatggaggagaatgactttaaaatattttaatttaacgtgaaagctgctggtccttgttgttcctagtctagaattaggactttataaactggtctttgcatgtcaaatctcttcttcaaactcatcttttatctcaggggtcagaaaacattgagagggtcaaatagtaaatattgtaggctatgttggctacctgtagtctccatcacatattctttgtctttattatttatgatccttttaaaatgtaaaaaaaaaatttaacttgcaggctgtacaaaaacaggcccacggaccatcatttgtgagcaccttcttcatagcactgccaggttagcctcctaaaatgcatctctagtcatgtcactcctctctctactttttggtaatttgttttagcctgccacataatattaaaacattttagcctgagatcaggagcccctccaaattggtgctaaaatactatctgagctgcatctcacattattttcttacagactttgtgtgcttttgcatttttatgctttgctctctgtttttctctgcactttaaaaaagtctacccatatttcaaggccaacatttatgctctcttaaagtctcctcttacccagaagtggtttttcctctcagaactctgcaagtaatctgaccatatccttttctctacttgtgttgattgccttctgctggatacttgtaacttctcttttagtttgtaaggcagagggtactatctatagagagagacattatctttattgcgcagaacacttagcaccatttacttgttgggtagaatgtgttggaaaataaaaactatgagaagaaaatgtgagaaaagtcttgtttggccaggtgtgatggctcactcctgcaatcccagcactttgggaggctgaggcaggagaattcctggaggccaggagttcaagaccggcctgggcaacatagcaagaccgtatctcaaataaataaacacaaattttttttaatctttttttttttttttttttttttagacggagtctggctctgtcacccaggctggagtgcggtggcgcgatctcggctcactgcaagctccgcctcccgggttcacgccattcttctgcctcagcctccctagtagctgggactacaggcacctgccaccatgcctggctaattttttttgtatttttagtagagacggggtttcaccatattagccaggatggtctcgacctcctgacctcgtgatccgcccgcctcagcctcccaaagtgctgggattacaggcgtgagccaccgcacccagctggaaaaaaaaaatcttattcataacaagctttcaactttaccatgattgtggggctaaagtccaaggacattatacagcaaggctctgttgtgttttttatccttagggatttaagaaaatctgtggactttctttgatggagataatggaattttttttagtgggttattttctgtatagtagatgatattcaatatacaaactaatctctgctttgcttaaacatatttcttcttttataatagtctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggtaagattcatggtggttcagcttagtagacaccatttaccctcaggtgttaacagtttgagaggtggggaaacagcattactaaagcgataggtttctcgcttctcttcgcttcgcttcgcttcgcttctcttctcttcctcctcctcttcctcttctcttcttttggagtcaggatcttgctctgtctcccagcctggagtggtgtgatcatagctcactgcagcctcgaactcctgggctcaagcagtcttcccgcctcaggctcccaagtaggtggaactacaggcacatgccatcacgcccagctaatttttatattttgtagagacagggtatccctgtgttgtccaagctggtcccaaactcctggcctcaagtgattgtccctcctcagcctcccagagtgctgggattgcagggctgttgcagcccgtgctgggctaaagcagtaggtttctttctttctttctttcctttctttcctttctctcctttctttccttcctttctttcctttctttccttcttttttttgagatggagtctcggtctgttgcccaggctggagtgcagtggcgtgatctcggctcactgcaacctccactccacctgccaggttccagggattctcctgcctcagcctcttgagtagctgggattacagacgtgcgccaccacacctggctaatttttgtattcttagtagagatggggtttcaccatgttgcccaggctggtcttgaactcctgacctcaagtgatccgcccacctcggcctcccaaagtgctgagattagagacgtgagccaccatgcccgaccaggtttctaatccataagttgaccataaagttatggtgataaaaaacagatcaattcattcaacaaatagttaccaagtgcctgccatgtgcctaggtttggagttagaacagggtcttcataattatagatcttacattctagtggttaaaagcaaatcagatttgagctcctatgtgaagctgagatgttttctaatattagtatgggctcagggatgatcttctaattacagttttatccttattcttataatttatagtttatgtataattactatatttaaaagtaaagttgggccatttattttgcttaaacttcagggtctttgacataaatatcgtaggaaggagtctctgaaggtgagagaagataaagtgcagcataacgagcttccttttcttaaaaggaagaaactttttgtagagaatgttcatccatgcattaactctgcacattgtgagacttgtgaactacaaaagaaagcgtgaaagttgtgagaataggataccttgtctagagcatagacttgaatagcagacagacgtggatagattctgtctttggtacttaacagatgctgcttccacaaggcacttcatcttgcggagctttaattttctcatctatagaatgcaggtaaacaaaggttctcttgacaataaaggataatatatgaagagcctagcattgtttctgacatgtaatagaccctcagttaaataatagctgctattatttctgggtttattgttattcattaaagtaggattttttttttaatctgtgaatttgaattccaaagaattcagtcctgcaaacttagaaattgggtagatgctaaacttactcatatctgttcatgtctttttggtgagattatgaaaaatacttgttttatttaatatatcagcatcattaatgacattgacccatttttttacccttctcaaaatttatgcaatgtataataagtgttaggtctaacaaaatgaaagaattgtaaataattacaatagctattgtttactgagcacgtatgttccagatactgcacagagcacttaacatatatccttacatttattccttaccataactctgtgagggagatgatgatattctcattttatagttgaagaaatttaggcatggagaaggaaagtaacttgctgcaagactagtaaagtggcagagccaggattagaacctagtctaactccaggacatgtttttgaccactgtgcatactgcctgcctctcaagaatttgcccgatgtagtcaaattgatgacaaagattaatctaccttctgctaacctgaaaactcaaaggtagggaaaaatagttgtcattattgctttttcctctaaatctacaaagttgtgtgagttcagaggattgcactgtgattatctgggcatcttgttagtcttagttctttcaaacagcatgtgaagttccaaggtttgtggtgatgagtatgaaacagaatgtaccaacagataaaaaagcaaaaataagatgctgattttaatcttctgttgtgccatatgaatggactcatgcttaatccatttggggaaaatatagaaacctagagccatgtttttgctactaggagatttgacaggaaatccagaaggtgagttcaaagaaatgagagtaagaaacataagaacatgtaaaaaccaataatagtaataaagcaataaagctaaaagaagaaaattatatgccaacttctggtgatatgcaagacaagttatattcttatcatatgttgattactggggaacagatgcacaccaaaactaattataacctgcaatttcaggggactaatgcagtgaagtcctttgtgctattatgtttctgattttttttgaaactgttagcttttgagtaaagatataagtctcccagtgagcctctgccgatactcgtgaaaccacatggcttatgtgctgcagcagctgtagcgccccattcattctgctgttagccatagtagacaatgaaggtgtcaggttatatgctccctataggctgaaaccatgtctcattcacctttattcctcagtgcctcctgagcccagcacatagtaattgcatggtagacaggttgtgtggctcaacacctgtaatcccagtgctgtgggaggattgtttgaggccaggactttgcaaccagcctgtgcaataaagccatatcccatctcttaaaaaaaaaaaaaaaaacttaagccaggcctcgtggcatgtgcctatagtcccgctactcgggaggctgatgtgggaggatccccttgagcccaggagtttgaggctgccatgaactgtgattgtgccactgcactccagcctgggtgacgtaagactctgattcttaaaaaagaaaaattgctcaataaatgttgaactgaatgttaattattgcttttacatgtaagctttttctctttaggatatggaggcacagcaagttaatgaagcagaatcagcaagagaacagttacaggatctgcatgaccaaatagctgggcagaaagcatccaaacaagaactagagacagaactggagcgactgaagcaggtcaggatttgagattgatgacttctgagactctgtcctctagcggtcatatgagcagacctcccaggaaagcagcttactgaaatttttagagtatgggcttagggttaccccacaagttcctcctgccttcccatctcatctgaaggggtggcctgcccctccacacctgtgggtatatctcatcaggtgggatgagagactgagaaaagaaataagacacagagacaaagtatagagaaagaacagtgggcccaggagaccggcgctcagcatacggaggacctgcaccggcaccggtctctgcgttccctcagtatttattgatcactgttttcattatctcagcaagaggaatgcagtaggagagcagggcgatagtggggagaaggtcagcaagaaaacatgtgagcaaaggaatctgtgtcacaaataagttcaagggaaggtactatgcctggatgtgcacgtaggccagatttatgcttctctccacccaaacatctcagtggagtaaagactaacagagcagcattgctgccaacatgtctcgcctccagtcacagggcggtttttctcctatctcagaatagaacaaatgtacaatcgggttttatcctgagacattcagttcccatgggcaggcaggagaaagaggccttcctcttatctcaactgcaagaggccttcctcttttactaaccctcctcagtacagacccttgacaggtgtcgggctgggggacggtcaggtctttcccatcccacgaggccatatctcaggctatcacatggggagaaaccttggacaatacccggctttccagggcagaggtccctgcagctttccgcagtgcattgtgcccctggtttatcgagactggagaatggcgatgacttttaccaagcacactgcctgtaaacattttgttaacaaggcacatcctgcacagccctagatcccttaaaccttgattccatacaacacatgttttggtgagctcaaggttggggcaaagttacagattaacagcatctcagggcaaagcaattgttcagggtacaggtcaaaatggaatttcttatgtcttccttttctacatagacacagtgacagtctgatctctctttcttttccctacaccatcctccttgatttttgttttttaacagatgagaaatggaggcacagaatggtgatggcacttgcctggtacaactaattaaagatggaatagaaccaaggtttcctgtttctgagcccagaatgctttctattaccctgtctgtattttgttatatctcctagtatagaaaacttcaaaacatattatattcatcagttggttttcatagtttattgcatttgtgctttctaggaacagcagtaaatattatttaataaaaatacagatacaatattagtgccatattaactgttctttctgcttgagaaaaaagtcttatacagactcttctaacaaatcatgtttaaaattatatttcattgttcaattagcagttgcatgttcccaagccaaattattttactttaatgtactcatataatagtttcagtattaacagagttaaacatagccacattttcagaataagattctatatctaatgttaataacatcactaatttactaagtgacaacattgttataggcatttagtacatattatcttatttcctactcacaagtaaatcactactattctctttattttacagaagagaaaactattcttataattctcagtgctttactgttagtatttccatctttgtgtatttaaattctttaaagacgtttttcattaggatttattacttctgaaacttgttcttttctcagagaaatgttttttattataaaagttgtaattcaactctatttcctgagtactcagtgaaaaactcaccaagtaacaacgtgcagggtatgtcataggcagttttagataatttagttatgagattagcgtcctttcagaaattgcattttaatttattcaaggcactattatatattaaaaggcaacaatttaatgttcttgatgcttaatgagataattttcattttgttatggcagatggttttaccgtacctcttcccagtgcctttttaaaatgagggagttaaatagaagaaaatggagcttaatgtagctgtgggctatttatttagtatatgttccaaatggaaagtgtttaatcttgcaattgaagagtcctttagtgcttcttattaatttaagtaacaccaaccttaagttttgtacttgcctagagcttaaaagaaatcagacaaaccttgtaaagtgtgattctcctaccctaattacctttctcataatctcttttctcacctctcttgatttttttccatttgtgtgatgaacaacttgagctaaatgtttaacagagtctctagcagtgtgctgccatatcacctttactttttcagacagctcccgaactgctgctgtactcttcactgtcttcactgttaagtgaaaagcttttgaaagtacttagtaactccagttactccttctctgttctacgttgtatttcagtgatttggacacatttttggattggcatgtgctttactcttagattctgagctgtctctgagtgatccattgtacaaacgagcagtgcattagtgcagttgttaatgagtttagaggtattagcctttttggggagattagccttttgtctataatatgaattgcaaataatttttcccagcttgtcatctgtcttttagtttgcatagggtttttattttgttttgttgccatgcagaagttgatttttgagacggagtgtcgctctgttgcccaggctggagtgcagtggcgcgatctcggctcactgcaacctccgcctcctgagttcaagcaattcttctgcctcagcctcccgagtagctgggattacagacgttcaccactatggctggctaatttttgtatttttagtagagacagggttttaccatgttggccaagggctggtctcaaactcctgacctcaagtgatccacctgcctcagcctcccaaagtgctgggattacagttgtgagccactgcacccggccagaagttgatttttatgtagtcaactttatcattcttttctaccaaggcttctggattttcagtcaccgtgttcctctttgtgaaattataaagaaatttgcctctgtagttttcttctagtacttttttggtttgattcttgcatataaatctttgatttattaggaatttactctgatgtgtgaggtgagctacagatccaaccgaattttcttccatatggctacttttttcctagtatcatttttttaaatagtttattgatttgagatgtcacctttatcatgtcctaaattctcaaggtatctagatctgcttctggacttttgttctcttccattagtcactttgtctgtttatgcatcagtaccacattgcttttaatttctgagattttatatgttttaatgtctttatgacccgttctccttttcagagcttctggcttttctttttcttttctttttttttttgagccatggtttcactctgtcacccaggccagaatgcagtgatgcggtcacagctcactgcagcctcgacctcctcaggctcaggtaattctcccacgtcaacctcctgagtagctgggattacaggcacgcaccaccgagcctggctaatttttttatattttgtagagatgaggtctcactctgttgctcaggctggtcttgaactcctggactcaagcaattcacccacttcagcctccccaagtgctagaattacagttgtgagctaccgtgcccaacctggcttttctttcttacagttttccatatgaatactagaataactttacatagttttttttaaaaaaagcagcttttgtttttgttgagatcatgtcagacttatgaattaattagaggagaactgacatctttatgatgttgtattcctaagaatatgatatgactttttatatgttccagtattttttgtaccctttagaaatgttttaaagtattctttatatgtactccacacatctgttgttaaatttgtttttgctactattatttcttggggcctttttctcatatcttctaactgctttatataaaactattgatttttatatattgttttatattctgccaccttactgaattattgtttttctttgtctcatgtactttgcctatttttaaaatgttcctggtttgtgtttttaatctattttatgaacattatattgatctttatcatatattttatgaatattttttccagttgtcatattaatgctatataactgagattcttgaagagattatccattcttcctcattacaagataaacattttttgtttctgattatttacactgttaataattatttattatggatctttgtttacaatacatactgaagtgccagcttttcatcagacccatctgttattcacttagttatatactcattatataatacactctgttataaactcagttatatacggagttacatgttcagcacatactgattgtctaccatgtgccaggcactgatttaggtactgaggatggaataggggacacttactttgcttctgttttgtttgtgcctcactttgcaggagttccactatatagaagaagatctttatcgaacaaagaacacattgcaaagcagaattaaagatcgagacgaagaaattcaaaaactcaggaatcaggtatgaatcactattcacaacttgtgaaaagatgccactgataaagctacatttttttaaaaaggacacagtaagaactttccccgtgttttcacctgagttcttttgtaacagtggtgacaaaagttcttttcaacctggtatagaaaattcatctaatgccatttgagtctacatttgctctgttctatgatttgcttcttatagaagtatcttgtagccaaagtcacgaagtagatgagaattaccccgaaatttcagacctttgacatcagtgtggttgtgctgattgccaggttcataattgtgatttcattttcctaagaaaaatctaatgataaatcttcctattaatgattgatcagtcttccataaagtcaccaagatatttttttaaccgtgaaaatgtaaaatgtacagaaaataatgacactcatgtgcctaccacccagacttaccaaagcctttatcattagctgatagagtcacacgttcacattccctgtaatcatagttgtcctttccttccttaggtttagacaattgatttaatggacttaataatcatttaaataatttacataaagattgagtctttattttttagttaatggcttagtttgaactatgaaaagtcaaataattttggtcttttaagtttccagacttgatagtagtccataattttaaatgttttgaaatactttgtcttaatttttataagagttgagaacagctcactgatttgagcattcccttcttcccttgcctattttgtgaaatacttacagatggtcacgtgatgtgctagcagaaagtcaaaagaaggagcaaaaaccaccaattggtttaatcctttttctatatttactaaatatttattgagtacctactgtatctgaagtattgcaccatttttgttaatcaagaattaggccaggtgaggtagttcatgcttgaaatcccaacactttgggagaccgaggcaggaggaccgcttcagctcagcagtttgagaccagcctgggcaacatagtgagaccttgtctctacaaaaaatcaaaaaattaggcgtggtggcacacacctgtagttctagctactcagaggctgatatgggaggatcacttgcgcctgggaggtcaaggctgcagtgagctctcagtgcacctctacactccaccttgagtgacagagtgagaccctgtctcaaaaaaaaaaaaaaaaaaacaaccatagggtggcttatgcctatagtcctaactacttgggaggctgaggcagggagatcacttgaggtcaggagttcaagatcagcctgggcaacatagcgagaccatcatctctaaaaaaatatttttaattaggtgcatggtggcacgtacctgtaagtcccagctacttgggaggctaagacataaggatcacatgagcctaggagttcaaggctgcagtgagctatgatcaccccgctgtactctagttgggcaacagagagagactttgtttcttaaaaagaaagaattaaccataggaggatttctctgaaaggtttttcatcaaattagaagagagcaaaacctttgtcccgtagaattaagttgacttgtacaatctgaaaagagatcagcatcttaatacattgccaaaaaaaaaaaaaatcacacaattggagtgagttaagatttattctgaatgaacaataaagaattatgcttattatttttgggctttctgcatgtaggttaaaaaaataggttgccagtttgaatgttttttcatttttcacacctgtaatcccagcactttgggaggccaaggtgggcagatcacttgaggccaggagttcaagaccagccaggccaacatagcaaaaccctgtctctattgaaaatacaaaaaaattagctgggcatggtggtgcagacctgtaataccagctacttgagaggctgagacaggagaatcacttgaacccagaaggcagaggttgcagtgagccaagattgtgccactgcactccagtctgggagacaaagccagactctatctcaaaaaaaaaaaaaagaaaaaaaagaaaattattgcatgggagtagatgaaaacatacagagaaaaaaaatgaacctttatttttatcccctaattagacttgcaaagttaccaaaaattaatttgagatgacgctaagcctaagctataaagcttctaggagaacgtgtaggagaatctttttgcaattttgaggctgacagatttcttagagaagatacaaaaagcgctaactgtagaagaaaatgatacattgctattcataaaaattaaaattttcttctcatcaaaagagattataaaaataaaaacaggtaagccacagattgggaaataatatttactctctctctctgtatatatatatctgataaaggatttataaccaggataagaactcttaataataaggtgcacagccatttcttttaaataggtaaaagacttgaatagacccttccaaaaagaagaaaaaagcacaccttgttttattgcatttctctttattgcagtttgcagatactgcatttttaccaaattgaaagtttatggcaaccctgcatcaagcaagtctgtccacaccatttttccaacagcatatgctcacttcatgtctgtgtcacattttggtaattctcacaatatttctgattttttaattatatctgtggtgatctgtgatcagtgaccttttatataactattgtaattgttttgggggcacacaaactgcatccacataagacagtgaacttaatccataaatgtgtgtgttctgacagctccatcaactggccattcccacatctctttacctctcctcaggcctttctagtctttaagacacagcaatattgaaattaggccaattaataaacctacaatggcctctaggtgttcaagtgaaaggaagagtcagatgtctctcacattaagtgaaaagctagagatgattaagcttagtgaagaaggcatgtcaaaaggcaagataggcccaaaactaggcctattggcaccagtcagccaagttttaaatgcaaaggaaaagttcttgaaggaaattaaaagtgctactctagtgaacatacgaatgataagaaagccaaacagccttattgctgacaaggagaaagtttgagtggtctggatagatcaaaccagccacaacattcccttaagccgaagcctaatccagagcaaggccctaactctcttcaattctgtgaaggctaagagaggtgaggaagctgcagaagagaagtttgaagctagcagaggtttggttttgaggtgtaaggaaagaagccatctcccaaatgtaaaaatgcaaagtgaagcagcaagtgctaatggagaaactgctgcaagttatctgggagatctagctaagatcattgatgaaaatggctgcactaaacaacagattttcaatgtagatgaaacagccttctattggaagaaaatgctatctaggactttcatagctccttctccaggagaggagaagtcactgcctggattcaaagcttcaaaggacgggctgactctcttgttaggggctaatgctgctggtgactttaagttaaagccagtgctcatttacaattgtggaaatcctaagacccttaagaatgatggtaaatctgtgctgcttgtgctctgtaaagggaacaacaaagcctagatgacagcacatctgttcacagcatggtttactgagtattttaagctcactgttgagacctattgctcagaataaaagattccttttaaaatattactgcttattgacaacattcctggtcacccaagaactctaatagagctgtacaaggagattaatgttgtttatgaaaacatttttgtttcatccattgtttatgaaatcatacctgccaatacaatatccatttggcagcccaaggtataattttgaccttcaagtctcattatttaattaaattaattaatttatttatttttattttttgagacagagcctgattctgttgcccagactggagtgcagtggcctgatcgcagctcactgcaacctctgcctcttgggttcaagcaattcttgtgccttggtctcccaagtaactgggattacaggtgcatgccagcacactgggctaatttttgtatttttggtagagatggggttttgccatgttgggcaggttggtctctaactcctggcctcaaccaatccacctgcgtcagcgtcccaagtgctgagattacaggcatgagccactgcgcctagccagttaatttatttttgagacaaggtcccactctgtcacccaggctggagtgcagtggtgtgattttggctcactgcaacctccacctcctgggctcaagtgatcctcccacttcagcttcgcgagtggctgggattacaagtgcaagctaccacgcctggctacttttgtttttttgtagaaatgaggtctcactatgttccccaggctggtctcaaactcctaggctcaagtaatcctcccctctcagccttccagagtgctgagattacaggagtgagccactgtgcctggcgagtcttatcacttaagacatactttttataaggctattgctgccatagattccttagttggatcttgaggcacagtcaattgagaaccttctggaaaagattcactatactagatgccattaagaacatttgtgattcatgggaggaggccagaatatcaacattaacaggagtgtggaagaagctgattccagccctcaaggatggctttgaggagttcaagacttcattgaaagaagtaattgcacatgtggtagaaatagcgagagaactagaattagaaatggagcctgaagatgtggctaaattgctgcaatctcataataaaacttaaacagatgaggagttgcttcttaccgatgagctaagaaagtgatttcttaagatggaatccacttttggtgaagatgctgtgaacattgttgaaatgacaacaaagaattgagaatactacattaacttagttgatgaagcactggcagggtgttaaaggattgactccagttttgaaagatgttctgatgtgagtaaaatgctatcaaacatcattacatgctactgggaaatctttcgtgaagggaagaacccatcgatgtgacaaactttgttgttatcttattttaagaaattgccacatccaccccagccctcagcagccaccattctgatcagtcagcagccatcaacatcaaggcaagactctccaccaacaaaaagattaggactcactgaaggctcaaatgatggttagcatgtttatttaaagcaagcttgggccgggcatggtggttcacgcctgtaagcccaccactttgggaggccgaggcaggtggatcatctgaggtcaggagttcgagactagcctgaccaacatggtgaaaccccgtctctactaaaaatacaaaattagccgagcatggttgcaggtacctgtgatcccagctattcaggaggctgaggcaggagaattgcttgaacctgggaggcggaggttgcagtgaggtgagatcacaccattgcactccagtctgggcggcagagcaaaactccgtctcaaaaacaaaagcaagcttgtccgacccatagtcaacccaacacagaattcgtaaacttaaatcattatgagattttttttgtgactggtatttttttttttttagcttatcagatatcattagtgttagtgtattttgtgtgtggcccaagataattcttctagtgtggcccagaaaagccaaaagattagacatccctgatttaaagtatgcacattgttattttagacatcatgctactgcactgttaatagactacagtatattgtaaatacagctttttgttgttgttgtttttgggagacaggatatttgctctgtcacccgggctggagtgcagtggtgcgatcacagctcactgcagccttgacctcccaggctctagtggtcctcccacctcagccccccaagtggctgggactacaggcatgcaccaccacactcggctaatttgtaaattttttgtagaggtggggtcttattatgttgcccaagctggttttgaactcctgggctccagcaatcctcctaccttgacctcccaaagtgctggagttacacacgtgagtcaccacacctggcctaaatataacttttatatgcactgaggaaccaaaaaattcgtgtgactgactttattgcaatattcactttattccagtggaccaaacccatattatctctgaggtgtgcctgtatatgaatgattaaataagcatgtgaataggtgctcagagtcatcactaaggtatactaccacacacccactagaatggctgaaatggaaaagattggcagtagcatgtgttggtgaggatgtggtgcagctggaactctcacccactgctggtggaagtgcacagcagcacaaccactttggaaaactggctgtttctgataaggctaacgtacatctaacctgtgactttagatatttacccagtgtaaatgaagatgtatgaccactagaagacttgtacatgaatatttgtaacatgcttgttcataaatagcccaaattggaaacaacccaaatgtccatcagcaggtaatggataaacaaattgcaaaccattcggcaaactaacacaactcagatgaatttttttttttaaaagccatatgcaaaaggattcatactgtgtgattccactcaggaaattcaagaataggcaaaactaaattctgctaatagaaatcagaatagtgattgtctagggtgatggaaacattgtttgttttgatcttgatgctgactataccgtcaaacatttgtcacagttcgttttttgcttaatacctgggtatttcactatatagattttaccttgattaaaaaatcttgaagtatgttgattaggggatcatagtaccatcttaaaattgagcattcttttaaaaatagtaaaccttagtttatattcaataaaattccatctggtagttatttgttgtggtgtgcttaatttgtggggagtgctgtaaaggattcataagaaaggaagctaattttttaagtgcctaccatatgacaggtaccatattaggtgttttatatgttaatttaagtaagcatcatatcctatgaacaaggaaacaggctcagatttaatagctttcccaagatactgtagctaggaaatgtcagagctggggttttaaacttagatcaaacttttttcaaaactgtattgatgtagacaatgattcttgccctcatgaagctgacttacagtgtcattgaggaggcaaaattgactcccataaaacagcgttatcggagtgactgataaataccaagacatttaccaagaaagctaagattaacctgggctagagtgattagagaagacttcaacaaagagtatgaagtatgttgattaggggatcacagtgcaatcttaaaatggagcattcttttttaagtagtaaaccttagtttatgttcaatataattccatctggtagttatttgttgtggtgtacttaatttgtggggagtgctgtaagggatttataagaaagaaaggcaggtggagcctagataagagaaggggactgagtttccaaacagaggaaacgtggccggcatagccgaggctggatgagagtagagggagatggagacagataagaccagatggaagatggaatgaaggaagtcgttaagtatcaactttcagccagagtctcctaggacaactatcatttactgtccctaaataccatgtgcaacaggtgctgtcatcttcactaacagatgaggaaacagattcagagaagtatagcaattaacctgaagtcaaatagcttgaaaattgcagagcagagatgaaaacctcagagtgtgatctttgcgctgcaccgtaactgttgaatgatggaggcttttgaatccctgttgaaaagtgtggattgtgtcctctaaacccatgctttgaaatactttgaccatgacgcctcagtgagaaaaacagtttacatcgtgtctcagtactgacatgcacttacatgtaccaaactgaaacaggagtttcacaaaattatacttttatatatactatatgttacataaatatcagaatatgtcccattctattacattttctaaaatgctgattttgacccaccaaattgatttcatgaccccagtttttgaaaatcacttttgtagacattgagtcagtatagagttttgagaaatcaatgaatgccacaatttacctatgaaaatgtagtagtgtgatttctgtattgtatgactttcattttatgtaagaattttgtgaacactttctctttcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggtaatcaaaaaaggaatctcaaaagaacatttcattcaaacatgcttttgaaaagttatagaaggactatttttatttgaaagaaacttcatccagtgaaggactcaattttctgatatgagacctgggccacgtactgtttagtattgttagtgaaccggataatggactaattaatattcctcaccagtattagacttggggaaagtagtctgaggattgataattatattgtaatgtctgagacacttaacaagatgatgctgacaaggcgaggaattcagtagagaggagctttcaggacacttgaaacaagatttgctttaataatcttccagtaaatagttacgggtattagagctaatacatagttcacataaccatatctaaagaaatctatagattcccaacatatgtaattaaaaaataatgtgtaagatagtataagcatcaacagatcagatttttaatcttggaacttcgtaaagtctacaaattgtcattcagcaaatttctcagttctttggctttaaattatttcttttaataaaaaaaattgtttaagagacgctgggtgccaggtatggggatggcactgtaatttaaaaagggtgatcaggaagacctcgttgaaaagtgtcacttcttttttttttttaatgtataattatcattttatttgtaattgttaattacaagtaaaaatgaaattataaataagtaaatcatactccttaatggcataaataaaaagtgcctcgcttaaattaataaaattttcctgaccataacttctgtgatttttttaagggttttcagtttcttttaggtttcacctttttttttttttttttatttttttattattattatactttaagttttagggtacatgtgcacaatgtgcaggttagttacatatgtatacatgtgccatgctggtgtgctgcacccattaactcgtcatttagcattaggtctatctcctaatactatccctcctcccccctcccccagccccacaacagtccccagagtgtgatgttccccttcctgtgtccatgtgttctcattgttcaattcccacctatgagtgagaacatacggtgaaaagtgtcacttctttaaagtcccaaaggaggtaagatagtgaacaatgaggaggcatagaaaaaaagtgttccaggcagaaagaagagcaggcacaaaggccttgaggcaggcatgttcctggcatatttcaggaacagcaaggaggccaaggcctctggagtagactgagtgaagaagacacttgtgtaagatgaatccagagagcttagaataggccgttgaggcctgtatggggacttttactctgaatgaggtaggaagccattgaaggatcttgagaggggggactgatctgacttgcaccttaataggctgcctctgactgccatgtcaagaatagactgcacagggctaaaagtggaagcagggagacagggcaagaggaggccggaggtgggtgggtagccattgcattaatccatgtgagagatggtagtctagaactgagtgggattgtgaaggtggactgagaatttattttaaaggtaagctgacagaatatgttggcagatgagatacggagtttgagagaaaggagtcaagagttttggcctgagcagatggaaggattggaattgtgatgtcctgagacagggaaatggcagctgaggcaggttgacagcgaggacaagaactctgaattgtagtgttaggcaggctttggggtgcccgttagatatctggatggaagcgaataggcagttggatgagtctggcaggggatgaagcctctgggctggagtacacatttgggagtcctctgcttcatagaaagaccacccggcctcactcctcctcacataggaacaaagggcccattaatattgactcttgtcaacgcttagtatttgtaaatttcttaatttttgctaaaatcattttcttatttaaaacttttttcttgttgtggatatggatgtttaaatatttatgtcatcaaatttacctgtcctttctttatagtttcatctactttggggtgatgcttagaaagttgcccttgaaaattccttccacatgtaatacagtgtatttccaattataattgtcttagttaatttttatgtcagtacactaatttattttcttatttaaacaggcactcgtctgcgaaatgttcctgttctttttaatgacacagaaactaatctggcaggaatgtacggaaaagttcgcaaagctgctagttcaattgatcagtttaggtaagcaatgccagtagggatgagtgatggaccatcagctgtttttacgtttttcagggtttcaatcacagtgactcccatcaggcagagtctatatttaaagtgacttactcctttcaagatattttatacttatatacacttttatttatttcacagttatattacactttcatgaagtgacttctttcatgatatttgaaatatcatgtcagaaattatgtcaagaggtctgccaatgcctacattttattgaagatgattaaccctgactatacagggtttttctataataatttttctataataaattctatttttaaaaacttcattaaattttattgagaaagcctctacttcatgtaaaagtatccatttgaatgttttatcccagaattttatcatgctattagaataaaagatgctactatatatagctgaacagcactcattgtattatatattttatataaataacaaaatttatgtttatgtatatgtaaattttttatattagcagacatctgccttatcaaaaaaatattttaatagtttacatatagcattgataaggttcttgtctaaataacctactgtaccctttttctttgtagtgtttataatgaaaagttttaatgaattgtggcataataatctttttgtacctttttgtgtcagaattgagctattgtattaaaaataagaatgatataccaagatgactgaagcctcagaactaggatgccatagccattatgtccaaattaagcacatctagttcaactattcatttattcaacatacgtagttgttagagaacctaagtgcaagacattgtgctagtggcaatgaaagaagcagaaaggggtattgcttctgcatgtacctgtcttgatagggaaaaaaatgttgcagaggcataatagatctggacatcatattgcttccacactatttattcaaatgcatgagtttatagctttgtaccttttagaagcatgtatctatacaaaagcttctagattagctatttgcaggttaatgccaaccagactctttttttccccagtcacatagttgacacccacctaatctttcgtaacttctttaattccactaaaaaaagatttaggccgggcacggtggctcacacctgtaatcccagcactttggggaggctgaggcaggcggatcacctgaggtcaggagtttgaaatcagcctggccaacatggcgaaaccccgtctctactaaaaatacaaaaaaattagccaggcgtggtggtagtggcgcacctgtaatcccagctactcgggaggctgaagctggagaattgcttgaacccaggaagcagaggttgccgtgggcagagatcgcgccattgcactccagcctgggcgacaggagagaaactccgtctcaaaaaaaaaaaaaattagggatcaagtttgcctcctacagttgtggctgtagaattaagagaaatacctgtgctgaagtttaacagccaagccccaaataatgataaaagcatttatttacctctatgacatttttatattattatttcaagtaatcatttaacagtctgctataaaaattgttcttttgtggtagccacataaatagtttaaatgagttaaatttatcagcatcattagatattaccacaggaagatttgttttgactgtgactcttctctctcctctccccctcacacctgtgtctgcacagtattcgcctgggaatttttctccgaagataccccatagcgcgagtttttgtaattatatatatggtaagtaaatttatttgaaaaaacaatgatgcacttgatttttaactagtttttttttttgtttgtttgtttgttttggctacagatcttattgatattttagcaatcaatcaatttttttttgttttttttgaaacagggtctggctcttttgctgaggctggagttcagtggtgcagtcttggctcactgcagcctctacctcccaggctcaagccatcctcccacctttgcctcccaagtagctgggactacaggcgtgcaccaccatgcccagctaatatttgtattttttgtagagacagggtttcaccatgttgcccaggatagtctcaaacttctgggctcgagtgatcctcccaccttggcctctcagagtgctgggatttcaggaatgcgccaacgcacccagccagcagacagtttggaaagagagaactcagttttagtaattaagatttcttttggtagagtataaattgacaattcattatgtctagaatataaattcctcaaaggcttttcctacaaataaaattaaacgcagtctaatagttacctccattttaaagcccttctaatgataaaaacaatttgaatacaaaacaattttttatcttgacgttgtaaagttgctttaattgttttcatgtgttttgctttattttctaaaagagcctcaagattgatttactttctcccagatttcttacctctagtaaaatggttacggtagtttgggatgccatttcgcatgtaccgtgtgcctaaaaaggctgctaactatttggagtgggtatgtctaaaagtagttgggttgaatgaaaatgggctgttttcttgaaaagaaatttctttaaaaagaaatttctctgtgatccactagagggaagagttattcctttaaatacaggttttgtgttgttttttttttctgagactgagtctcgctctgtcacccaggctggagtgcagtggcatgatcttggctcactgcattctccacctcccaggttcaagcgattctcctgcctcagcctgccgagtacctggggctacaggcgcacgccactgcacctagcgaatttttctgtgtttgggagatgggttttcactatgttggccaagctggtctcaaactcctgaccttgagtaatccgccctcttcggcctcccaaagtgctgggactacaggtgtgagccactgcacctggcataataacaagtttttaagaaggaaagcgtggggagtacaaaaaaaaattgaatggcatcagaaagcattcagaatatgccccagaggggttgatttcccaggtgttagtgatgatgagtaacacgggcactgtcatgagatggtgcccatgagatgtgatttctggcacacgacaaagtggtgaggcacttagtgatggaatctcgtatcatttcggtactaccatgagggaattaaatttgtcactatgaatcgtgttctgggccctacatcagcctctgaaacgacacattatttctgtctagaatattttcccatctcttcttcaccgaacattggttaaactctctttcagaataccaactataactgttctaaaagtgttttctaaccaacttcatgtgtatctagcagttttaatcactctgcattataatcaactgattattttgcatacacgtgcatattgtgaatgtgttgaagttcagagctgactcctctcaactgaattctgtaggagtagcaagtctttattaccttccattgcactgagctcatttagttgtttcattcattccttcatgtgtcccataggggatacagaggcaggtaagacacagtgcctgccctcagtgtacagtgggcctttggtaaaaattggtttattggctaatccacaaattgctttttctttctctaggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagtttttttttataattcagtctgcttttggattttcatatatttaactttgcaaaaagatttactttgtacatgttacaggcttgattggtgtaaatctttttataaatacataaataaaagaaaaatatgcatttttcttttctaaaataatggtttttcatccccattaaacaagacctttccagacggactttagtgagtagagccagacagaaagcagctgaagtcacttgtaagtaattcttagtgtttgccacttcttcccaatggatgctcctgtcttcccctttccagctccctgtgctgtcttccttggattcttactcactcattgccttccttttctccagcctatatgttgagttagctcgtgatatgcataacccctgcttgtagtgtttaggaatcaaacctgccttagcaacctatgcttttttaaggtactctagtgcagagatattattcgaaatgagacattttctttgaaaatgtccattgtattgtctcttttatattgggcccaatgtattatctgttttgactttcattttcatcttcatttttttttgttttttaaagaaacagggtcttactcttgtcaccaaggctggagttcagtggcacagtcgtagctagctgcagcctcgaacccttggactcaagtgatcctcctgccttagccttccgagtagctgggattacagacttgagctaccacacccagcgaagagcagttttaaattttgaggtgtccaatttgtcagtttttaaattttcttgttcatactttgtgttcctatcaaagaaacctttgcctaacccaaggttacaaagattttctcctatcatttcatctagaaattttatacttttaggctttccatttaagtttacgacccatgttgagttaatttttatatcaataaaccctccaacttgatttaaactttctcttttttttttaatttttagaaatggggtcttgctctgacacccaggctagagtgcaagggcaccatcatagcccactgcagccccaaactcctgggcttaggcagtcctcccacctcaggctcacaaggaactgtgactacaggcatgcaccaccacacctggctaatttttttttctttttttttttttgtagagacagggtctcactatgttacccagattggtctcaaactcctggcctcaagcagtcctcccacctcagccgcctaaggtgtgggaattacaggcataagccactgcacctggccctgcatgtctgaattattaagttgttctgtcacccggctactctcttcataggtaattaatatatgtggatcttgggctgtgcaagggtacagtccttcctgtcagggggaacatcttggaagcagtctgcttggtgcctcactgaacgtctgactgaagtttctactctttaaatgtgtctccatcatgactttaattgacatagaagccctataaattcttcagaagttctggtacactattagatgtgtatgtttcttatttttcattggaaaatgaagttttaaaggtcatcttaggtgtgtttgggcctttttttcccaacttggcatgggtgaaaaatgcagaaagttccccatcgtatgagagcagatgttgggattggaggtagaggcacatgacttaagtttgtctaggacttatggcacagtcttactctggtgtgatagcccatcactgtctaagctgttaagtcagggctgctctcaaacagaataaagtaacagtttagtcttgtgaatatattttattttatttttgagacagagtcccacactatccaggctggagtgcagtggtacgatcttggctcactgcaccttccacctcctgggttcaagcagttctcctgcctcagcctcctgagtagctgggattacaggcatgcgctaccacgctcagctaatttttgtatttttagtagagatggggtttcaccatgttgtccaggctggtctccaactcctagcctcaggtcatctgcccacctcggcctccaaaagtgctgggattacaggagtgagccaccacgcctggccttgttattatattttaaaggtttgattttttccccccctcttctaatttggaaatatttctggaaaatgattaaaaccaggttacaaacttcaaacagagaacagcccatgcttcatcatcaggtgttgccagactttccatctccatggacgtcctcctggcttttgttgagatgtctctaagtcctttgttcagtctttacacattcttggctttgaaaatagtttgacagtgtgcttccgggattgtttttctgcagttacttaaatatttaattgggtttcagtttcaggaaccttgactactaacaaactaggcagttttttaaagcgctaccattccttatcctcagatgacacaaaactttcttgacctaattaaaggggttgcatgagagcggagtttttttccttctcaaatcaatatatttatttaaagacattgtaaattgtatgcatatatttacacgtacatgttatcagagctcttatactgctttttatttataggtgtcaattggaaaataagattattctaaaatttccctttctctagactttgtgcttactgaaaaataccattttgggccaggtgtgctggctcacacttgtaatcctagcactttgggaggccgaggtgggaggattgcttgagctcaggaatttgaaaccagcctgggtaacatatttaaaaaaaaataaaaagaaaatgccatatttattgctgtggaacaaaaacttcaaagaaaaagcatggattttattaaaatatggtggaaataggctttccttgttagctctgtaaatgaggtaatagaatatctggtcagggcagttcagctttaccttaaaactaagacccatctcaccctgtggggcagggaggtggaagctacttaaatatgtcttgctggactccagctccctggtgcaagaggccagctgagtgttggaaaaggctggtatgtgtgtcttggtctggtaggaagtagaaggaaaggactagtaaagcctaaggggtagttaaggactaaagacctaagggacttcaggctctaattggccagaaaaaagaaatacctgagaagggtgtcttagtggctgttctgcacacattgagactgctaccgtattcctattctttcctgaatgagaagaacatgaattaaatgattctgaacttacatacttctttttttggtgggccagggacagagtcctgttctgtcgcccagtctggagtgcaggggcgcgatctcagctcaccacaacctctgcctcccgggttcaagcaattctccctgcctcagcctcctaagtagctgggattacaggtgtctgccaccatgcccggctaatttttgtatatttttagtagagatggggttttgccatattgtccaggctggtctcaaactcctgacctcaagtgatctgctctcctcggcttcccaaagtcctgggattacaggcatgagccaccgcgcccggccccaaacttccatacttctagtcggtgatctgctttccagacacaataaaaacacacaaacactcaaaataagtgaaactctttcataagcacacttgagcaacaaacatgatacataatggaaggcttatttagacaagatgtctcaaggaaaacagtgggtagtgaaataattttgttttaaaccactataagactgcaaagtaatttgaattatgaggaccctttgtgctggccactggaactggggatagagtggtcaacaacaaagtccctgcctctgcggagctttcactgaagtgggaaagacaagactacaaacatacacatcacgtcactcagcgttaagtgtatgaagaaaaatagaatggggtgaaggtatagagtaggttggagggtgaccagcaaagttgtctctgcagaagtggcagggcctgaatgaagtggtgggccatgggaaatacagggcgggatttctgtgcagtaggttcagcaagaagcccaaagcttctgagtgggcgcgtgcttagtgtgttcgagaactagactggcagggaggccagagtggctggaaggggacaagtggaggagaagaggagggtggagccaaccctgtagggacctgtatgccagcgttaggactttgtattaaaaatcgcttttttgtttctgcttggtaaccccctctgcccctgaaccactaccttctttaaacagagaaaacctttaaaaatctacatttgggcatctacagactacagttgttccacatgccaatgctgaatagtaagaattcattttgtggagaacaggctatacctgaggaggtactttgctatgtactaagaacaccaaatcagtgaatttgtagattccccaaaaacttttggtctccacattcacagtcaactcatctttattcaaatcagggacaaaccaaaagatgaaatcaagagtagagcccttcgtgtctgaaggcaaacatcttccatcctttgaccaaccctagtgtgactcactgcctggcatcaccgctcttgtgctgccagaactcataagctgaaatggcttcagacctttctgatcccctgagaggaatgacattacttttttagccactattgtattccccagtgcctagaacagtatctggcacgtaactggcctgcacttgatgttcattgaacctcattgaatcgagcaaagcactaagctcatgcacgagtctttaagcttcctagaccttcactcagcatctatcctatttatacagctcatctggtttctaaaaccatagcaaagaagagaaattgtaactggccaggtacgttgacaatagtgtggatttagatcgggcagcttggcagggcttcctccaaaacgggaaaagccataagaatttgaaagcaaaagatggcctgaagatattgctggccatagatgttcatagttgtgttagtctgttttgactgctataataaaagaacatagactggcttatcaacaacacaggtttacttctcacagttctggagactgggaagtccaagatgaaggcatcagcagatttggtgtctagcaagggtccttttcctcttagacagtcttcttactgtaaccttacatggcagaaggggtgaaggatctctctggggcctctcttttttgttgtttgtttttgtttttgttttgagacagtctcgctctgtcacccaggctggagtgcagtggcgcaatctcggctcactgcaacctccgcctcccaggttcacaccattctcctgtctggggcctcttttatgggcacttatcccattcgtaatccatcctcaggacctaatcacttccaaagacaccaccttcaaataaacttaactactagcaatttgctttaattcataaacatggcacaagtcacttgaatcaaagaattaaaacttaattaggactagaacacacattctcaacataggtgatgtcactcccaagggggttaaatttcctaggagggtaaagatatcttactgtttttatctataaagagcccagatatgcatgtggtatgtaacagtatatctgtggtattaggattgtatgtgtgggccgggcacagtggctcatgcctataatcccagtactttgggaagccaggataagcagattgcttgagttcaggagttcacaaccagcctgggaagcatggtgaaaccccatctctacaaaaaaaaaaaaaaaaaaatttaaagccggttgtggtggcatgcatctgtagtcccagctactcagtaggctgaggtgggaggtttacttgagcctgggaagttgaggctgtagtgagctgtgatcatgccactgcactccagcctggacagcagagcaaaatcctgtctcaaaaaaataaaaaagactgtattgggatagtaataatgaaaaaaagtattgagaaacactgggctagaatgataaggcagagacctatttcctgccctcatggagcctacattctaacaaatggaactgttttttaaatttttaaatcagaacatacatatttttggggtacagtgacaatttaacacattcatacaatttgtaaagattaaattagtgtcattgggatattcatcaccttatttgtctttatgctagaaatattctaaatattctagccattttaaaatgtaaaatagattattgtgaactatagtcaccctatggatttatcaaacagtgagtcttactccatcaactgtgtgtttgtatccattaattcgcctctcttcattccctcctccaaactacctttcctggtctctggtaactgccagtccactatcttctgagatccaattttttacctcccacatacgagtcagtacatgcaatatttgtctttctgtgcctggcttagtttactgaacataatgacctccagttccatccatgttgctacaaatgacaggatttcattctttttatggctgagtaatattccattgtgtgtatatgccacattttctttatccattcatccataaataggcacttaagttgattctatattttggccattgtgaagaggaaactggtttttaaagtcatgcatgacctggccctcactaccccatgactttccagccactccccacatctcattctaccctcatctctctgaccactatgctagtctattactgttctgattattcactgcctcttactgtgggaggattttacttcctgtcccactgatatcagccttggccacatgacctgacttgctttgactcaccagccaaatgttagtggtgaaatattagtggaacagttcccttcctcagcagaagctttaagagtcatctgtggctttgacacctaacttgttcctcctccatgagtttagcgtgtcccagataggggctgtccttcagcctaggccctggaatgaagcatgtccacagtggacatgtggctggaatgaaaagtaaatctttgcttttgtggattcctgaaattaggaggaatagctaacaatagctgactagtgtgtccaacagtgcactaaccaagttttctccctgcctccagaccttcccttcttggcttttgtcccctcctaatgtcagcatagatgccacttggtgaaatcagaactccatctttccctgcaaaaagaaaaaaaaatagtagcctaggtgttcgtaggcagaatgatgctcccccacaaagatgtgagtgcccttctttgccctcgtcactgaaacctgtaaatatgtcatcttacaaggcaaagggggtgttgtccatacggctaacgatcacaaaatatggagattatcctgaattaccccacagggatccttaaaagatggaaaaggaagcagaagaatcagagacgatgtgacaagggaagcagaggttgcagcaatgccattgttggctttgaaggtggaggaaggaaggggctctgagctgcagactgcaggaggcctctagaagctgaaaaagatgaggaaacagattctcccctaaagccttcacacgaaatgcagccctgcgacaccttgactttagcccagtgagacccactccagacttacgctctctagaactgcaagataataaattcgtgttgttttaagccactaagtttgtggtaatttgttacagcagctgtacaatatgggcgtggcatccctccctggtgaggagctcccacagcaccctcatcacagtccttgtgcttcacagggctgcctcttcactttccaccctgccagcaggactccaagcttgacatttcaactctatcacagttgtctcctcagagcccagaatagtgcaaggaacttagtaagtactcagtgcagatttgtcaaatgaacaattttcaaaaccaggactaaattagagctgaatgctactattttctgacttgatggcttaagtagctgtggtccttagaagccacttaccgtctctgaccctcaatttccttgttgttaaaaatggagaaaatgccaccatcacaaagaagtcccccacagggaaaaagagcattttctaagctgtaaagtgcattccaatttgagttttattggatggcatgtttataaagtcaaatgaagctgagatagtgaaaaacggccctgctagacaatcaaccatgtgtccagcagaatataaacaatactcagaacaagacattgacaaggccagtcttgggagcacaaaaattactaaacattcccttctactaataagcattgcccctttctgaacaactgctgctgctttgccaataacaactcaagcccccatgttaaccctcctagatagcaatgattgagatactcagtcacgaaattgctcctgcttctcgacaacatgcatcccagaactggcccccattacttattctccctcacaatgttccaaaacaagccaaaaccctttaagaaacccctgtcagctgggctcagcagctcacgcctataatcccagctctttgggaggcagagataggaggatcacttgagtcctggagttccagaccagcctaggcaatacagtgagaccatgtctctacaaaaaatttaaaaattagcctagtgtggtggtgcacacctatagtcttagctacttgggaggctgaggtgggaggatcacttgagctcaggagttcgagattacagtgacctatggccactgcactccaacctgggcaacagagggagaccctatctcttaagaaaaaaaaaaaaaagacccctatcatctcccgttactgagatattcttgggtacacagtctcccttgctgcagcaagtctaataaacctaattcctaattttggtagttttgttttgtttatttgactacaagtgtggtcttcagtcagctctgatagaagctcctcatattcagttctataattttacagacaagcagacagatccaaagacccatcaaggtcctccaattagcagtagaaatgagatcaagcatatgttttgtttgttttcacatagccacgggtttggcctatttggttactaaacatgtcagtgtatcaaatctgtctggcacagaatcttctatttctcatcttgactaggaccctccagtagcttttaggcagggagaaaacctgccatattttttcaaataatgcttagttctgggacaaagccagatacgttctaatgagagttaattgttctttatcagcgtgagaggaagcaggtgtgtgttccccgctgacatctgatttatttctttgagatcttggaacagacacttaatcagccacccaagcaggaaattgcttttctgcagaaggtaaacaagagggttttctttatttttggccataaaattggacccaaaaagcatttcaaatcacttggagtttttttttcttctgattatttgaattatattccttaattgtgggaaatacagaaaagaagaaaatattcacccatagacccaacactccagactaataagttgtcccatttggcctgtttccttccagtctttttttttttttttttttttttttccaattgtgaatgtgtatgtatgtaggaaggtctggaagtggagggagagcagcttttagttgaagccatactgaatatatgattttcattttcaattgcatttttaaattacataacacatgaatacatgcttactgcaaagatcccaaacaataccatatgcagagcagaaagttctagtgctcttcagcactgcaccttcttcccattttccagtgataactaccgttaaattaggaaaaacggggataaataccagggtacattacttagtactcacaagtactcagtaagtaagtgcttagcagtgggtaagggcaagtgtggcagttggtaagtggattcttcccatcccatcagtggtgaacagacccctacttgaactccagtagtctcctgcctcctggtcatgccttcatgtaattccctccttatgagtacacatgggacctgtgacttgcttctaaccaacagaatatggcaa

SEQ ID NO: 833 - DNA, 2823 bp, Homo sapiens
ggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacgaataatgcaggatcaaagtgaaggtaacagcctgcagaatcaagctctgcagactcttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggatctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttagtattcgcctgggaatttttctccgaagataccccatagcgcgagtttttgtaattatatatatggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagtttttttttataattcagtctgcttttggattttcatatatttaactttgcaaaaagatttactttgtacatgttacaggcttgattggtgtaaatctttttataaatacataaataaaagaaaaa

SEQ ID NO: 834 - protein, 731 aa, Homo sapiens
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKGKTPVFQSSQTSSVSSVNPSVTTIKTIEENSFGSQTHEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTLQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLRSELQDMEAQQVNEAESAREQLQDLHDQIAGQKASKQELETELERLKQEFHYIEEDLYRTKNTLQSRIKDRDEEIQKLRNQLTNKTLSNSSQSELENRLHQLTETLIQKQTMLESLSTEKNSLVFQLERLEQQMNSASGSSSNGSSINMSGIDNGEGTRLRNVPVLFNDTETNLAGMYGKVRKAASSIDQFSIRLGIFLRRYPIARVFVIIYMALLHLWVMIVLLTYTPEMHHDQPYGK

SEQ ID NO: 835 - DNA, 46604 bp, Mus musculus
  misc_feature (1)...(46604): n = A,T,C or G
gtgaaacagaggcaggaagattgcaaactcaaggccatcttcggctacagcacattcaaagccaaactggttaattgactaagactgtctccagataaaaatttaagcaggatttcaaaggaagacttgggatatagctagctcaatggaagactgctaacctagcaggtaagaggccttggatcccttcctagtaccaactcctcaacaacaacaacaacaacaacaacaacaacaacaaagtcatgttggtgaaagaatcaattcacaacttgatgtgggcggaagactgggtaatggagaggttactatgactccagagaccagctggggctggcaggggaaagatgtctcttttgataatgctggtgtcagctgttacaagttgcttgacaataggaccaacagtgatttcatggagcaaaagccttatgaattatatgggataaaaaaaaaaattactaaaaagtagcctggccattctccagatgactacacatggattttccaaatgactcaacaactccactgtagacacacatctgagggaactcaaaccatgcttccaggtgccgaggagatggctcagttagtaacatgcctgccaggcactttaaccatgctggatcctcatggatccgagtttacatcccagcactcacattaacaacctctgcccatttattcttagctctcagtaggctcttgcctcctgagattcaggttcaggttcctagcacccacatcatctatagcttcagttccaggggctccagagcccacttctgacctctgtgggcacttgcacacacacgcacacggtacacaaacaggcaaacatacataaacacaaataggaagacaatgtatacatccgtggctacaacctggatgagctctggcaacctcatgctaagtgaaagcagccacacagtgtatgattcatcgatatagtgtctgaataggaaatcatagagacagagagtagattaatgggtgcttaggtctcagggctgtgaagtcgggatacatgaggagtgattactagacctgacttgtagaattgaaaggggtgaattttataggtgtgaattacaaggcttacactaaagaaaaacaatttaccgctgaacaggagattcacagacagtatgcacccctgcacctctcctcccgtttacattctgttttcttggtacggcttcatttttccagaagttccttcggatggaccacagcaaaagatgtccaagtgattgagccatttattctccaatctggaccaaatttgaggagaggaggggaaacgctcggcaaattctgtggggtttctgcctcagggctgcagggaccggtggtgtggctctgtggagggctgtagctcaggtagctgcgtcggtggcccgtgcttcctgccaccttgcatttcaggcccagcacggtggtgttggcgtcttcccacagacggccactaggagagcatgggcccttggcttccctaaaccatctcatatccttaccagtagtctctctcttaaacttcctccatgaccctgtttgagtcagccatctgtttcctgtcaccgaacttcaaataaacaaccccagagacacttggaaaggaagagtgcagtcactcagtgacacagctatgtcgcctccaaaaagccatcgcaccaactctccttggtgtcagttacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttgtcctaacctcagacatggcgccccagtagcaagcacgcgcactttcccttttatcactgtaaccattctctctgttcctacttggagcacttagtgcaatatataactttcgctatggggagacatatttatttgatgctccttgttccgaatctgctgtactcccaaatactgaagagtcacgtgcttcaccacctctggaaaattctcagtcaaactctagtctctctctctccctcctgccttgcattcacttctggaatgttttctttctggtccaaaattctctttgtagctgtgtcttctcagttctctgactcctctgtaggacggagtagataaggctccatgaccgcattctttgttgctaaactttctgatttattcccttttcataacgcatgtctcttttttatagcaccttaagcttttgcttccttgatgggtgaactatcattttacattaatttcatttatttatttaattagagtggggtgggtgggcagtgttcattgtctgtataggtcacttttaggcattggttctctgctgtgggagtcctgggaactgtactcagactgtcaagcctactggcaagtgcttttacctaatgagccatcttgctaacccaggcaaaccattttaaaccgccttctatctaattgtaccactatttcttggtcccgtgggtttactctttgtttctgtgtttagtgattttgaattgtgaatgcatttgcgggggaggggatgattgccagtgagaatcttaggaagacttcaatgagattgaaagcctttcaagtagcgtttaaatttttttggttcccccccaccccctttttgagataggctcttgagtatctccagcaggccttgagctcatgtgatagtcaaaagatggccatgaacttctgatctttctgcctcaccatcgtgcctcctcttatgggctcttgaggactgaacctagggctctgcgcatgctatgcaatcattccatccacggagctttagcccgagccccgggggctttttctcatttctttgtactggtttgcctacacttactttaggccagtagcaaactgtcacattaatttacatcttggctattttgagtccacgcaaggcaaggcaaatttcaagctccaacacagctgtatcaaggctactggttactcattggatgctttttgtctcaactcagccaagaacatcagatgccttgcatcagctttctgccacggagaggcagatgggtgtagtctacctgtccttgaaactgtgtggttgtgggaccctggatcaactgcgtgcccctgtctcaggggagagcacagtgttccttttctggtcccttggtgggtaagcatcctgactcctggattctcaaaactactgactcttccctgggcctcggaagcatcagctttcgggggaatacacgggcctcagtcagcttgtggagagcaggggacaatttggggagataaccacatggagataaccaacctccccaaattgtgggccctggggatcaaactcagatactcagccttgacggcaggtgcttttacctgttgagccgtcagccactggccgtctttcctacttcaaaatgaactcagctagctctgatggatttaaaataattgcatgtttctcaaaatgtgaatttaaggtttccaaaagaatgtgcatgtcatatcttgtggttcctattctagcaagctccagtgtctccgtcaccgctattatgtctcaaggagctcagagggagcatacaagagccaagccctggaaacactgtcagcaaggaggggtcaggtcctacacagtctcatttctttatttgtagcagggatctaggctcctgagaacctcattcttaatatgcaggtgaggatcataatagttatcatgagagtactcaggtatgtccagatcaaaggatagctatgaaactataaccaacctatcacaggatcagaaatgtaattaaacactatgagggtcttggttgttcttttctttttctatatttctttcttttgttttctttcttgtcctggaactcactgtagacgaggctggcctggtacttggagatctgtctgcctctgcctctgcctaagggctggtatgtgtgtgtgtgtgtgtgtgtgtgtgatgtttttgtgttttgttttgtttttttgggttttttttttttgtagctgtattgtaaagctctcttgcatgaactttgtatataataacatcatattacaatgtccaaaggttgcacatagctaaagcaaagcactatgggagcagacatggtttggcacacaagaaatgctcatgaaacacgaaaagatatgaacagaattctcctcaccccactatagagtagacaaatgtcctggagatttagaatcctcagatagagcctcttttctttgcaaagtcccaggaaaatgtagattcttcccatagctctctgtaaacaccctacatactttactcctataaagagaacaagtgtatcagcttgcagatgatgaatgttttgagttgagaaaactaaaaaaatatttaaaaattggaaaatatgacactaatgtgctacattttagctactataaaatgatatgattaacggcttacatttctgcctatgtttggccctggggcagctgactccagaaataggcctctgcttaagcactcactggttgtaggtctgtggatgctctgatgttacttcagcctgccaccaatctatcaccctcttcagttagctttctgtctcactgacacattctggacctccaggttaaacacccacactagagccagagcatttcctaggcggccgtgcaccaaacacaagcaaaacagcgcttcgcgtgagtcatcccgtgagatattttgaactgatttttgctaattttgtttcaaaacaggtctgtttctaactcaaaccttttatatactggaaactccccagctctctaagccatttcgtggctgttggatcataaagatttctgcttataggtcagcagtataagcttgaacaaactgataagtgagtaacattgacactgtaatctttgtttttattcagtgtgtgtgtgtgtgtgtgtgtgtgagagagagagagagaaagagagagagagagagagaatgtccagtagttttctctctctctctttctctcactgtgttggacccaagaatcaaacttgggtcatcagcaagtgacctaacccacttgccagctgtcgtcttgccagctcaagaatccagtcctcagtgagtagccctgtgacaagtactggtcggtggtatcccattcagtgttcacccaacttgtctattatcttcatttgattctattctattttgaggttcattttcttcttcaaggtacgagctttctaaatagataaagctgtcctggaacacactatatagaccagactggcctcgaactcacagaaatctgcttgtccctgcctccctagtggtgggactaaaggcgtgcaccactgtgctggcctattatgttgattctgaagaagtggagacagagtcaccgcaggctggaaagacagagcagtaggcgaagtgctttgcaagcacaaggagccaagtttgatggtcacaacgcatgcgggtaagcgtcaggcttgtactgtaatggcagggaggcgcaggcaggtggatgtctggggcttactggtcagctagatgaatctacttagtgagtgcctggctaatgaaaagcctggtgtcaaaaacaaggtacgctctgtagctctgtagacaaggctggcctcatctcagagacccacctgcctctgccacctgagtgcggggattaaaggcctttaccgccaacgccaccacccggctatgtggggtaaggtcccagctcttaggtactatcttaaccagctcaccgaaacagcttgggatgcagagacccttcacaacagtcagggctctgtagtcttccttgagtctcactgccatctgggagaagtcaaagagagcaacatgaagcagcttaagcatcactcaagggcttttaaccatccccacctccgccaaggcatgaagcaaggaccagagtcgagtagccttgagggaccctaaggacgtgtaactggaacagccttaacacgattgctgcagcacttctgtacatctgaaattatgtcataaaggaaaacttaaaaggactgaggatggaaccccagcacagaaaggggtgcaggaagaatggatgagaatactatcagttgatccagagggatttctgtagaaattgaatgttaatagcaagatccagaaaaacgtgtttaattcagtcctgtttttgtgaaacaaacaaaatccaccccccccccttcttgtatatctttatgaggattgaatgaaatgttcatgggtaattaagaagaatgcagagcctagttcctgcttagtgtagagctaggctggtcaggtacaggaacctcctttcaaggtccttccaaatcaggttgcttcactttaccatatattagaatagcctgggaagtttgaaaacatcctaaggctcagtagcagcccagaccaattaaatacgattcctagcatcagagtccagtctggtgtagcttaaaagttcctcagtaacttctaatagacatcaaagttttcggaccagctgggacagacccttctggagggccagggtagaggagcaaggctgggaagcaaaacccacatgtgtagcaccgctgttaagcatcagccatagaggcccacactagtccttggaacagtcagtgagtggagaaagagctctggggaaacaggctggctccacagatcaaatagcccagtggccagaggtcaagaattagaaggggagtggacattttgagccatgtttactcttggacagagagtttgaaattcctcactttggttcctgggagtctgtctgtctctctctctcgtactttctctctttttaagtttttttggagacaggatttcaaacacacacacctacacaccaccaccaccacttccacctccacctccattaccaccaaagaacaatcaagaagcaagcacttgggctggtgagatggctcagcgggtaagagcactgactgctcttccaaaggtcccgagttcaaatcctagcaaccacatggtgcctcacaaccaccagtaatgagatctgacgccctcttctggtgtgtctgaagtctgctacagtgtacttatgtataataataaataaatcttaaaaaaaaaaaaaaagccaggcagtggtggtgcacgcctttaatcccagcacttgggaggcagaggcaggtggatttctgagttcgaggctagcctggtctacaaagtgagttccaggacagccagggctacacagagaaacccaaacaaaaaagaagcaagcactcagtgccagaggggaggaaaagttaggaagcagctggaatacagcagaatctagtgtaatgtaagtcagtctgaccccatcattttcatttctccaacacccctttacagagcagctagattccaatctaaaactgccaaaagccaggcgtggtggtgtagcaccacaattccagtgcccgggagccagaggcaggtgacttggcaagggttccgggcttgtgtggctttagactgaaaccctggctcaaaaatctcaaacacaaaacatgggggctagcatgtaattctcagttggtgcagtgtttgcctagcagagagaaagcaatgccctggatcccctccctcacccaaaactggatagtctcatggaggtgggcgtctgtaattctcgggggaagccttccacacagcccctttcaaagaacttagtgttggtcttaagagaggacaactaagtcagtactgaacccggttggagcttagggggaaaaggaaccaagaagtgggtaggggcagttgagggatattgtttggagtttggcagaaaggcaggtccaacttcttccaccaacaaaaacaaggaccttcaattagctgtagtgcataaagttgcagaatgcactctgcggtgaccacatgccaacactgcaggcttgcaataggtgatctgaagctagattgcacttgattcttggcctggcctacttttattgaggatttcctgagtgttgacttcccttgtatcaaataccacttgaagcattttcacttattagctcgtgcaatgcttaagacagctatcaggtaagtaccaccatcactcctggttaccaaggagaacactgtggcccagagggctcagataacttactcaaggccacagggttcatgggttgtaaaatggagcttgtaccagccagtcccgtgacttggatcattataataacagcgacattaacataaaaaaaaacaattccggagaacacagcacgtgtcaagtactaatatgggcaaggtgcaggtgaggtatttgcaactgaatctccttaagggccggaagcagcagggttgctgcacagaagtgacttacagaaggtttggcctctccagatgtcagggagagtgacctgaaggaaaatacaaacatcagtgttctgtgcagagttccctacattcttttgatcagtgttgaaagaatgacttactaaactgagttaattgggactacagcatttgacaggatccttttggtcaagctcgacacgggttccgttgactcttgcaaacggttcaattaggtgctttaagatcgtttacaagttgcccatttgatcccctaccagacaccggaagacgtcagaataagtgctcctggctacggagttaggcagagatgctagggacacatttatcaagcccacctcagtctttggtgccctttttaaaaacttctcaagggggttttctgtggctatggcaaccctggctggaaaaccatcagcattccagccatatgcagccaacgatctgtacagacagatgggcaagtgattaggaaccctgatgccctttgcgttcgctcagcctcagcagatcaatctagcgccctgcaactttctggaactcagcatcccaccgcaggatactcttcccagactctccctaatcttgtagctggctccctgcagccgtgactcgggcgttgcagtcctgacatcatcgaagaggcctcttctccagaggctgcagcagcgacagcagtaacagctttcccgcctcactggtcgctcaccaggtgcggggcgcagcgctcaacgtgccgaccttgcaggtccctcgaggggcggggccggaggtgcagcgcggcttccctgcacgctagctgccattgtgggcggctgggcgctcactcgccctctccactcagagaccctcgccgcacgaggcgctctgaacgtccgggagacgcacaccgggctcgcctaccctcccgccagctcctccttgcagcaggcgctctgcacgcctctcagccagcgcgcgctcccagccccgccctcgggcggctcacgcacgagccgcgggcgcgcgcctcccccgcgctcccgcgccagacggtcgcgagcgcgcgtgcgctcctcgcaacatccccgggagcaccgccagagcgagcgcggggccgggcgcacaggagtaaaaaggaggcggcggccgcgtctgcgagcaacagatccgggcgacgcgagctgacctcgtctgctgctgccctttttcgttctctctttctttattttggagtttcagaaaaaaattatatttggaagacatttttttttttttcgtaaatggcgctggccccgggtcagcgggcggttttctctgcaccaagatgggcttcgccttttccgtcgtgggcactcttggtggcttgattgtcagtcttctccgggcatttttgagaccaggagccgagcactgcacataggtgactcgccctccggagcggctgggcgtcttggattgggacttgggggggcagagtgcagtaaattgcgagcaccgcgtgctctctgcaaaaccggcggcgagccggaggtaggtcgctcccagggtgaaaccgctcccgggctgagcgagcccggccccgtgcgcagtgcagccgccccgagagcgtgtcctgtccccgccgcgccgggaaaatggaggctgtgatcgagaaggaatgcagcgcgcttggaggcctcttccagaccatcatcagcgacatgaaggtaggacgctgggggcgcggctgctctgacctcgccgcggggcttcccctccaccgcggccggcctggccctcgccggcgctgccggccacctgcgggagctctggcgacccgggtgtcaccttcttacccgccgcactgctccggctgtgctgggtcactgggcaggcgacttcccgggggctagtgggggagagtctgatgccacttaccaacccctgcattcataatcccagggggcgacaccatcttgttcctttgggggtttagggccctagttccaagttttccattgtctgtccctggactgagtgtctgcgacccgtggaggatggacgccctggaggacacctgactccctgggtttggggtggagtgcttggcgcggtggtggagcggtagtgggggcccctgcttggctgcaggaaagagtcttccggcctgggagattgggtggcagggttgttacaagcttggctttcaggtctacctggagtaggggaatctgagcaaattagttattaattagtctgttccagagctgctgatggtgttccttgcattccccataccctcccccggggcttggcgcagaagttcccagggaccccgagcctgagaggctcacaacaggaaggcaaggttgaggtttccaaaactactatacccagctctctcaaacacacatccacaccccactcttctctgggaaggattgtgtgtgcgtgtgagtgcgcgcgagtgtgttgggggcggggaacaaccctagccttttcctgcaaagggtgggactggagataacctgatcctcgattgtgggttttctggtgctcagaggtacaccgtgacttaggttacccaccctaataagatagaagcagttccaggagctgcctggaagtgggaattgggggcggtagtggggggcatttttttccagtgtatttagggagcttctctttggctcgaggccagccccagtctgcctcaacagatccggggaggtggtgtttaattaagcgctcggcttccaaaagagtgggcaggtttggaaagctgtgttggcgagtgggtgtggacagcccctcttcagccgctgcctggcgcctggggaagcttttgtctgatgaagtgtaaggtttggagaggccgtgggccttcgccatggactttggggaggaatgttcagctgtcatgcctgcctcctccttttagaaccaactgtcacctcatctagtgtgaactttgccaaggtgcctggttggtccccctcaggtccattttgcaagcctaccaagctcgtgccttttgtcagaaatccttgtagcctaatctgtagccagagcctgctcgcccaggaatgcctctaatccagtggtttggaattagatggattagtctcttcaaagacagcccctttcattcctttgccctcaatccacattgaattatcgaagtgttcttttgaacaaagattgatgcccctgcttggactctggtgtttattgttaacttaaatttcacccactttactagagtcaaaacaagatttggtttgaggcacacacactgtatgttgtgatgtgcagaggagttttttttttttttttttgaggaggtaatgatgtttccagtccctgaatagaaatgaggaatccagggatctaaaccgatccctgacttcagccccagagtaatcacacctggagttttctctacctttgatgatgatgacgactacgactatgactgttgttattttaatccaaaatcagggctcagttcttttcagtaggtggtttgaacccaaagcccttcagaaggtaatccttccccaaggatggggttgtgccaccttccacccaccagctggatgcctggtgtaggccctgcctagacatttgtaggtggaagacctcttacacaccgctctagtctctttctctttgagtttggtagatttttttccccacttgacagtagaatatttcagactggaggcacagcagaaaactacattgtgctttggattctgattttaggccctttgggggaagagagggatcggggagagagagcatgcaggttgtctgatttctaaggttgttttatgcgaaagggaactgctaaatatttacatggagttttcttccttagaagccttcttttatggagtggccagcgatgacacttcaaaagagaagtgacaagattaaattgggctttttaggacagacagcataggatatatggatatgtggcgttgtcggcaagaaagtcagtcattgtggtgacctccttgtccttcccatctttaaactcgtgaccagcttatcatatttttggttccctttctgtttgcttttagggagaagccatttggattgtcatcatggtaccatttttagggctttttttttttttttttttttttttaaagggatgttaaattggggtgagaaaaaggctaagaacttttttttttctgaatagcttttgagacttcataatgtacagcaacacaggaagggagtcagtttcctctttggagaaaaataaaaagataacaagagagtggaatagtttccacgcctgtgccatccatctttcttctgaggcaaagaccctcgagacacagcaaagccccggagaggtttctctgcttcctgcaaaggttctcggtgggactgagtcctgggctgtcagggcctgtgtttctttctctcagggctagggggaggaagaagttgtcactttgcctccatcaggatccagccccaaggaaagcaagcagcagctgctaaaaaacttattgattccttgaggagaagaaacctctgctccccctccctcccaccctgctgtggtggtggtcactaatgaaggacaatgtgcaaaatcactcactgcctgtcttccctgggatccacggaaatcacccttagggctgcctgctgtgagtaggtctctccccaaaaagtggggagggctgagctgttggtttatctggggggacagtggtctggaggtgactgttgactctcaaagaggtcttagaatcttttttattcctatccaagttctggatagaactggatcttagtaaggtaaacagattagtgttgtttgttttgaatcattagaccagaatttgaccatgtttccgtgctttctaagttccagagactttgctagctagacttaaagagtatctcgccccggggacagcggtctccttttaataattaacttattttaaaaaaagaagaagaagaagaaaaaaaagacgcttaaaatcaaatatttcctcgttcttgttgcacaagcaccaggctgccggggactgagttgggcctgctgcaggttgaactttgccctgggttcaggtttatgtaatatggctaagctaaaaaatacccaattgcacctgaacgagccgttccatgtgtcgctttccacaggggtgttctgttacaggcacctgtgtggagcagaatagcggccttgttcagttcctccagactgcccccacctctgcaggccaccagtatcctctgtctgaaggtctgtctaaaattagggctgctaaggggacatcttgaattccccaggaatcttgctgtgggtcagagaagcatggacatagctcccctcacctatcatgaggtgacaatataagtagcaggtctgacgccatgcagtgagtgactttatggctgccctggtcactgttgtgaggttcctttagtaagagggattcacttcctaggtctttattgaggcctcctatgtagaaggcgttttgttaggccctgtccttgctcctttctctgatacaatatggcagtaggcgaggaaagaaggaaggaaggaaggaaggaaggaaggaaggaagggcgggcatctgtcagtcttcttggacttctctttctgtagtgagataatgaagagccggccgagtgaccaggtacggggagggaaaggagcggttctgggtagaggctgacagctacacaaaggcagaacaagcatttctgtaatggacagatgggccccatgttggcttttctcttggcaaatggttgtgtttggccagggttttacagcttcctcatttggggccagcgggagaagaagacaaagtaaagatgtcataaagttggcagtaggagctgcctggaaagggccactcatgggagcactagggtctctcctagggaagtcagtccttttttgagagttcagggtgtgaatcttgtcttcctttggaaatagatcacttggtggcttcacttagctattctgtggggaaaggccttttatctctttcaaataaagttgtttagaacttgttgcttgatgtaccgaacctttatgctttgaaattccataattcataaaggtccagatacagggatgagaatttgcatggaaggtagactgagctcacctctggcctggctcagcactcaacctttctagaataatctatgttcatctctgtgctattttattatcagctgtgttggaccaccaaactctgctgtgatgtcaggaagtcagacccagcctctttagctatcatttgcaccatacataaacaggggacactttcaatacaggcgcggtatgtcttacataggccctgccttcctagtggctgactgcctgcctgtcctctgacctcttctatctcatcttgggctgtaaaggaaaaaaaaaaaaagaaaaaagccaaaatgatatagtcagtttgtccagctcactcgaggttgctaaaatgctcggtgggtgaaaaggttgaaactattgatccattagatgctttctcatctgtatctaagctgtttgcatctttgcaagggctggtgagagctggcagggttccttctgcgatgagaccatttagaggttcccattgggaaatggaaaaatgagatcattttcagttccccattacttcttggaatcgccttcaggacactttcccaccaatcccacacctctgcaaaaataaagaaattgcctttcctcagaccagaccagaagccatatgacaggttttgcatgtagccggtcagaatactgggaggccatatttggggccccttaactggaactggctggtgccttgagcagtttaattcattcaggtttgcagattgtactgctgatatggccttattaaatagcaaatgaagagacaaatagtaaattaattggcggagcgttcaggaagcgtattgtatttgattgcggaggctctcccttaaattagatgcagaatacaggtttcacgtgagtgtgctccagagacaaaacaggcccgaggccccagccagccctagtgcagagtctatcctgaggctgtgctccacacctctaagccctcctggaaggccttggggtgactcactctctacatcaacccagtgtggttagaagtggctgtttttttttttttgttttttttttttttaacccattgtgcaattatgaggtttggttgtatgagatgctctggtgtgccacctggtacgtagtcggagctcattattcattacttagggcacacagtaggtggatagggacttggagaaggacctactgtgtgccaggcttctactgtcaggcatgcatgattttatatcattcgtgtgtatgatgtggcaaatgagaaaacggaggcgcgggcggggagatgcagtaacgtgtcccaggccatggtgaggggaattggtgttcagaccatgtcctctttgtcccagagtgaaggtctttaagaaatcaaggtatggggaagggtgttaatgtattgcaagaagacagctcttcatctatctgagcccacgggagggtcatagaaggaactagggcccctgatctggaactgtgggcttgaatggagatgctgtgggtggaagtctcttagcagctgttgcctcttgggaacaatatttaatttaaggagtatgaagagatatggcttcccttttttccccatttatcagttaaatcaatagaaaagttttcagtgcccctttcatcctagttctgtaggtgtgagcggagtggagaagctttggggaccaggctcttatgggctctaccctcagcgcttctcctggttcaggtacagagctcatgcaatctcctcactgactgggcttgaatatggagtcaaggtgtctgaggctgcactctcataatcatatggatcaggcaggttcaaccaaagttcacatgactccgcagtgaactccttacctcaaactcattctgtgtccagcccaggaacacgcctgtaaaagagctttctgtgtttaattacgtcctgctagccctccggtttgggctgagttggtagagcccttgtccttgaaaacctgtctagatgggatacttagaaaaccaccttcctgtattaattcttggtgtacacggccttggtcttagtctataagaggcttcttttcctgtcttaagtgggcagaaaaacagtcgagtgccttttaagctatgtgcctttttacttgatttctttgcctcaaagaatggacaggaatggagacactggcttgcttagtgccagtagctcctgggagaggtggcagtgggcagtaatattgcttgggactcttttgctgccacctgctacatgacagagctctgtaggggccggggtagtgggtctgaccagagtagggggtctgggcatgtgtgccttttgggtggctgggcatggttacagaaaaggcccactgagtgccctgggagacgggaagcctgggcctgctcccaggagtctctgagtcagcgctttaggcagcatgttaggattttgaaggcactaggtcaccagggttgagcatcactgagccatcaggcctccccttacagacacacccctgtcacggtgccttcttgatctcacccaagcagaagaagaacccatttagacacttgcacaaggatgtgaataatctcagtatcacctaatttagtcttcaagatagccaaatggaatgttttgctatgtgcatctcaccacaataaaaattaaaataaaaatacagcaacatgctaagtaatcccagcaaaactcaacaatagcttacctagaattcttcagtttttactctgatgcacctttagccaagcattgtggtgctatcctgcaatcctggtatttgggaggtggaggtgggaagaccagaagttctgggtcattctcaactacatagagactttgtggtccgcccgggcggttatgagactttgtcttaaaatacaaaaacaaaccccatcaataaaagtgcatgacagtaacaaatgtatttttttagttgttggagtttaaatagccatgggtggctagtggccgcttcactgagcagcagagattttttttttccttttttttatttattaggtattttcctcgtttacatttccaatgctaccccaaaagtcgcccatacccaccctcccaatcccctacccaccgactccccctttttggctctggcattcccctgtactggggcatataaagtttgcaagtccaaagggcttctctttccagtgatggctgactaggccatcttttgatacatatgcagctagagtcaagagctccagggtactggttagttcatattgttgttccacctatagggatacagatccctttaactccttgggtactttctctagagcagtagagatcttaaacacactaagtattgtccctgccttacagtgcagcttcctgtccattcaattcaccttctaactcttgctggtcaggatgtgatgcttgtagatattctggaatcctgctgaccaggagcaccgggagctaaaggacaccctgccgctaagttcctcagtctccaggagtcccagttttgttttctgtagggtgggtgtaataacatacctgccttttaggttccgaaatgcagatttctttacctgtgaaagggttccctcttccctgtccaggagttagttaacgtagcctgtagactgggaagggacttaagatctgggtagttattatttctttgctgcttcaggcaagcactgtctctttttggagccgtattagagcctgtcttggagctactagaaatgaagttaaaaggtttttgtaaggaagccctgagagccctctggcccagtgtggtctatggggattccatttctttatttgcaaacctcaccaactgttcataagagggtgcactgggagaaaaagggccttcaaagctactgaggacaggggggaggggggagggaggagttgggttgctgagctatcttttgtgcccccttggttttctgggtgtcttggtggcttctggccctgcctctagtattgaggacatatggagccactgccccctcccaagacctggtcttcctgctgtctgctcaaagctgctcttctgtctgagcctggctggcagctaggtcctctatccctgggccccagctgttgggcctgtgtgtgcccacgggccacacagactccccatggctccctagtttcctcctccatcacctctgcccgttgaactcattctcatccagagaagggtcttcttgggccgtttctcctaggagggattctgtgaggccaggcttcctattctactgaatagttactcgtttgaaaaagtggctttcctgggtggtggtggtggtggtggtggtggtggacacctttaatcccagccctcaggttgcagaagcaggtggatctttgtgagtttgaggccagtctggtttacagagctgagttccaggagagatagctacacacagagaaaccctgtcacccccaaaaaacaaaacaaaactaaaaaccaataaaaatgtggttcttttcttcgaattttaaagcctgtctctgccattatttggactctttattctggaaaaattactttcctgagccttgatattttttttttcttttaatctacataatgaaaggtgaggggacaatattatcctcaagggttagaagagaaggtagatgtttcacaccaaatggcttgtttggcgtgaaacacatgccgaattaactctcttcatgtcggtccaagttccccggtctgtctcaagcatctgcagtctgcagtccaaatcctgaagcttttcctgggtatcagtatgatgacactgctccatttccagattcaggaaaggctatgcaaatccacgttaaactcctgacctttggaaccaagtctggcctcatctcaagcatgtatacacacacacacacacacacacacacacacacacgcacgcatatacacacacacacacacacacagacacacacagacacacacacagacacacagacacacacacacactcacgctttaaaatcagagttccttgctgacagtgacactcctgtttcagaaaagtccaagatcattcctgagtttgatactacaatctgtgtttgcttttcaactttcaatatagagataactttcaagaatgcagtatgtgtatgtattctgtagcctgattatgtgctgggggagggctctgggggggaacactggggcatcctgggtgggagagttggagctgtgaacaagcctgtcacaggcctcatcttgatggtctttacgagagtcaccagcaagacatcagtctttactgaagtcacactgccaggagtcaacacaagagtttgtggggttgttggggaggcagtgcctctaatttccacttggggtgggaggacagaaaagcagaaggcctttggtctgggtgatacccaactggcaattcagtctcattttacttgtgtaataaagtttctgtggttggaactaccaggcactaagtgttatttgatacttcaactcagctgtcattcccattctacagatgggaagcagaatggcaggagaggttcagccatttgcgtagcaggtgaggaggggttaagcccaggccgagtaaccctgtggtgacatccactccaggagtgtgctctgtaagccactctccgttgtctcccacagtgtggcatttcacattttccccctcaggcgctggggtggatgcatttcctctgtctgatggtttcaagtatgctggacgtatcacatgcagtatctagatttgcctctccggctgcttccaagaagccttgtggggtgtggtggtggctgagagtgtttgttgtgcaaacatgaggatcagagttcaaatccctaacatagaaaacactgagtatgtctgcgtcctcctgtaaccctggcactagaggaggcagagagagctggacaccccaaaatccacctctggcctgtccatgttcatgcctgtatgtacccacatgcatagcaccctacacccgcaagaaggggtagaatccaatagttggcctgagatttttgaacaatgagttgacccatctattggtgcctctagcttatcaacagagggatgtaagtggggagtggtagagtccagtgtggctgcttcaggcaggatacatgctctactcggggagcccactccagaccaggagacctgagtgccaaccaggagccggcagatccccgcagttaggggctggcagtggggtggattagtttccagggagaccacaattgcattctggagccaggctcctttgccgctgagcacgctgccattaaggaagtctttgagttgggtttaatggttgctctttgttttgaagtgactatttactgagccttcaaagccaacgccacagcaggatgtgatctgggacctgaataattgcatcagacaccccaataggaagcaggtactgaggagcctcaccagaagtcgcccagggccagcccctgagccccagctattgctgggaggactgagataggcactctgcaggcaggagacttgcagccccacggaacctggctccccggaacttggcctgtttgatggtgctggccttaattagggacaccctaattaagtcactgaggaggcaggccttttttttttttcctttaaaaaaaaaaagcaaatgttttgagaacatttcatgagggattacttctgaaagattatacaagttatataaaattaatggaagaaaacctagaaacttcaattaagtgaagttatccaaaagcaccaattacggagtgggctgtgcactcaagctcacaggagcccagacaattaaaggcctggggaacctcctttccatccaatcttccctttcccatgcgagggtttacataagctatgcaagtttctgtgccggccgtgtatgtgactttgtttgtatctatagtaaattctcctggggacacatttgaggacctactgtgtgcagggtccagcttgaagtgctggggatatagagcagcagcaaacaaaagtgacaattcctgcctttctggaacctactgtcttaacagagtagtgggtgacagataagggatggtcaagtgacagcaattcttaaacaaacacacaaaaacaacaaaagcaaaccaaccaacccaccccctttttatttttcattattatttattttatgtgtatgggtgttttacaaacctggtatcccaggagggcagaagagagcattggaccccacgggactggagttacagacagtggtgagcccctgtgtgggtgctggcaattgaaccttggccttctgcaagaggtgcttttaaccgatgcactatctctagccccatcctcccatatgctaaaaggaatccgtgcaacggcacaatcaaacctgtctctccccaagagtggtgagggggaatctccaggaaggggacactgcgtagcaacttaggatcagtggaagagtggtccagtctgtgcaaaggccctgaggtggagagcttgcgcctcttacctgtgttcgggctaggctggtgtttcactgttagaagcaatgctgcagtaaggacgtgggtttcttttttcaggtttatgttcttctgtgaaggatttatctgtggcctaaaggaatgcacttctcaaagcttctgggacccggtgctgactgtctcgcaaagcatgtctctgcttacattcctgtgtctaagtgctcatctttcagattagtttggaagaggctggacgtggacatgaatgccaagagattgctgagttcccagtttctaagggcttaggggtaggacataccatcttatctcgtgctgtggtcctccagtcttgctgtccagtcttgctagttctcagaaagccagagtgtcttcacttgcagattcctaggcccacccttaaattctttgttgatctggggtggggctcaggaatttgcccttttaacaaatgcttactaattctctctaggttttgcagggattgcagtaggggttcctgaaggggagctcaggctgacctgagccgccaggggcttgcctctgtagttcacaaagcaagaggttctcttgtgtgtgtgtgtgtgtgtgtctgtgtgtgtcacttcaccgtggatatatctggactatattccgggtggacatcttgtgtcatgctaactgtggctatggtaatatgcatgcctttctcctttctttccccctttggccaggaaaatgtctgcttcctcttggagagccaggtgagacatttggggaactcccaccccaaccgccctccagtctttccaacttggtggatgctcccatctgtgtcattggcaccagtggaccctcttatctctgcatggcgggcccctcactcagtacctgcacatagtagacactcatttaacgtgctgttccggaaggctgccattgtgtgctgactcacaaaaggagagctgagctctgtgtgctgctactcagcctttccagcacagtagcctgattatcatcctctgggggcaggaactggccattagcatcagttacagatggagacagagtggcaccaggtgatgaagtcacttgcctctaaggtcactcgctgaacagatctgaagttgggccagctgactctcggcaagctcacactcttgaccgttttgtctgttagggcgctctgctccggcatgaatgatagccagtggaagcgcaggcatgcagcaggcacatattgtaaaaggaagcatagtgcctttcgtggtccaccagggcatctttcctggcagcttgcggtaggagcttgggtgatgaatgaggtgtggtctttgccccaagtggaaaccgattcagcacagtatggctaggcccctggggtgggtttgatgaatttgtgaacctgtgcctgccttctggagggtttggcaaacagaaatggtagctagtgtagggagcaggatctcagaggttcaagtcatgttggagttggtggagacacgtcagagagggtccatggaggaatgaggtagagtggcgtgtgtgtgtgtgtgtgtgtgtgtgacattgtgggtccagacttctgactttatggggctcttgggttatggtgtgctttgctggtcatcttggggatattgatagacaggaactaatgaacagagtgacagctctggactctgcccttgagggttctctagggcaggcggtatcttgggggaggcttaactgcacaagcactttgcaggttaagagcagtgaaaacctgctttaggtgctaaactaatgacttctcatgtttcctgatgtggagagccagccaggtgacctgatgagctaatttccctgtctgtctcaggagccagcaaacctagcagcaattagtacaatcaaggggagggagtcagggcagacctctcacctagcatctcttactccttaagtatgcgcacggcacgggcctccctgggcttgctaggaagccttttgtgctccctttggtactgtctacagtgccaaccctgttgagcgctgttctaatgttgctcatgggtccttctggaccccttggtggctagctgacccctttgaaactttctcaggcagcataaggtgcctgggtggccactacctttcctctggtgggaagactgtctcaagtaataattgaaaagaaaatcagagtagtgaaaacctctgtgtgtgtgtgtgtgtgtgtgtgtctgtgtctgtgtctgtgtctgtgtgtgtgtgaactttggagaatggaaaaggagagggagaggagttttgtttgcagagaaagttggagtatggaaatacttcagtatatgctacaaagggtggaaaggatgggacccaccgtgctgggtgctgtcatcccagcatgcaagagatcaagctgggagcagcacagctgccacaggtagtcatgcaaacaagttctaggccagcctgggctgcatagcgcaatcccgtcgtctcaaaatgaaaacagatgaacaaaataaatcagatcctgaacgctctttgcagttgtgaagcaaggtacagatgcccaggtgtggccaaggctgcccgttgaaaagtttccacagtgagagccgttctagatctcccagtgctgttgacactgaagtctggccagtgggaccaagggacagatgattatgttttagttccttgtaatttaaatttaaataaccctcagtccctagtgttagtcttgttggatagctcatgatagatagataaaaagaaagaaaaggaattaaaaaccaaagcaaatttgaagatacagttgatgtatttgcttagttattttaattgttaagtggcgacacacccatatgttagaaaacaccctgagcaacgtgggtgagagggagcttggggcccttgatttaattagactggacaagcttgagagggagcattggtccctgagggggcggctggatggggaccaccttttgtgggtgtgccatctctttcacaggcagcttcattgctgctgtacttgggccagggtgtgagggtgggcggggaagagaagcaaccattgattatccccgggctgtcgtccctgatggacagggataattagtggatgaggcaagtcccaatcagaaaataaaagccccggactggtatttacgatggatgggttcagccagtgcctttcatctgaggctcttaggagactgcatcttgcaagctagggtgaggaagtttagtttgggagagaggctctggcgagcattcctgagccctggcgctaattatgcacacccacttctggaagctgaatgcattcctgaacccagagatgctcgtcttgggtcagaagggccagatccctctccgtgcttcttggctttttatctccctggaggcttacccacccaggaggacttgggaaggaagcatgaagctctgagtgatgaccagcctagagatctatccctgtgcccatggagaacccgaggacaaaataacatcacttgcattcgttcaagcgactgcaaccgggtgttcctgtgtggctcaggctttaaaggggttttctttgttttgtgctggcttttccatggctgtcctgaccgtttctagggtgacacacagttctccctggacctcagcattctcttcaggtgtcagtgtgggtccagagctgtgcctctgttctgcctggccttctgtaggacacacatccgaagcaggatctaatggctggctgagtcactcagatgctgtctttccctctggctgttcggactcctcagaaacggtcatctctgtagtcagatctggccccagatagtttttacctttctctgtgtttttgtgcctcggtttcctcgggtataaaccagtagcagcacaggcctcgctgcgggttttgaaagagaatggactcctcagggtgttcagcgtgcctgtcggcctcgctcaggacacatgccacctcccaggtcccccttcagagcaaggaaagcaaagtctgcacttttgcccgatctccagggtcgggtgcatcagttaatgcttgagaagtgtggatccagacagatgcttggtgcctagcaaccacttagaaagtgctgatgtgccaatgtcggctgtcactagtgatctcccccggaagaagccaggacccatcaggtcctacctgccttgcattgtcttagctgtgactgctagtgagccagtctctgtctggccccttctgggcagaacagaggcctttaagctggaacccagttacctacagcctgaccctgctaatcccgattttcttcaccattaaactctcctcctgagagtcctctctggttcccctggctcctcttctgttgtggttttctaaccacagtccccgccctcctgtgtcccttaagtggtgaggtgctatcgaattccctcagctgtcccttgatcactgtgactgtcacagtggggccagtgtgggagaagcagttggtacattatttattgagcacgggtagctagccttagtagactgaagggcttacacagtttgccctctgagggtgggaagccatcctttgtttaatgtagaacaaaatcaagggggaggccacaccaaaccagagtgacttctgtgtcctgcttctgaattgggtgacggcatgcacggcttgggacaagtggagggagagtagggagacaagaagagagggactctgactggaaaggtggaggtagacaaggcagtgtatgggttaactagtgcccatcaaattctctaaggggaaggagatctaggaaggtttttccctaaagaagaaagaagagagctttattctcttgtctttctttcccaaagggcacaggctgccccgccaggtatgtgacccatgagccaggtttgcagatcacctggccagcttggaattgatgtcacccgttatctgaacgagggtcaccttggctccctctgctgtcctgtttgtgtttcagctctggacgttgcctcagcgaccttgtccaccctggccagttttgcgcctattcagcaaaattgtagcacctcagtcagagttctctgtcccctgccagctgtgtccacagagtccttgccttgtagtgtagaagagagaccctggcttgtggctcagagatgattcacacgatgtactaagccgagggaatggacacagctaatccagaagggtgggtgaagaggtggtatgacggagaatgttctggaagaagcaccatttgtgccgggcagtgagtgaagtttgtaagattcttgagctccacagtccactctggagttctggagagaggacagcctttgggtagtgtttgtagagcatggtgggaacccccaaaagatgcctgcatgaagtcatgtgctcaggaaagacactgtctctcctgccccgtgtgttttgatgaataaatgttggttttcttcttttcttaagcagggagcttcctccttctctaactctggtgtaatctgagttcagggttcaaggcttccaaaagctccttccccatttccgaaggcctcaaggggctcctgggaaggagggtctcattttgcctgtgactttgggtgctgggtggagtcttgttttctttctttggttgtggtgtgtctgtaaagttctgaaacctacatgtgtttctctgatgagcgccagggtgagtgggcgtgggtgtgtccttcccacagctctgggagacattcctcagggggggttttccactgtgctcaggacacctgcaaaaacactcgaaacccaggatcatcttctgccactgcctggtgcaggcctggggtggcattgctttgcaaaggctctgagtgcatccagggtcttccgaagcctgcctacttccttagtcaatctcccagtagtaaacatccccatccccagggctttaaaaaattgcctttcaatctttctacccatacttctccctgcacacatcctccaagcctttggcttttgtagtaagactctttttaggtgggtagaaactatttcccggaaaaaaacattaaaaaaaaaaaaaggtacagcctgctatcactttgttttcaagtttgaataacatttacaccttttttttccatcttctaataatcaagtttctgttttatattcttagaatctttttgtaaagactccattaaattacagattgcctaaaatgggtggatttgacactctgatagatcctcgcatagcattagatcaggagacaggagaaaactgcttctgccagccttctcctggctgggtgggcgtttgtgggtaggaggctgtgtgccctatctcttgatgagaaaggggacactccttcccccctttcttttcttttctaatttgggaacaattgacgtgaggttccaggtaggtgcagattttttccccttctggaacccctggaattgaacctagggtgtcacacactgggtgtgctcctaagctgtatttccaccccagatgaggtgtttaagtggtttgagctattgcagttcccaggcacactgatctcggtttggggtaggcacctcattctctgtttaggataagcagacaaacctgctgacactgcagacactggagctgccttggtctgctctcccaaataaggttaatgcattgagccaccttttgcctcctaccttggctggttctgcaactgggaccaggaatgaggaatcccagcctgcactgctagctggtttgcagtgtgacctccagtgagcatggggtggaggactcggggaggggggagctttatcagagtctgcgaatgacagtatccttctccacaaacaggtccctgtctgtgtgccttgaccgaatcgagtccctttgggtgtgaccttatttatttatttgtacggcttgtctgagataccacgcacgaatcttataatgtgcccattgaaagcagataggccgttggcttgtagtatgttcttagagttgccacactgtttttgagcaccttcatcacctaagagagaaactccctcttagccataaatccctgtttccccccactccccactgcccctggcagccccttaactgccttgtagctctattttccctcctatctaattataatgaaatatccttgaccagccccacccacatccagttcctcccaccactggaccagatgttttaggttccacactggtaagggcatgtggggtttgtctttctgtgtttcctctaaagctacgttctgtagcttcatctgggctgtcgcagtaacagggtgaacagtggtccatggtgcagctgcatctcgtctgtgacccaccgacagttgatcgacacttgggttgatgcctgtgttagccaggagtgcagatgtcatctcctcagcactgctgtgacctcgtgtgttccccacatcaacctaggaattaacggtgtctccacatggacatccagtgactctaatgtctcgcagcaaatgggagaagtaataaggttctatccaggcagttcccaggattctcttctctcttcctctcccacggtctttcagtgataataagtggtgctactcctaagggtggtggaattgtcctataccccatcttaaccaaaggcagtggtgtgaccgaattgtcttaattattatcattatagggaaatgggcccccaaggggccagcgatttcccccagtaaatgactggcctggctctgcctagagcttaggtgatgggctcatgcctctggctaatcccgcatggtgtcacagagtaatgtagcctaggttgacttcgaaggcagtgtggccacggcaggcttagtactccttaactgttttccaggtactgggattataggcaaaaccaaccatacgtggcctggttcaacacatcccgttggcctgggtgggaaaggctttatacgatagatgacagtggcacctccagctagaggagggctggcacatatctcggtggcctcacttttctccaggagtttcttgtggatgagaaagagggtctggctagacagtaatgagtctctatctatcttcagtgtgcctggaaggtacatctgtctgactggacagatccctatcgaccttacaaaggtctttgagttaccgggaactctcgatatagggcagagtattcctctacaggtttgatagagaaatagtgaatacagagggggtcaaaataggtctttatggtgtcctgatgagactgcagtggaggctggaacaccctcaaggtagactggtcagccagtctgtctgtctgtctatctataatatgtcactctctctttctctccctctccttgccctctcttgcttgtttgagtgtgagtgtatacttgtgtgtgtacatgtgtgtttgtgtgtgtgtgttcgcgcacgtgtgtaggtataggtgggtcagaggacatcctaaggtatcgtcctcaggaatgctgtctgctttgttgcaaacaggatctcccattggttgggcactcactggttagactagactggctggccaacaagccctgcggatctgccagtggctgcctctttagtgctggtattccaagcacataccactatgccctgaatttttatgtgcattctgagggctctcactcaggtcctcctgcttgcttgctatctctccagtccccttggcctttgctttttttgttttgtgtttttgagacatcatcttttgtagttccgtctagccttgaacttgctaagtaaccaaggctggtctttaactccaggcgctgagattataattgtgtgctaccatgacgaggtcatttattatactgagttctgtggttgggttgaggataacccccagggctcaaacacagcagaagagctatgggtcaagagcagtgtctagatgctggttgtcatgactcagatgtagctgccaaagggcctctaccaagagccctggtgcagctcagctttccgtgggagcaaatggcagagaagagaccaagcgcgtcccagatgcaccattgcagaacggttgggcgggagctagcagcatatgcaaaccagactgcaaggctaggcctcctcggaaattcatggcgtaaccgtttccagaacctctaatttggtcttaaatttttttaatgtaatgactttattgttttcattaaagtgatacatgacccttataaaaacacaacaaaacaacattctgtagaggaaagtacaaagaaaaaaaagcaatatattggtccaaatcttagcttgcagaagcaacccattttaagaataagacagctttccatgtaacccctatgcacatttcagacagaatggatggctagagaaatatatacacaggtaatttttaacaaggtgttatctcttatgcatatacgtttcaaaataaaaatcttttccttttaagtattgggaagaactgactgaagaagtaacttggaacaagcagccagactcttttcttttaccagagaagtaggttttcaggtgtgtcttaagacagtggtgcttaaccagggatgatttggcctccgcaggatatctggcagtgtctagagataatttcattggtcataacaaggacttggtgacctctggcatctcggtggtaggtagaggccagagatgctggctgcttgctatcctgtgaggcacaaggcagcaccacagcagagatccacacagccagagcgctgacagtgccgaggcagagaggcagcagtgaggttaggaggaactggtccacggtggccatgaggaggtgatgacacagatgcgctcgactgcacttttagacagttgggacttgacatctgtgacgaaagatataatggttaatctaatgctccccctgccccgttctcctcttagctacaaaaacaagaggtggtataatactatttttaccttgtcaagatgcctaccatttgtatcttcttctgggactatgacacacacacacacacacacacacacacacacacacacacacacacacgttatgaatgaatggtttagtgacaaatagcatatccccacccatgttttacctctactgggtgtgtttagagtcacatcttggtggacgctgactcgtctcagtaaatatgtaatgtgtgctgagagggaggtggcaggcttcacactggcttgccctgctcagatcagaacctacccatctgtgtgtcagtgctatactcagcaggaggagacccgctgtgctctaggataaggagtgactatgcggtggggtcccttggagacgcacgattggacttcagggttcagtacagaggaaagattatccgtgctgattctgagcgcttctggaaggctagacctagagccctgtgaacaccagggacagacggcttgccttaggtggcccaggcttgggatgtgtcccttgctggagtgtgctgggaaaccacctgttgtcacagtgtacaaagatgccggggttaaacatcagctgggtggctatatttaggttattttcgagccttgggattctgataggctgatactacttctcgatagccacctgtcctaaggaggggtttcagtcatctggctccctccttgtgctctgtgtgacaaagttaggagagtagatggagccatgttgtatgcaccagtgaccaaggagagagccttgtatatcctgggatttggttggttttgttttgttttgtttcccccaagacaggatttctctgtttagccctggctggtttgaaatctgaagatgagactggtttcaaactcacagagatagatctgcctgtgcctgtctctcaagtgctaggataaaaggcgtgtaccaccactgccgggcatgttctatatttttaaaatttggacccatcatgttcatacaaaatgctgactccaaggtgtaggtgtttggctttgtggagctaggttcctgttggtgtctgtgtttatttgcaagattatagggacaggcacatctgaaacggttccagggctattgcctgtctctagtgtgtatatcacagaaccctacagaggaggatcacatctgcagattgttccttgcatggttggaattgggtgcttggctcatcacactgtgactgattgctggcttttgttctgtcctaggggagctatccagtttgggaagacttcataaacaaagccggaaagctacagtcccagctgcggtgagtagacgcgtgtattctacaggagaaggcgacatccttaggcaagacagagggaggtggatcggcacacacgtctggcttaaatttagaagtgtcacagacagagaagcgcgaagcaggcacctagagccgtatcaattcatagtctcccgtcccaccttcacaccccagtcccgtgtgaacccagactcaagtctgctctgcctcccaccgtaggaattcttagagttgattccatagagtagtaatgggcaatgtttgtatggcgcccactgggtgccaggcatatcagccctacaaggttaagtacaggcattttcctggtcaggaagcagaggcacagataacagcccgttcatagagaaaccattagtgacagaaaccgatgtaaacatgagaggtccggttccagaatccaagtttgttctcatctacctgtattgtctttccacatagagagtttagagccccagtgtagactgatatacggttccatttacatggagtgggtctcggcagtggtaggctgggccgcgcaatcctaggtttactagacaccacagagataggtgcttagacacttagaagtatgttttacggctcaaggttatacccggagaagctgctcaaacaaggggtgctgccggttgtctctaagaagcccgtatggcctagtgagcctgttccattaccgcatgctccgatggaccagatgatcacatgctgcagccccaccctttatgaagtcagtgtgggaagagatacggctgcgcttggtggctaacccgggaagcatgggacacccgagaacgactatctggataatcctcgatggcgaaatttgggggagtgactggctggtgttgagttggatgagagggcagagcagtggagcggggagtaggggtgttcttggaaaaagagccacctgggtgacagacagacaagggagggtgacttgtcgtttctaagcccgtgccagggcggaccagaggttgctgctcagagctcttgcctagaggtacgtggcccagcataaggggtacatggctcctcgaatgtagcaagaagaactgggcaagaacgcatggggttcctttagctttagctatggaggggtggtatttgcagccttttatatgacccccaagtagatattggcctggctatgtaccttctccagttaccgggtccttgacagtctccttgatttctgagctcattgggttatgtttgggtcttcttctgaagggctcaccagccttctgtcatggggctaccctggtctgctggccatttctcatccgctgtgcctattgcacgtaggttaacatccctctggtaggaaggaggtctccccctgaactaaagcatttacctttctgcttccttttcttgtccagcctctgattgtgtgatgggctttcagtgtgggcctggagaaagattattctcctggcctttagctggcgagagtagtgggacctgaattgctgagctcactgccggtcttgaacatagaaagtaaaagtcaaggtagactttgaagtacctgcttcccctccctccatctaggtcttctgagatcagggcacatttctttatcattttatcaagtgagggtttaattttgtgtcctggagaaaggctgcggttaccaccgcagacgcagcacatctgtctatcttggagtgtttaagctgaatcatctcactagctcttggtggttccctatttgctgtgagctcaagtaaagggccaagatgtcctttgtgctgccagaaagtgcagtgtgacagtcatgaagagctcctaagtcctcaaaattgaccagtgtcttaattggctgtagaagtctactccagtgactgtaatgggcaaggcttgtccacggctggcccataaaatagggttgattggcattgaattgaatgagagtaaataaatcaagccagcttgtcaggtattcatcataagtcagaatgagctatttataagtctcaggatgtttgatagaggtaactttttcaatgtttgcagttgatgtcaacactttaaaaatatgcatgaaatgtgtgcatgtgtgcatgtgtgtgtgtgtgtgtgtgtgtgtgagtgagtgagtgagtgagagagagagggagggagggagggagggaggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtagagactggagacatgtaataaacacttgaagactatatcagtcttcgaatttggtttgaagtccttgcctggtaggggacttttgttggtttgtcatggttgggatcctggtcattcctcagttcgtgatgttgtaggtcatcgagtgcctagtgcgtccatctggttgtgcttacgggcatgggtaaggattaaggagattgccaaggcaggagctagccttagttctccccagtgttgcttttaggacttgagaagatgcctctgaaagagcatcctgtgcctgaacaaagcagaacccagggttttagtcttgtatggttgaagatttagggagcaaggctgtacctagctagcaccctgtgtctgcagtgggttgagctgggccttgagtcacagtggcaggtcatcagtcactctggtatgaaccagtgatctctaaaatgtcttttgacttgtggcctcagttttcctttttttttttttttttggcagtgaaatgttgatctttctgctctccaagatttggttccctgccagttcacgtgcacataaattactttcctactctcaagcagatgtcacctgtgctgtctatactttaatgatactttcttctttggggtagaaacccctcccttttatttctttgcttaaagtttcacttggtagcttccacagccaggcctcctttggggttgagtgctagggagagaacgctatctcctgctagctctcgtccctggagggttctgcttgctgcggatcggaggctttagcccaagagctgagatgaatttgccagggagacattcctcacgcttttgttatctgtttgcatttcaggacaacagtagtagcagcagctgccttcttggacgcctttcagaaagtggctgacatggccaccaacacacgtggtgagcagatgggaggctgccttccagcactgactggatccagcacgtgggctctctctctcccccgggcggcttcccgagaagatacggctcgagttatcagagcctggctgactcacagttttcatatatttttaactccgtggggttgcacacattagaagttgtaactagttccccagatagtgaagtgtgtgtgaagactagacaagaaaggaagggagccactgttccttcatgaggcggcttgctgtgggtgtaactcgagggatacgcttagtatagagcctcgagctgcacctttgtcttgctgtgactcctccagcaggttgccttaggctctcccatggtacctcctgggaacggggaagtcctggagatgatgatgtggctactgtcctgggttctccacaaacaagggaatccttttatgataggcccagtatctcgagggccgtaactgtctctctgtccccagtcttaggctgcagaccctgtgaacaagagacagagtcctgatgataccccactagacagagtgtccagagcctaactgatatttaaaatatgcttatgaaagcagtgaccagaaggtgaaatcttttgaaaagatttcatggtttcagagaatcccaggaatattcgtgacatgtgagaggtgccagaagaaagtggatagtgtaggcccaccttcctctcagtcccatacaaccactctgtctgcctgctccttgtctggtcatgctgggctccctcgttacctgcatagctgtgaacctgctctaactttgggtgtttagtgcaaagctgaggctccttcccatacctccagtggttcatcacaaccggcggtgggcacttaattaaatatttatagattgagactccagctccttttgttgcaggactgtcacgggaccacaagagccaatatgcctcccccttgtccccaaaaggcacaccgttgagtagggagactgagatgtgtaaataaagagtgcctgtgcagaaatagtatgtgtggtaaggtaatagccgaagctcacagcaccaggggaatatcggaaagtgagcaattaacctggtgccagggaatcagggacattttcccaggggaagtaccatttctcctcctttctgagacgccaaccgcatcccaaaaacattcccatggaaatacgaccgtgacgtcaagcatcagacttccttaacctggtttgtctgtgtggtgaaggtactaactaacccatgtaattttgaaatgcctttaaaatgacttagcttagatgtacctgttgtagaaccttggggaacctggattctaaaggagcttaacatgcaaaccgatgtttgctgttgtgaaaatgtgactgactgtccatccgtgtggtgtctctccttcccccctcagccgtgtctggaactgtcagtcatacatgcgttatctactttgtgcaagtgccgtggtgtgtgtggaggccagaagccagcttgcaggagttggttctcttgtttctaacgagtgggtcccatctttggcagcagccgaaattacctgctgagccttctcttttttgagacagtcttaagtagccaagactgagtgcctttgaaggcatctgaggatggccttgaacttccggtcttcctgcttctgcctcctgggtgctgggatgaccactgtgagcctcctgcccagcgtgggattacattctcaaggatctagaattcagagcatgtttttagactttcctgttaaattactgggtgggtcctgaaggggcagcaggaagggtgaccccgattgtctataatttcctgtgggaagaacctgtggttttgaagaggctgctcccagagtccctcttgggggggcggggaggggattggagggcctggaaattctcatgcttccaggggaggggaaacggcaactgttggaagagaagcaggaagaggctctcagtggaggtaatgggtcagagccaggcttgggggctggggaggtggggatgtccgctgctgtcggcctgtgtgtcactgtgaacagactcctgtgtgatgtatctttaagacatttggtttcaggttgtttttgcagtacagtttagaatccaaagtgtggttgctttcttttattggatgtgggaacctgtatgccttaaagaatatatggctgatacgagctgtttccatggtgatggtatgagaaacttggaagtactccttattccaacaatttaatttagtaaaaaaaaaaaaattgtactctttacaaaaaaaaaaaaaatctaaaaactgcatttagccttgcccctcttagagattaggtttaatgtcctttgtaatcatttttgtcaccctcagtgtgtatgtgattctgcatacgcctcctcagatggccactcctgggaaacgttgaagccccttggcttctgctccacactacggtaccgataccgttcgtcgccgtcgcctgtagatgcgcctcgctgtgtctagtagacaaatggacttccagtgcctggatagagcgagttctaattattattctgtgactggatttgtatcttccctaggtatttgccattacaggctgtggtgcgggcaatgcttgtacatctatgaatgtctggtgtgtgtgtgtgtgtgttgctctcatcttatttttgttatgtgcttagtacgtatgtacatatttatgtataccggtatgcctgtggctatgcctcatacgaaggtcagaggtcgatatcaggtgtcttcctcccacactgatctcatcatttcagcctgtctttctggctggtgactctctagggtccgcctgtctttgcctgtgtcccagttccagccttagaggtgcctgccaccacactccggcttgtatggttgctgggatccaaactcagctcctcatggttgggcggcagtgctggctctccagacgagtgacctatcttagtggtctgtgtgtcaccacggacaggatgagtgtgtagaaggctgttcacgtgtgagcttaagggggctcagagccgtttactgtgctgaaagagtatctcccaggctggctcttttgctcggagactttagatgtagtgtttaaacatctctctagttagaagttggtaaaagagagttaccactgccccctcccttcctgttttcctctgccctcccttcccctccaccctcttctcccccaacccatgtctttctcttcctcctttgtctcttctttagttttttgagatacaatctatgccatctactgccaccatactatgaggtagcacagcagagtgtcacatctctgtctaactatcttagtaccattcgcctttccccatcagccttccttccccagcccccccccccccgtaaccaccattctatgtccaatttctccctccctccctccctccctcctttaagatttatttatttattttatatatatnnnnnnnnnnnnnnnnnnnntggttgctgggaattgaacttgggacatctggaagagcaatagtgctcttaactgctgagccatctctccagccctgagttcagggccattgaatatctgtaccatatttcccccctttggctgacagtgtctgtttcttgaccgctgagaactgtactgctataaatagctacagatgtgtcttccacatgcaatttccttccctttaaatattactcagggggccttgctagatcatatgctagctctatttttaatatttgaggaacctctgtggtcctccaagtgactgtactaatttatgtttctatatacacagggaagagttcctttctatgcatctctgtcagtgttgctttttgtcttttcctcttctcttctcttcttctcttcttctcttcttctcttcttctctcttctctcttctctcttctctcttctctcttctctcttctctcttctctcttctctcttctctcttctctcttctcttctctcctcttctcttctttgggtatgtagccttgcctgtcttggaactttcaactgtagtgcagccattccattgagctgagccctgacgtctccttgtcctgcgttgctttctcttggagcctctctgcacgcatctcacacacctgcaccgtttgcggacactaactgtagaagcacatctctattgggctagtattcagaatgccaagataattttaactaggtttctggttccagaatattcacatttttgtgttatttctcaaaggaaagagctctgaaaggtttgttgtcattctcatgaggtgttttagcatgagttattaacaaaatttatgaaaatcttccacaagtagttactatgtggataaaaatcaattttcataatatgcttaccttgtttacaatattgaaatctggactccattttgatactgattttctaaataaaatcatataacttgattaatctcatgtatatattatttatataatatatacatatataatgtgtatcatgaaatgatggaatttgagtttattggcaataggcacaattctatgtgcttagtttatactctggaattaacatcttatttatgtaaactctgaacatgctgtctttcttcagattcactggccacaacaaaattagttggtaggtcttaactgtctttgatttttgtggctgtctcaggagtatgcgtttgtcagggtcagttacttacagaccgaggaaagaaaagtaaggcaagcaaatggaaggcttctcagtaagtatgctgcggcagacggccgtatgtgctggggagagcacctgcacacctgggagtgctgtctgatccaggcgcccgctgtgtgcagcctctcaggactgctcctcacaacactgtctgcttaggtcagcaagggcctttgaagagcacagtgctgagtgacttggttttgcatgtttttgcgtgccactgtaaataggtttacatctttgaaaacccatcctgggaatgtgcagatgatgatgtgccaggaccactcaaaggagctcaaggttttcaggaggagagaaatgggctccaggcagagtagaacatgtctaaaagtgagcatggctttaatagtgaaagtcatgattgctaatgtcctttgcgtcctgtgagctggactctgttttgagtgttttagagttgtctcttctttgttattggtgatccttcccatgacccacattggatgcctggtgtgtatactttctcacatacacacacacacacacacacacacacacacacgataagctttattgtataaatcaggcacaatgagattaacaacatctaataatgagatcagttacaatacgacaataagagctacttgaaacttaggaattgtttatttctataattttacattcaatgtttttggattatggttgattggttaacgggtagagctgggtaagagggcccagggtcttcttaaagcaccatgtgatgaaaatctcaagggacagactcaaaacaggtcgtgtctggacactgatgcaggtcacgtggccagtgaactggagcccctcccctaacctggaccgggaccagtaagttaggatcccttatgtaaggagcttctggccttagcatgtgcttatatttggttttaaagtgacttcaacccaacggcattaaaaaccccagttcatgcaaaaaaaccttggtatggagctgagatgtctaggtttgacttttggctgtttaactgtgtaaccccaagttttaatttcctcacggtaaaaagaactggggtgtgtgtgtgtgtgtggggttcccgagataagaccagcaaaccttccttcgttcactcattttccatggtattaaacactgcgtaagtcttgttacatcaactgcatatgaggttgggtggggtaaatccctttcctaatttgtcttcaggacttctgcttttattccagagacaacagaagagaggaagcggccttaatcagatgaagacagagggcgggagcaagaaacctgggtgccggagatgggcatttgggcaggattgagttgtgggactccccctgcagttggagttgtgtgtggtggggcaggtggagctgggaccaagtgcatgggggggggcggggggtgctttcaccagtgacttaggactccaaggccggtgaggaaatctgtctggcttaggttccgttaagcgaccttgctgctttagaaggtgtctgtgacctcagtggacggtgcacacctttagggtgtgtttgttaaatgccacgggtctgcactttctgggcatgatgttgtccctgaagatatgtgtgctcagtcaggttcagccttgagggctgtggtggacaatcgggtgggactctgcaatctgtttaaaagcttcctggctatgccatctgcctataacccacccatggcgtctccacccacacagagaagctccctagagcgttaggacatctggtccctctgttcgtgcatctcccagccttcacggggcctctgtatgtgctcaggatctccctgagttgtttgagtcccacgacctctgaatctgtcatgcttagggcctcaagggcacatgctgctgttggcgccttccaatcaccgttgtccctacagaccgtgaaagctccagccgacaaccacctgtgttgtccacctttatggggagccctgagacccaaatgatcatttatgagcttctgacactgttgtacagatgagtgactctacacaagagctcccccaccccctccactcaagggccttggtgggtcctggcaaggatgctggagtcttgggcatgggagcctgctgggttggacaactggacagagtgcacttgagagttcagaatttgaatgttggtgacccctctcttagggttccagtgtgtcttcatatttcactgtagcaggaagttccctgcccccatgaggaggtcatggtccaggggaggtggccacctgcacttggctggttgggggaagggagggactcttcctttgctgccagatggtgctaggaaacttccgagttccagccaggctgctcttgtttaccccagagttttactttaaccagtttgtttgagattctagtagcctttaacttctggatgactgtagcattccactctagaactttcttgtttgtaattagagccatgtgatgactgtgtacaaagcactttagcttcaaactggagggggaaaaaaagttaaaaaagaaaaaagtcctttttgcaggctcagcactgaacattaaaaaaaaattcttgaaatactactttaaaggaatgtgttcatattcattcataaaacacaaaaggtttaaaactgccttcagctaacctgtagctaaacctgtggccactgtgggaagctggccttgggccatttcttcattggttattttcaggcacaggggagaactctggagtatttgagagacaggttcaatgctaatttctccttaggaggcaaacttagccagtcaacagactcatggctagcacgtttttcttgcagtcttcatgtgtctgtttcttgcacatcgtaggtgtctaggggacggtcgttgatttgcagaaacatttaagacgtcgtgcgctgcacagtttgctcacagaaggatgggcctgcttagtgctcaggtctctattggaagggatgaggagggtgtgtgtgtgtgtgtgtgtgtgtgtcggtatgtgtgtgtcggggtgtgtgtgtgtgtgtcggggtgtgtgtcggggtgtgtgtgtgtgttggtgtgttggggtgtgtgtgtgttggtgtgtgtgtgtcggtgggtgggtgtgtaggaacactaggttaagatgctttggaagacactatcgagtttggttttgctgtcttaaacttgaccacttagttatggttcacttgagttacacatgtgggtgtaaggcggaagaacaaagctattaaaaaaaataagaattttctcgcaatatttactgaaagaggaaacgagctgggcaaagtcaaaacgggtttgtgttatttatttatttttttctctctcatgttctttttgttttgtttgttttaaattgaagtatgacttggtgggtccatgatgtcattatagtagctgacataaggatactggcctcttagtctagggaggcttgtctgtgcaggagaatttctttgatggtaggaatactctgtgtgtgtgtgagaaagagagagagagagaatgagaatgaatgagaatgaatatattcaatatggtagtcactgaatatggtaggcaacatgtctgagaactaattttttttcctgtcttttgatttcaagacagggttcctctgtatagccctgactgtcctggaactccaggatggccttaaactcagagagctcagcctgcctctgtctcttgagtgctaggattgaagacatgtaccaccatgtctggatgcataattgaatttttaacttaaatttttttagtgaaggctggcaagaaggctcagtgggtaagggtgctaactactaagactgacgtcctgagttcagttcctgtaattcacgtggtagaaggagagaacttctggccacgggctgttcactggcttcaacatttgtgcccatgcctgcaccccgcccttaaaccaaccaacaaaccaacaaataaatgtgataccaaaatgaagtgagctttaaacagccttgtgagctctcggctcccatcatgcagtggaggttgtgaaggtgcctgtgcctgcaggagatggctcctttagttttctggtatgtgtcaggagccgtctaatatatcttagtagatatattcagaggttaccgtgtggctcaggctgtcagatgctaaagtcagttctagcctttgcttcccagccattcagtgggttagatgtgggcaagcatatgtgagcagtgaggggaccagggagagagaatcatgtaaacactgtaccccaactctctgtctttctggtcctctctttagctctctgactttatgaaacaatggtctaacctcagctatctaagaactatggagaacgtcttgcttctgcttcctaaatgctgggattacaggcacacaccaccatatctgactctgcaccccctccctgctttggagacagggtttctcagtgtagacctggttgtcctggaattcactctgtagaccaggctgtttgaatctctctcaaactcagattcatctgcttctgcctcctgagtgctgggattaaaggcgtgtgcctggctttccccacttttaaagtatgtccattgctgtgttgaaggatactgtttcattttgttaaaatacaggctaagcatctgtcactgctttgtgaatctgaaatccaaaatgccctccaacctttttgagtgaatatgataccacagtaggaaatttcacattacaaaaattcctttcgtgttcaagacaattaaaaataaagttaccttgagaccatgtattgattgtatatgagacaaacggatattgtgtttagatggggggtctcacctaggcttggagaagaaaaatcagcaaccccaaattcttgcggctctaagcattcctgtccctgtgaccggggaaggatgtacagtgctgagagtgctgtttagggaagaagtggcccagctgcctccagatgcagtaagggaggccggcttcttggcaggtgagccttggcctgccgtctagtccaggcacaggaggattctgtgacccagaggacggtggtttctgaaagatgactgatctagaatacggaggctggcagtgcgcatccgtgatactgagttctgtaaaaatgccctgcagtcacctttggtacctggatgagaagtaggcacgccatcgcatctgtatgtattggccattcctaactaccgctgagtcacagggacatgaagactaacttcagtgctccatcatagcaaacaaacacccttttgtcgattggactttc

SEQ ID NO: 836 - DNA, 208 bp, Mus musculus
atggaggctgtgatcgagaaggaatgcagcgcgcttggaggcctcttccagaccatcatcagcgacatgaaggggagctatccagtttgggaagacttcataaacaaagccggaaagctacagtcccagctgcggacaacagtagtagcagcagctgccttcttggacgcctttcagaaagtggctgacatggccaccaacacacgtg

SEQ ID NO: 837 - protein, 70 aa, Mus musculus
  VARIANT (1)...(70): Xaa = Any Amino Acid
MEAVIEKECSALGGLFQTIISDMKGSYPVWEDFINKAGKLQSQLRTTVVAAAAFLDAFQKVADMATNTRX

SEQ ID NO: 838 - DNA, 48933 bp, Homo sapiens
taattgactacaatacgattttgtttgcctgagtgtcttaatgctagaaacatctaaacaatggtttattccaaaatgaatgttaaaatctttaaaatcatgctatttgaagactcaataaacaatctgctgtgattacaaagctaggaaatggagagatttaacacaccaccaatgactatttggggacctcacagcagccaagttttttttttttttttttttttgagacagagtcttgctctgtcgcccaggctggagtacagtggcacgatcttggctcactgcaagctgcaagctccgcctcccaggttcataccattctcctacctcagcctcctgagtagcagggactataggcacccgccaccacactgggctaattttttgtatttttagtagagatagggtttcactgtgttagccaggatggtcttgatctcctgacctcatgatccgcctgcctcggcctcccaaagtgctgggattacaggcgtgagccaccatgcccagtcacagcagccaaatctttttatgtggatggatggtgtcaactgttacaaacagatggacaatgactctaccagttagttcatactgtaaaaaaccttatgaattaatgactacaccagttatttcatgctgtaaaaaaccttatgaattataagaaataaaaaactacttatgggaaaacactctggaagttcctcaaaaggatacacatagattttccacataacccagcaattccactataggtatatatccaagagaattgaaaacatacccacacagaaactcacccaagggttcatagcatctttatcagtaacagccaagaagtagaaacaactcaaatatccatcaactgacgaataaacaagatgtgatataaccatacaatgaaatattattcagccataaaaaaaaagtatcgatccacactactgcatggataaaccttgagaccagtatgctaagtgaaacgaaccagataaaaaatgccacatattgtatgattcatttatatgaaatgtccagaataggcaaatccatagagacagagtagattagtggttatgtagggttagggaaaagggaggttgtggggaaatggagagtgactgctaataggtagggggctggtttgaggggtgataaaagtgttctaaaattgattgtggtgatatttgcacaactgtgaatatattaaaaatcactgaattttgcactttaaaagggtgcattttatggtatgtgaattatatctcaataaagctggtttaattaaaacgacatagccagtctttttttaaccctagcgctcatgcctgtaatcctagcactttgggaggcaggcagattaaatgtctcctggctcagaagcctaaattcacccctgtgaccacaagccaagtcttccttagtgaaaatctaaagagagaatctaacagtttcttgtcaagaagaatccccctgcccctctgttcccctgccaccccccactactgccattgttctcttgggcattcagtaactgctgcaggctcagttaagttgagctcagtagttcaagaccagcctgggcaaatggcaaaaccacatctctacaaaaaatacaaaaactagctgtgcatggtggtgcacgcctgtagtcccagctactcaggaggctgaggtgggaggctgtcttgggcctgagccgagatcgtgccactgcactccagcctgggtgacagagctagatcttgtctcaaaaaaataaaaaaacaaaaagacatttactactgagcagtcgacgttcatgctgaatattttccattgctcccctgagccccaattcactctccaacctcccctgcttcgctttgtcagaaagctgttctgtatggactgtaccaacaggcacctttgtacaagtgatcaacccatttattgtccaaactgtggtacttttgagaaagagcgatgggagcaaaccaggactctgtggacaaatgtctgttggagtttgattcttgccgtccaggttggttgcagggcccttcagagggccacagctcttgccacactcagccccctccacgcagctggctctctgggttccagcttaccccctcttcttgccctctcctggcaggggtggtgatggcttctcaccattgctggaccccagagctgcaccatccatggtgttccctacaccctgcccatgtccgtgcaaatagtctctttcttaaacttccttcttacccagtttgagtgggccatctgtttcctgcctgtaccctatagacacaaaactccagaaaagcagcatgaaagataaatttgaaaggaagggtgtggtcggcacagtgatcctgctagatatcttccaaagggccgttgcgccgactctcctgtttctgcagatttctgttacgccaaatcctgcaaataaatgattttactacaccccccagcaacaaggatgttacaacaaatacaattttctttttttttattataaggagttttctttgacactctgaaagaaataagtatatacggcaaattacaatttgcagtatgataattcagtatgaaaaaaaatcaattcatttggcttatcttgttcagaacttgctgtgctccctaaaactgaggattgatgcatttcacctctacaaaattctcaggcaatatctcttggactatctgttccccttccccattttctcttgaactagcaatatgctgtattctcatgtcctccatgtctcctaacctcttttgtctattttctattaatatttctttatttctgggcttccttctgaactttctgatttaaaaaattcccttttcagctccatgtctattcagttctctaacttgtccatatatagttcaaatatacatggtaattccagtgactgtaattttcgtttctaggctttctttgattcctttttcacgatgcttttctcttttcatagtgtcagtttttgtgtccttcttttatatttgaattattttaaatttgcttacctctatcagattgatggattagcttcagttcttgtgggttcagccctgctgggagtttgctgattcttgagtgtgatgagtgcactgtggccttgtattgatcagttctttatagttttgaatcctaagctcattccaggaggctttctgcaggaatcttgtgaggacttgattgagggtggatcccctcagagccatttctcatttgcttctgggttacccaggattattttagaccagtaacaatttttcacagtaattttcattttaagtattttggatccatttaagatatggcaaactgaaacccccaaatgcagctgtggtgcaggcctctgtcacaaatttttcactgaatgcttttcacttctacccagatcccagactaagactgccaggctgctgtgtcggccacctgtcctggtgggcagattgtttctcgtccacttgcccttgaagtgcagcagttatggggtgtccagctctgtcggtggctctcagtggcacatccctgacttgcatgggactagggactctttctctggtcctccttgggggtgaacacgcaggccaagcccttggattattgaaaccaaggactcctcctggggcaattaaagcatcagctgtcatacattcttttttgtgtgtgtttttttgtttgtttgtttttgaggctgagtctcactctgttgcctaggctggagtgcagtggcgtgatctctgctcatggcaacctctgcctcctgagttcaagcaattctcctgcctcagcctccccagtagctgggattacagctgcccaccacctcgcccggctaatttttgtatttttagtaaagatgaggtttcaccatgttggccagactgttctcaaactcgtgacctcaagtgatccaaccatctcggcctcccaaagtgctgggattacaggcatgagccaccatgcccggccacacctggaactttcaataaggcctgggatgaggctggtgaaggaagggattttgagcacgaaaatgacaaaaaatcagacctacccctttaaattagattcttgtcccatatttgagcatctttctgacattcccctcctttcaaaacatcaagcactcactgggcagacatcaagatcctgttaacatgcaactcctttcatgactatttgttgttatattttttatttttatttttttgagatggagtctcactctgttgcccaggctgaagtgcagtggtatgatcttggctcactgcaacctctgcctcctgggttcaagcaattctctgcctcggcctcctgagtagctgggattacaggcatccgccaccatgctcagctaatttttgtattttcagtagagatggggtttcaccacattagccaggctggtctcgaactcctgacctcgttacccacccgcctcggcttcccaaagtgctgggattacaggtgtgagccaccgtgccaggcttgttattgtttttaatagctcctatgaggaggaacccaaaggaaagaatctctattagacaaatttcaacccctgtggtcttggagaagagagattgagagtcagtgaagtcttcccaaaacaactcccctccccgcttcctgccaaactgcccagtggatgatggggttagaatgtgcactgccttcttgtagttctgtgacctctggcaggctatctgatctctggagccagcctctatttccttgggagttcctacctcactggctattcctaggattaaagtggatgtcaaaggcctatcacatagtaggggctacacacatgagttcccttgttcctcaggagtgattctcaactctggctgctcaaaggaccttgcctcgtcctcaaattggctgtacattggaatccccttgggaattttaaaacatccatacctgggctccattcccagtgaatctgatttaattgtcctgggctgtcatctggccatcaggctgtttcagagcttcccaggtgattcaaatgtgtggcaacattaagaacactgatctaggaaactttgaaagaaagtacccaggaccaggttctactcctaaacaattcaagaagaacctctggcagaggttggctatggaatttttaaaaatgtatcatgcatgttttattccattatcacataaagacatacagatgcacgtgcatatgtgaatgggtgtgtgtggatggattttgttagtgtttgttttacagaagcaggatcacataacacatacttttctggatcttactatgaagacaataatttctgcagaaatccctccaggtcaatgaatattattctaattcattcttttttcttttaattttttattttgacataatttcagacttatagaaatgttgcaagaatagtacaaagatatctcatttccccttcattagatttcccaaatgttaccccattatggtatttgcttcaagcttgggttttgttttttttttgtttgttttgttttgttttttaattgagacaagttctcgttctgtcatccaggctggagtgcaatggtgtgaacacatctcactgcagacttgacatcctgcactcaagcgatcctctcacctcagcctcctgagtagctgggactgtaggcacatgccatcacagctgtctaattttttgtacagatgcggtcccactatgttgcccaggctggtcttgagctcctaggctcaggtgatcctcccacctcagcttcccaaagtgcttggattatacatgtgagccaccgtgcctagccaagcttaggtatgttttaaaagctcctcaggtgagtctaatgcacagccacgttgctctgtggggcctcccagttagccatgagacttaaggcagtgtttgtgaaacttctgaccttcgagaggggtctttgcattagaggcagttatctgaagtggttaagacagtgggctcgaagtcatgctgctatgtttgaattctagctcttttgcttcctccctcctgacccaccttctgtgcctcagtttcttcatctgtaaaataaggataatcgaagtgctaactcctaaggctttgtgaggattgagtgagattacttaagatagtacttggcacacagtaagtatacactaaaggttagttatttgtatatttatcattaccatagctcatctatgaaacaaaattggcttaagctcgccctggtcacctataaacagaattctttctgatcgagtcattaaattctttagacaaattcgggagttatcagcatataaaagttcccatttagaaacaggccccttttgaaaatgaaattagcgaggatcaattaaaaatatctgtcacattgactcaccctaagagatgttttgtatgtgttttgtggatggcaggctgaaaaatgccgaaatataaccctaatgtccagaatgtgtcactggggcaggaaaccaatgaaaggtgatgaactgattagtagcaaggctgaaggggggtggcggggagcgtaaagagcaagttctccccccacggaccagctgtcccccaggcctaggccaggtgggaatgtgagccctgaattgccacatgttcctatcttcctggaagtgctgaaactttgttccttgaggtgaagtttcccaacttctaaatatttttagatttcccaattttttattttttttttttttagattttccaattttaaaaactcctctgcaggccagtttgtagcttccaatcatgggagtcaaatagcggggttggaagatccgaaaggggaaagaagtcataatattttgtatttctccaggactgtttgaggaagagaggctgtatctgatggttctaggtcgccaagacatcgtgtctgctctctagtggggtaggaacctggttgggttccattcctgagacatttcttgagcacctgctttgtaccaaaccacgcctgtcctcccaggagcatccaatctcctttgctttgtttatgtgctcccaagctgcctgctgactactaatttgacttctgcagtgccttgatatggagaactgggctctcaggggaacagatatccctgctgcaagttataaaccaagactgtccaggacctgatctccctctcattaacagtatttctggggcttagctctttctgtaccatataagcatgatgagaaaaatatatattttataagtaagataagggtctggtcagagtagcaataaaagagcatgaaaaagatattagtttagaaaaccttaagtttacataccatatgaagcaattcagaaatatatctggttatttcgaatccatcagaggcatctgagtttacctaaaagtgtaaaatattatacattacacaaaacccaacatttcatcatgtaaacaacaaaaacgggacaccctattgtcgcagaggcagattctataacctgaaacccctcctgccatagccacgtagacacagttggtaaaatgtaatcagaatctctttaaatatatgcagagccagtctaaaagaagggaagtccccaacagccagaaacaaaggagaatctgaaaacaaggaaagaatgtatgacagctggccaggcacaatggctcacgcctgtaatcccagtactttgggaggccgaggcgggtagatcatctgaggtcaggagttcgagaccagcctgaccaacatggaggctgaggcaggagaatcgcttgaacctgagaggtggaggttgcagtgagccgagatcgcgctactgctctccagcctgggtgacagagtgaggccctgtctcaaaaaaaaaaaaaaaaaaaaaaaattgccaggtgtcactcccactttcctgcatctgggaacacttttccagcctccctttcaaggagttctcatgagagacaagggcctggtggtcaggcccagggaaaaaggccacaagagaggtatgctttggcaaacattgctaaagttggggtatttggggcattgaaatttaagcatgtggcaggaaagctagaccaagtgtccactgggctaaggccccttatcccaggagttcaggaggctgggtaaaagagagacctggggcatggaagtcagaaaaccagggttggattccttccaacagtgcaacaaggaccagaatgataatttccttcaagtagacataatacgtataaaatgcccagaatgcacacagtagaccctcagcaatgtgcctgggacagcacaccaatgttacagaagtgaaatggggccagggctggacctgagccttggcctcatccctgcttcttctgttgataagatttatcgaatgattacttatgagatgccaggtaccacttgaagtgctttcatcgatcagctcatgtaatgttcagaacagccctatcaggtagaagccatcattatccccatttacagatggatgaggaaactgaggcccagaaaggttaagtaacatacccaaaggcatacagttagtaggttgtgaactggagtttgaatccaggcaatctggctctacaagcagtcatcttgatagttagaataccaatagtattaaaatcacaataatgattggcagcaaacgatgtgtcaagcacccgttattggcaaggtgaagatgagtcggatgcattcgaacgcccttggggacaggatccagcaggggtgatcaagagatcagttacttcctgaaggtaacacccttccgggtgatttcggggagacggatggggaaggtgggttgcagttaagagttgggcagagtgatccaggggaacattatcttctgcagctgtgctgtgtaactccatgcatccctttgatccataaagttttcaaagccagaccttttcccattacggagtgaatctgacacaagtgtacagaattttgcacttggtttcttttggccccactccccccagtcttttcttttgttatgttttgtgcttcaaatggttagctcaagggttaaaggaactgtccggagttaggtgcctatgtcttaatatcttttaaaagttgctcatttgattctcctccctctggcccatttggcgttcatctgaatgagggctcctggttatgcagataggcagtggagctgtgaaaatggaccactaggccccaaatcaacctgggcacatttgcgctctgcaggttcaacctcccaggagggctccctgcggttataccaacgctggctgctctcagtgggcctgaaaaccatcaaccgtccaagtcataggcaatcagcaatctcgatagactgatggatcgtggacagaagctctaacgctgtttccattcatttagcaacagcaaatcaatccactttcccagcatcctgcaactttatcgaactcggcatcccattgcaggatacgcccccgaactctccttaattatatatttcgctatttgcaatcaggactcggcgatgcagtcctgacatcagagaatgggcgtcttctcagaaggccgcagtagcggcagcagctttcccgccctactgagcgctcactacaagcgggctctgggctaggcgcgccacccgtgcaagtccccggggagcggcggtgcaccctccgtcccgcgcgctcgcagccattgtagggtgggcgctcgccaggcagggtgccgacacgccctctccgcgctgcgacgggcggccgggggaggagagggtgcgctgtgcgcaccggagggagaggctccggcccagtgccgcctgcccgccagcagaccagcaggctcctctttgcggcgggtgccccacgcgcctctcgggcgcgcgctcccagccccgcccgcgtgcggcggccgcacggccgcgagagcgcgcctccgcttggcgggcacggccgcgagcgcgcgtgcgcccctccgaacgtccccgggagcccagccagagcgagcgccggggccgggcgcgcaggagtgaaaaggaggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggtaggacgccgggggtgcggctgcggcgccggccgccgcgctctgacctcgccgccgcgcttcgcctccaccccgggccgggcacccggcccttccctgcagtgtggccaccggccacctgcgggagctcccggccggagtgtcacctgctcacccggggcgctgctccgggctctgcggggtcactgggcgggtggcttctctggggggtgtctgctgtcccacgccatctcccccgctcattgtcccagggggcggcaccatttctttccctcgggggctcaaggcactggctgcaagttttcccattgtctgtccctgaagtaagtgtctgggacccgcgggggctggatgcccgggaggacacctgattcccccgggcacggggtgggggcgcctggcgcggtggtggggaggaagtgggggctctgcccgctcgcaggaaggagtcccctagcctaggagactgagagggaaagccagtccctccttggctgtcaggtctacttggagtggggtatctgagcaaattagttattaattgggccgttccgaagctggtaaaggtgtgcgtgccctctcttagccctcccgcggggcgcggggccgaagttcccgggcagccttgcaggggccccgccttctcccagctgagcctaaaggcaagattggggcccccgaaataactgtatcctgccctcccagacccaaacggacacacactctaggttttctcttggaagggttgtgaagatggtgtgtgtgtgcgcgcgtgcatgtgtgtgtgcgcgcgcgcgcgtgggggcggggaacaacaccctggttttttcctgcaaagggtgggactggggataacctgatcctcggatgtggattttctggtgcctagagatagaccagggccccgtgttattcatccagaggaaataaaaccagccgcgcgagctggctggaggtgggaattgggagcggtgggggaaattatttttttaatgtgtatttagggagcttctctttggctctggcccagccccagtttgcctcaacagatccagatccggggaggtggtgtttaattaaaagctcgcttccaaaacgagtgggcaggtttggaaagctgtgcaccgagtgggtgtggacagcccctcttcagccgctgcctgggcgcctggaggagcttttgtctgatgaagtgtaaggtttagagaggcttcgtgcctcggagatggtctttgggaaggaatgctcagctgtcatggcctgcttccacctttcagaaccaactgccacctcacccagggtgaactttatcaagctgcctctgtcctggttttgtccattttgaaatctttctacagctctcgtgccttttgtcacaaattgtccttagcatagcataatctgcagccagactctgcttgcccaggaatgcttatagtccaggcacttggaattagatggattattccctgttgaaagacagcccctttcattctgttgcccccagtgcacactgacggatctgtccactgtagtcctggagtgatcacatctggagttttttctctttgttctttaatccagaatccaggctcggttcttcccattcactgtttgaatcgaaagccgttcagaaggtgacctgcccaaagggtgggctgtcctgctttccacctgccatcctgtggctgcgtggcactatgccctggctggggactcacgggtgccaaggtggtgttttttcccctgcatggttccagttaaaaataaagacattttctttaatgcccagtcacggcggaatctagagtttgtgtatcctgacttctttcggtttgagtttagtaggtttgttcagtatcctatgggaaatcatttattttaaagttttttttttttggtttgtttgttttggcagtaaaattttaaaagcaaggtggaatggaagactaaaacatgccttgggttctgcagagttttagacttttggagactcgagagatgaagagagagggaatgtctgatttccaagattgtttatgcataagacaattcttgaatattttcttggactttgcttcttaaaagacttcatcatggattagatgacagtgacattttaaatggaaattaaaaatttttaaatttgaacagatctgataagcagtatatagtgtgcagatgcatgaagtcaccagcaacaaaagtcagtttttaatatctgaaatcaactgactttctaatgacctgcttatcctcttgttctcttctttaaactcccataatgggtttataatgcctttggtctcctatctgtttgctctgagggaaaagcgtaaatgtcggaaacccatttggaatgccatcttgataaaaatttttaggttattttctcagaagtgatgttaggctgggtgagaaaaggataaggaaaatggttttattagtagcatttgattcttcaaaatgtacagcagcacaggaagggagtcaatttcctctttggagaaaaaaagaaaacaataaaaaaagggaataatttcaaggcctggcaccctccatcttctgaaaccagagaacctcaagacatggaaaagcaagagagagaggattctttgtgctttcctctaaagatgcttcatctaagtcctcggctggctgtcagggcatgggttttatccttttcaggcagtaaggtgtggaagaaatcctgactttttctccactggggaacagcaccatgtaaagcaagcagcagctagtaaacaacatatcgattccttgacgagaggaagcctggtggtttgtttcccgtttattctaccctgctgtggtggtggtcgctaatgaacggtgttgtgcaaaatcacctactggctgcctttcctcccatccatgcaaattagtaaatcgctgatcaaattggctggtgtgagttggttccagaggaaaggggagacaagatattcacgtggctggagggaagggcccatagctggtttgtctggggaacagtagtctggaagtgatgttgactgccttccgatgtgtagacgatcttgactgcatcaaggaggtcctggaatctttttggagtttctatccaagctctgggaagggagggctccatgtctcaaacagcagctttgtgcctttgcttttgagtcattgaaccggcatcgattttggtgatgtctggggagttcttaagaccaggagactttgctggccaaaattgaggacagctcactctgcggatgtctttcttcttttaataattaacttgggttaaaaaaacaaagttggatgtctgaaatcaaatattttcttcacccttgttgctcaagaatcagcatgtcgagagctgaactgggcctgctgcggggagaactttgtacgaggttaggagtatagaatgtgactggcgcaagacaaccccaaccacacctggttcctccaccccatgtgtcactttagacaggggtgtcctgttaccagcacctgtgctgagcagaatagaggccttgttcagttcctccccaccgccccccacctgtgtttgccatcactatcctctttcctaagttctgcctaaaattagaactgctaaagggacttcttgaattccatggaaatctttttgtggttcgaagccatgtcgtgatattttccctcccatatcataggatggagaatgtgggtagtgggtccaacactggatagtgatttcaggattttttttttacccctcactgctttgttttggggttcccatcagaagagagatacacttccttgctgtttatggagggcaattgtgtagaaggccttttgctaggctctgcccttggagagctccttgtcctgtgggctgtaaacaggtaatatgaatccaatatggtggtcatgaaggaagggctgtggttcagcctagagaagagcatcagtctctgcaggagttcccttggaggcctcaaaaaaagagttttctccaggacagcactgaaaacccaaccaaggcctcagccaggtgctctgagggaggtgggctgctccctataaacggtgacagccaccaaaggcaggacaagcagagcacttgtaaaggacacatgggccccatgttggcttttctcttagcaaatggttgtatttggccagggttttacagcttcctcgttttgggcccatgggagaagaaggtgaagtaaagatgtcataaaatcgacagcaggaactgcctgggatgggtgcccagagatttaggacctcttctatgtagagtcatctttttggttttttgggtgccaattttgttgtttggaaatcgtttctatactggtttgagtgtttctttgtgaaaacccctccctatttagtttttgtgaaaaccctttactatttagtcaaattttttggaacttctagcttgatgctgtgaacctttatgttctgaaattccgcagtttgtaatgctccaaatcaagagaagtcattcctaggtcctggtttgcatagaaggtaagctgagtttggattttgcctggttcagccattgcccagttcttactagagtaacatatactcattccgtagtatttattgagcatcagtggtgtttcaggcaccaaacgtggcataatgatttcagcaagtaaaaacgtagggtttcccattaaatttgcatttcagatatactaaaaaattgttcactatttaagtttgttccctgtgtgctatgtgttctcagttgctgacctcttgccctttgaactcttcttttgcacctcagccacagggaaaaggaaaaaagctaaaatgatgtctgtcaatttggctagcttacttaaggctgttaaaatgcttggagggtgaaaaggttgaaactattgattcattagatgctttatctccaatttgcatctcggctttttccatcttcacgggcatgggtggcgatagctggcaagattccttctgtagtgagaccatttagatgttcgaattgggtatggacaaatgaggtcactttgagttccccattacttctcggaactgccttcaggacacttaccccaaaaacccacacctctgcaaaaacaaagaaatacctcactccagaccaaacaaaagccagaggacagatttagctgcctaggatgtcagacaagaaatttgggggccatttaaagggaactaactgatgctgtgagccgtttaactcagatttggagatagcactgctgatatggccttattaagtagcaaacaggagaggaaaatgaaattgaggagtaaattaattggctgagcattaaggaagcccattgtcacgattgctgaggttctcccttgaattagcagtagactgcaggtttcatctgagtatgagccaccaaggcaaatcagaaacaaccgaacaaccaaaaacttaaaagtagcaattcccagtgcagaatccactccagagcagtccccgtctcaacacctggaagtcctaggcttggggctctctcatctcgcctgcttcccgatttgtttggaggtgacagtgtttttacctactgagcaaatgggaggatttgggttgtttaagattctctgggggctggacaagggcccttgtaagtctgtgtttgaagaagtggatgggctcaccaacaaaactccttcctgtgctgcctcttggcgtatctggccttggtcataggttctaagttgtttttcttttcctgtctaatgtaagtgggtgaaaaaaaaaaatcaattgagttgagtgccttttgaactgtgtgtctttttatttgcttgctttctctcaaagcagtagaaagtttcagctcactcagcaccagcagcttcctgggcatggaggtgggcagcaggttttgcctgggtcccctctgctgcctactatgcgacaggggctccaagggccgtgggaatgggtctcaccagaaggcgaggttctaggcaggtgtacctcatttggctgcatgcgtgtggttacagagcagggtccattgggttccctgggagcttggagatgctgctgcctgggccagggctctgatcagtgccttggggtacattcatggcattaagattttgaaaagcaccccaggtaattctggtgatgtccaaggctgagaatcactgagctgtgtaagtcttccctcaaagccttttctggtagggcgaggtgcctcacacctgtaatcccatcactctgggaggccaagatgggtggatcacctgaggtccaggagtttgagacgagcctggccaacatggtgaaaccccatctctgcaaaaaatacaaaatttagcccagcgtgatcatgcacacctctagtcccagctactcagtaggctgaggcaggagaattgcttgaacccgggaggcagaggttgcaatgagctgagatcacgccactgcactccagcctggcgacagaatgagactgtctcaaaaaaaaaaaaaaaaaaaaattagagttaaatgttaaataaactgaaacataaaaataaacagcaacaaaggattttagaatactttgccatgatttattgattctgtccgttgtgatttttttttttgcgacgatggaaattgttaaatacatgagccactagccacgtgtgactattgagtacgtgaggtgtggctagtgcagtcaaggaattgactttatttttagtcacttttcatttgtttaaatttaaatagccgtgtatggctagtggctaccgtacggaacagttgcagatctgtaacatatcatctagagaattagagtgtgcctgcgttgcaacacagctttctatcttctaccttctgctggctacaacactgcccctaaacccctccatagaaattctggagctagagttgaccttgaagttaaaggaatctgactcaaatcccatgggcgagttatttaatctctgtaagtcttggtttcctcttccgcaaaatgggtctgatgaacctgataagagttgttggaggattctgaagtgaaacattgcttgtgaaggttttcacacattgcctggcgaacgtccactcaaatgttagaagcagttactattctgtcttgtagatttgggaatgaggaattttgaagtcttaaaatcagtggagtaattatctccaccacttcttaggcagacactgccccacccttatggagctgtatttagagcttgcagtgaagttgcaggaaatggagaagttgagtttttttcttgctaagtaaatcgcccctgagttcattacaaaggtcagctggcccagcaggacctatttgcattctgtatttgcaaaccctactgtttgtttattagggaaggagagggtggggtccttggctaggacatttgtaagtcagatacattgaggcctgggggagggaaagttgctttattaggggcatcttttcccatctacatcctttgagtttcctcctttttctggggcaaccaccaaaagtggccatcctgtgcctctagtctgccctgtggcagcagcttcccaagtcttggccacatctgggttcttcccatgggccgaatgtggcagtcctgccttaaccttttgtgtgaggacacctgtgatttggccccagctaagtggcccgctatgtgtccagtgctccctaactcggactcccaggcttccttgacacagcctgtgctcctcacttttgttgtttgtcctgtcctgtctctgccattgctgcctactgaaatctttctcatccttaggccccattagacagtgaccttattctctggtgcctccttttccctcaaagctcgataaccctaaagccatttttcacattctttgtgacattctacctagtattgattatatcctaccttaaaaagtggttatccttgggctttgaagcccggctctagcgtttcctagctctattgctctgagcaagttaagtttactgagccttgattttcttacctgtaaaatgggagaagaggtgaataatccttccctcttaaagttgttgagtattaaataagtaaaagtcgagggcttagcatgaaataagtgctaaataaatgctcgtatctatttgagccaccctagtaattcctggcagagcctcctgctgatagtggcactcagatgtttcaaagaatagaagcaacctatgccttcagtttgataatgcagtagagacaagtgcagtgcttttcaacattcaacatataagtaatttgagaggacacagtacatgtattcgtcaaatacgatggcatgtctactgcatgtcaggtgctgctggggggtggaggaacacctgtggacagtatagacagtcattgccctgaagtgctcagtctaggagacaggcaggcaggtaattagagttcagtgtaatccacaccaccatagagatcagcccaagattgtgtgggggctctggggagggcctctgattcccatttagggtgggagtacagagtccaggaaggcttttgatctgggtgacaccctcgctcggaactgagttttattttgcttattttaaaagcatttatatgcaaaccaggcactatgctaagtgcttgacacaaacttatttaatcttccaaccacccagcgaggtagtcttagtaactagtataattcccattttacagatggggaaactgaggtgctgcgcggttaagccatttgcccatgtcatacagctagtgagaagcatagctgggagttagttgagtccaggcagtctggctccagggtctgtgtgcctctccacaggactgggctctctctcgcttttgcagcctagcattttagattctgtaacaggtgtatttcattcatgtccttgatcgctctatttgtaccattaggactcaggatgagacagataagaacacacaaaaatctagactcacctctgagtttcttccagaagctcaaggggtctccctctaattaagaggaatatgccctggccacggacatgaagttgttgggccaggccagtgcagtttttgggagcagctgagctgtgagatcgaagtgtgcaatagggttgtctaaggtggcagccacacgacacatgtttgttttgctggaggagcccctctgtcaagggtcgctccagtaaccactctgcaccccgagtgattgagtgcagagcaggaagcgggcagatatttgcagaaggaggctgggagagctcagggattagttcccagggagacctcccttttgaggccggactcctctcctgcagccgagcacgcagccattaaggaagtctttgagtttggtttaatggcccctctttgttttgaagtggctgtttactgaaccttcaaagcccgctcggcagcaggatgtgatcgagggcctgaataattggatgaggcaccccaataggaaacagggagcggggagcagagccaggactagccgacagccaagccctctgtctgagcctccgctggagggactgaggtcatcctgcaaccagaagttgacctggagcgggggtcccctggaacctggcctctttgatgttgtgctggccttaattaggaacaccctaattaagtcactgaggaggaagcttttttcttaaaaaaaaaaaattagcagatgttttgagagcatttcatgagggattacttctcaaagattatgtaagtaacgtaaagttaatggaagaaaaactagaaacttcagttaagtaaaaaataagtcacccacaagcgcttgatgagaaagtgggttatgttcacactcacaagggctcgcacattttcagcaaagggtcagggagccaagactgtgtcagaaacttctttcttcacttagcggcctggcgtccttgcctttccgtgtgtgtagttgttagcagtgccattgttaatggctgtgtggtgttgcactgctttgtatttctctaattaattcatttggtcaaaacatatttgagaagctactagtaccaggttctaagtgctgggctctagcagtgaacacaatggacacaaatccctgccctcctggaacttacattctagtggagtgaggtgcagttgaaggagacacatggaataagtcaattctcttgtatagtaggattatgtgcaatggggaaaaagcactgttgctgtttttctttttaatttttatttatatatatattttttgagatggagtcttgctctgtcccccagaccggagtatgcagtggcgcgatctcagctcactgcaacctctgcctcccaggttcaagtgattctcctgcctcagcctcccgagtatctgtcccccaggccggagtgtgcagtggtgcaatcttggctcgctgccacctctgcctcccaggttcaagtgattctcctgcctcagcctcccgagtatctgtcccccaggccggagtgtgcagtggtgcaatcttggctcgctgccacctctgcctcccaggttcaagagattctcctgcctcagcctcccaagtagctaggactatagacatgcaccaccacacccggcttttttttttttgtatctttagtaaagatggggttttgtcatgttggccaggctggtctcgaactcctaatctcaagtgatctgcccgccttggcctcccaaagtgctgggattacaggcatgagccaccatgcccagtctggtgctgtttttaagtagagtggttaggggcgggcctcgcagaggaggtggcgttagagcaacaacttaagaaccgtgaagatgtgggcagggggtgagggcagtgttcagtgcaagggaagagagcatgtgcagaagccctgaggcagaagccagtacctccctcatttgtgtttaggttgcgtccagtttttttttttttttttactaattataagcaaccctacaacaagtacatccttgtgactagacattgatttacatcagtgatttcccccgaaggactttttatccttggtcaaaatgtgtgtttttttcaaggcttttgaaacccattacccaaagcctaccaaaaaacatgtctcagttcccaattcccatgtttgagggctcaccaccgtggattacatctaaaggagctagatgtggacactgggacctagctggcacccctgcttccaagggcgcaaagggacatgtggcatcttatctagtgcagtgattctcaaatcttgctgtgtgtaatttttaatgagcaaaagtgtccctggagaatgggttaaaatgcagattccctggctccatcccaggagactttttgttgatctgggggtggggcttagaacctgtagtgttagcaaacacttcaggtcattctctgataggtcttgctgggattccaccaggagtaggtggaagtgggagtgccccctgggtcacctgagccactgagagcttcctctgcagctcttgaagtatgtagggagctatctcccgcacatgtgtccccatccccgactccaccacagatatacttggaatgcgatcaggcagacgaaatgagttctgtgcctaggcagagcatgatctcgacttcctttcatttgctaattctgtcttttgcagggaacgcttcctccctctttgtttcatttctctttgccaagaaaattcccatttatcctctgagaccgaggtgaggcattgcctcactctgggaaccgcactgtccagcactttatatctcgagtatgctgcccttggggctttgggatctgcagttccacatcagctttactgctagactgcgttcctcaacgctttggtctctttctgtctatggcccacccctcactcagtgcctgcgcatagtaggtgcccattcgtggcccagtcagggtgattggcatcgtacattgagtcatcaaagcagagttgaattctacttgctagtcacccttctaaacacttgttgttttccccatcatcctacaaccatcatttgaggcagggactgccatcagtgtcctttacagatgaagacagggcagcaccaggtgattaaattacttgcccagggtcacccagtgagcacatctggaattggcaggctgactctagagtcatgctcttaaccactaggccacacaaggcttttcaggctctggaatatggctacacctcagcgccctctcgccaggcaagaaaaatgacattcaatggaaagacacttaaaaaaaaaatggctatggaaatgacaaacacagttatcactgtgacactggtggcctttgactctttactggctaccagggcatcgttcctagcagcctggggtgggagttgaggtcacagaggaggtgctatctgtctccgttccaaaggggaaatctgcttcgtggaagatggcagagcacactaagcgtgtatagcgcagcaaggccagtgcttgccccagggtggatgtgacaagttcatcatgctgcccttggctgcggagaggtctcagtttaaaagggaatatggattaaaaaaagtaaggaaaagaaaacaaattaaacaacaaaaattaaaaaaaaagaagaaagagaaaaagaaaagaacataaaaaagggaatatggaatgaatacagaggtatgtgtgtatttaggggagcaaaacctcaaacatgatcctctctagggtagagggtgtttgtgtgtctgttcagggtattggagagattggccccaagaggaactaatccctaaaatgcagaagcagttttggagttgggtagaggcaggtcagagcggacacttccagggaaaagaaatgggtgagtgtaaatggaccaacgtgaagtcacgcttagaaggtctaacatttcatagggtgtgcaagccactaggtgttttgctcaggttcaatatctaatgtggacatttatagacaggaataaacacatggagcaatagctttggcctctggataggaggacaaaggttagagggtagatatgtattattctggggaggattaagcttatacaaatgctaggtaaaagcagccagcccctgtattaggtggttaaatattgagttcccaggtttccagatgtggagaatcagtcagtcttaggtgaacccattatacaattttattttaaaaagaactgggcaggctgggagtggtggctcatgcctgtaatcaatcccagcactttaggaggctgaggtaggtggatcacttgaggtcaggagttcaaggccagcctgtccaacatagtgaaaccccatctctactaaaaatacaaaaaattagctgaacatgatggcacactcctgtagtcccagctacacagaggctggggcaggaagatcacttgaaccctggaggcggaggttgcagtgagccaagacagcaccactgcactccagcctgggcaacacggcaagactccatctcaaaacaaaaacaaaaacaaaaacaactgagcaaactcaggagcaattaaccattgcttaggagcaaataacagttaatgcagttaaccgggcgtgagggcaagcccttccctgactttgggcaaattacttactctttctgtgcccgattttcctatggttagtagggaagtgttaaatgcctgttctaccagctgccctttcagtggtgttttgaaagacctctgtactctcgaatacagcatacatgtgaggcggtgccttcagtgcccatcatgacgtcagtttagattcccacatggcaggttttcacctttgaaaacttggccatacaaatgtcaggtggctgctgatgcaggcagtgactaaccataaacctcttcctctctcttttgatgggaggaactatctgaaatcataaaggaaatgtcatggccgtaatggccatggctcttgcttgtaatcccagcacattgggaggccaaggcaggcagatgacttgaatccaggagttcgagaccagcctgggcaacatggcaaaacccatctctactaaaaatacaaaaattagtcgggtgtggtagtgtttccctgttgtcccagctacttgggggactgaggcaggaggatcgcttgggcctgggaagtcgaggcagcaatgaggggcctgggaagtcgaggctgcagtgagctgatattgtgccactgcactccagccttggtgacaaagtgagaccctgtctcaaaacaagaaaacaggcagggcgcagtggctcatacctgtaatcccagctctttgggaggctgaggcgggcagatcatctgaggtcaggagttcgaaaccagcctggccaacatggcaaaaccctgtctctactaaaaatacaaaaattagccagacgtggtggtgcatgcctataatcccagctacttgggaggctgaggcaggagaatctcttgaacctcatagtcggaggttgcagtgagccaagatcacatcactgcacctccagcctgagtgacagagcaagactgtctcaaaacaaacccaaaattggggaatgagttgaatttaggggatgaaaaaggagagggattctatttttcaagaaatgtggagcatggaacacatacatacattttacagtggttaaaaaatagaaccaaaaacctagctgtggttgtagagcaccctaagatagtgaagcccttaggggtgccgttgtggtggggtggccattgctgtccaatagaactttctgcagtggtagagatgttctgtgtccatgctgtccagtacggtatccactagccactgcagagcacttgaggtgtggctagtgggctgaaaaactgaattttaaattttatttaatcatactttaaataacctcatgtggggctcccctgttggacagctcaggatagacaaaggaatacttcctggtggaaaacttaagaaaatgacttggaagatatggttgacatatttgtttggttctttttattttaagtggagacacccagatgtcagaaaacagcccgggcatccaacctagtaatgcgggaggaggaaaagcttgatatccttgatttgtttggttagggtgttaatagttacaaatggagcagtttgtaaggggagatggacggatggacagagggagcaccttttgtggttcagtcttccttttcataggcatatttattgctggtgtgcttgggcaagtgggtgagggtgggcgggcgaggaagcaaccattgattatccccaaggctgtcatccgcttgatggacagggataattagtggattaggcaacccccaatcagagaataaaagcccaggaatggtatttatgatggatgggcttacccagtgcctttcatctgaggatcttaggagcccttcatcttgcaggattgggtggggaagggtggttttggggacaaagctatgacaggcattcatgggccctgtctgtcatcccacacgcccacttctggaagctgagcggattcttgcctcatgcttgaagaagcagggaggccagagccactccagcgtaggtcagaaggtgccagcctcctctggaagctgcgtaaagcagcttcagggtaacctgaaggctgagctcatccagggtatacccagcggaagaagaggaaggatgctgttggctatgttcctcacactcgccctgctgaggtctccgcagacctgggaaggggtcatggtggcaggggtggctgtggcagctggagatttaaaagcccctcccagattgactctactgatctcctggtagaagaagaccagtttgtgtgttcacagaaaaccaagatgagataaaattatccataatcataccacaagtgccaacagctatgaacctcttggtgcatttctaccaggcatttttctacccactctttgttgtgtgtttcatgttttcttcctttttttttttttttctgagacagtctcgctctgtcacctaggctggagtgcagtggcgtgatctcggctcattgtaacctctgcctcctgggctttagcgattttcatgccttagcctcctgagtaactgggattgcagacgtgtgctaccatgctgcactaattttttgcatttttagtagagacagggttttgtcatgttccccaggctggtctcgaactcctgagctcaggtgatccatctgcctcagccttccaaagtgctaggattacaggagtgaggcactgcgcccagcctcgtgctttctttttcatgtggttgggggtcctgaccatttccagggtggtattacaatccctctgggccatctgcagttgtaatcaggtgccatgtgtgcagggcacccttgtcctcttctgctctaccttgtctgggctcttataggacccacatgtaaagcgcgacccaacctgctgtctaagccactctttgcagccctggggctgggctgggctggaggctggctctgttcatgtggttacttgcacttcccagaatcagggaacacttgggctgcaaagtcagatctggcatcctattgcaacctggagctctctgctccaacctctctgggcatcagtttcctcagctctaaaataacagcagcacctgcctgcctgggctgctgtgagcatgcagtgagaatgcaggatcaagctgggctccttagagagtggtctgtggaccaggagcagcagcacctcagattaaacggccccacctccaccaagcaaatcagaacctgcctgtctgcaagctccccagatgatggatatgtaaattacagcttgggaagggccagtatatatacctggcacctggcaactctttagaaagtggtgatgcttcatgatgatggtgatgacagtgatgcttgtcaaggtgaacagagatacttgggaagttacctggctggtcatataccccacggcttgatttctcagccagatccactggtgagccagcctctgtctggcaccttttgggcagaacaaaggcctttgagctggaaccccactctctagagcctctgccctcctggttcctacttgattctcccctgaactgaattcttcctcctcacgtaagtcctccccagctctgtggctcctcccaagttgccctttctctggcagttcccggcccctgtgttccttgtgtggcagcgtggtgttgaattccctcagctgtcccagtggcgctgggctgggagaggcagttgctgcattatttatggagcaccggtcaccagccgtgctgatgagctacacacagttattctctgcaccatgtgtgggatgccgtcctgggcctctgttcaataggaaacaaaacgaagccaaacaaccctaagccagaatggctgttggccgattgctgtgccttgctttgtgttaggcaaatggcctgccatgggtcctggctctagggaaagtggaggaagaggaggaagatgaggagaggcactcggcggtgtctcctaagctccactttgagggtggggtggggagaccaacttgtggatttgtttaggtggccaccaaactcttcagttgaaggagatttaggaggcctttttcctaaaaactaagaaaatgacttcattattttcctctctctcccaggaactagagtgatgccaggtatgtgaccattagccaggttctcccatcacctgtctggtctggaatttatgtcactcactgtctgaatgaaggccaccccggtcttcctcacctgtcccaagtccccaccctgggtcttgccctggaaggctgcccttgcccacctgggccacttcgcccatgtcctgcctggaggagtggccagcataaatgtgtcactccagtgtcccttggagagagctggtcagtgttccctgcctccttttgtgtcagctgcaccccctaccagaagtacttttccttcctcccttcatttctcagtccttgttccacagtccaaaggggaagccctcaggcttatagacagcaaactgtatgatgtgataagttggggagtaggtgcagctaaaccagagggtaggtgggaagggggtgtgtcagagaatgttccagaagaagtgtcacagctgggtagtgacagctgaataggagttttcaatattgctgaatccccctggagatttgaagagaagcagccacagggtgtggtgtgtgtggggagtgtgggtgagatcacgtgttcagggaagccccatctctcacccaaggaagtgatggagggagtcctctttacacgcttgtaaacaaactggctttctcttcccgtttctttaatagggaccttttcctttcttagaacccagtgtaatctgagttgtattttcaacgaacgcactgccaagggctccagaaactcctggctctcctctctgaagaaattcagggggctcctggaggaggtgcgccttctcattttgccttgtgactttggacttggcagaagccggggcgtggcgggagttttgttttctttgatttgggtctgtctggaacgttgtgaagcctttatgtgttctcaggtgaaatccacagtggggtctgtgttgaattgttttcacggctctgggagtgcattccgagggatttcctcaaatggggacagagctcagccagcaacctcaggaatgaactttctggggacttcttggtgggtggatgcagatgcaaaaaccaaggacagttggggaattgctttctaaagggctctaagagcttccagtgtcttgggttgcgggtttcttttgaaacttgagtatggtctcctttatgtagtcttgctgtccaaaaggcaggactttttctctgctgcctttcaatctttctagttaccttcttcctcctttcttacttcctctaagcttgaattattatagtaaaactgctctcaggtgggtagaaacttcttttttccttgaaagaaacttacaaaaatatctggaacaacccaacatcactttgcctttaaattttaatgacatttactcactttttttttttttcatttctcaacaaggaggtttttgtcttctgttcttagaagttgattttttttctttttttagaatctattaaattatatattgcctaaaacaggtgggcctgactctctctgatagactgtcaagtgtcattaagtcagcagcaagctactttgggcaaccttctggctgggtggatgttcgtaggtggggagctgttagctgtaccccttgactagaaaggggacccctccttttgttgctaatttggtaaagactgaaatgacgctccaagtgggggcagataagaagtttcttcagtggtttgagtagtcgtctttttcaggcacactcatctcagggttgagtactccaccctgccatttgcttagcagcagcagagaaattgtctggcactgaacacccagctgcctttgccttggtctgtttctgcctaaccctggtttactaatagggagatgcagatgcttcccatgttggctggttccacaccaggtactctaaaaggggggttccagtctggatggacagtctgacttagactttacagtctgtcccccacacatcctaaaggagattactgagagcctgtggccacttggatccctcatatcaaatgtttgttgagcacttccagtgtgctgggcactgcaccgagcactttctgtatatgacctcattcgttcctcctctcagccctgtgaagatgtgacttaaacccatgcagaggtcaaataacttgcccagtgtcgcatagcaaatgggagagctaaggttcaatccaagagattgggcttctgtacgtgcaatctttattcatctccttcattctttcaatgttcaataattgatggtattggtaatggtgatggaattatttgttttggttatcatcattataagggaatgatccctgagaagtgaaatgatttcccctagtccatgactggcagggctgtgactagacctcaggacccagtgctccctgcccaggccactggccagttctgcatgttctcgatgaacatgcctcaccttttcctttggctttgtttctttgagacagggtcttgctctgttgcccaggctggagtgcggtggcacaatcacagctcactgcagcttcgatctcccgggctcaagggattctcccacctcagcctcctgagtagctaggactacaggcatgtgccacagcacccagctaggtttttttttttttcttttgagatggagtctcgctctttcgcctaggctggagtgcagtggtgcgatctcggctcaatgcaacctccactttccgggttcaagcaattctctgcttcagcctcccgagtagctgggattacaggtgcctgctaccacgcccagctaatttttgtatttttagtagagatgggtttcaccatcttggccaggctggtcttgaactcctgacctcctcatccacctgcctcctaaaatgctgggattacaggcgtgagctaccgtgcctggcctggtgttttttttttgtttgtttgtttgtttgtttttttgtatttttagtagaaatggggtctcgccatgttgtctgggctggtcttgaactcctgggctcaagtgatcctcctgcctcagcttcccaaagtgctaggattacaggtgtgagccactgcccctggcccacctttttcttaagaaatactttgatcgtcttaataatatttctccagggctccctggatgggagtgtttggtgtttgggagaggagggtctggctctttggtccttcttccttgtgtagccgagagatggtggcacctttgcctagaagtaggtgagcagtgtttctgaatgctcagatttctcagaaagcttttcatcgtgtcttgtggctcagaaagagaaggaatggtcggacgaagctgctattggttggttgagcctttgtgttcttagaggtgccaactgctgtccctctggacagagatctccagtggccatcctgaggactctgatcttggccctcatctctttaattggatgtaggtgtacaaggggtgttcttatctggactggattaaaaaaatggtatgtatgttgggtgtcataattggagtccccactatgtcttgatgggccttgaatgatagcctgagctctcacaagttttcatttgacataaattaatatacagttctgctcttgggtggaagtaacccccagggcacacacttgggatggaggtcatgtcgtgacaagaccctcacacaggtgttggttgacagtagctcaggtgtagctgccaaagggcctctgccaggagccagccagacacgattcttgcccggctgttgcttagtttcccataggggcaaattgccacttagaggaataaatccagaaacctgtgcttgagccaagcaggtctccaatgcatgaaggcagaactgatgaatgtggtgtagcagcatgcgtgaaacagactttagagttcgggtggattgtaaattcatggtgctgttgttgccagaacctctaatttgatcttacgttttaaaaaatgcaatgactttattgttttcattaaaatgatacatgacccttataaagaaaactcacaagactccagccataaaggaaagtacaaaggagaaagcaatacattggtccagattttaactcccagaagtaacccgtattaatattttatagacaactttccagatatctcttatgtacattttcagacagaattgacagctagggaagtatataaatagacgattctataacaaggtgttccttgttataatgagtgctccttgttataatgagtgctatgcatgatcttttgaaaaaatatacttaattgtactttcatttaacagaagaaaatgaaactgaagtaatactgtaattgtttcttcaccactttctttaagttgatttctcagatgtgcctttaaggcagtggttcttgactgggcgtgatttttgtcccctaggggccatctggcaatgtcccatttttggttgtcccaaatagggggtgggggaacgctggcatctagtgaatggaagatagcgatactgctaaacatcttaaatgtgcaggacagccccccacgacaaagaattatctggcctcaaatgtccatagtgttgaggctgagaacctgctctaagggtaagaaaaaatgatgtttaataccattaggaaggtaaaactgttaatgttttagctgggttgcagttttagacagttttaattgggcttctgtcatgaaagatgagttgattaacctcattataattttttcctcctttcctgaacaagaaaatcaagaggtagcatatgttgtttttaccttgtcagggttcataacatttacgctctgttctgcaaaaataatccccaggtgtttagtcttagttttgttttgttttattttattttatattattttattttttgagacggagtgttgctctgttgcccagtctggagtgcagtggtgcgatctcagctcaccgtaacctccatctcccaggctcaagtgattctcatgcctcagcctcctgagtagctgggactacaagcatgcgccaccatgcctggctaatttttgtatttttagtagagatggggattcaccacgttggccaggctgatctcgatctcctggcctcaagatgtctgcccaccttggcctcccaaagtgctggaattacagctgtgagccatggcgcccggcccttagttctgtacttaaatgatcaatgccaaataccacttctcagcccattgtttccccctttctgtgttgattttgagtcacctcttggttggtgggctgtgtgatcttaatataaatttaacatgtgtaggaagggagacgtcggtccctgcctgctttgccctgtcagacttgcacctgcagatttgagtttgtgtctatgcaccacacttagaggaagagtagagagacacgctgagtgtctctgggatgcagtcagggtgtgaagcagggtcccggggagaagtggggttggatgtgaaactggattttgaaaagacttccatgtggaagcaggattattgatcttaactgagggctcccagaggttagaactagaactacatgaacatcaaggacagggtggctgataataggctgggaaggtgatgagttccctgttagccgaagtgtgttggggaaccacctgttgctatactgtccctaggtgttgggcttaagccatcagctgagctgctgcattaggtaatttttcaatcttgagattctgatagtctaattaatgctttctgtaaccacctgtcctggggaagagccccagtcactctggttccctgcttggtgttgtttggggcaagtgggagaacagccagggccatgtttcatgaacaagtggttcagggtggagctttaaatgttctgtacaccttaaatttggacccaccatctaccaactcaaaagtgtatgtgtcagattctgccaaactagttcagttgatgtttgtagtatttacaagattataggaactgagcacattctaaactgattcctgagccaatacatgtatatagaatccgggaaacgtattgcagacctgcaaaggaagagaacatacacagattgttccctgcatgattggaattgggtgctctgttaatgtagtaatcagatgtctatcgcagtgtgacttactgatgtctttgatgtgttgcaggggagctatccagtttgggaagatttcataaacaaagcaggaaagctgcagtcccagcttcggtaagtagaagcacatgttctacaggaaaaggacaacatcctcagacaaggatggagtgggacagaccaaaatgcagattgattagggttgattcaggaagtgctgcagatagggaagcctgtgctgggttctgattggagcatgatcacctatagccatatatcctgggccctgattgccatatgtaaaatgggactcattcatgtctgctttcctccttccataggaattttgagagtcaaatgaggtaggtactgtatgtaaggtagcaacgggtaacatttatgtattgctcactatgtgccaggcatttgttaacttgtttaaatctcataaccccacaaggtacataccattattatccccattttactgatgaggaaactgaggcacagcgaagttaaataacttatccatagtcacatcactactaaatggcagagcaaggatttgaacttaggctctctggctccagagtccatgttctcctccattctgcttactgcctctccacaaatagagtttaaaacctcctgttggctgggtgtggtggctcacacctgtaatcccagtactttgggaggcccaggcaggcagatcacaaggtcaggagttcaagaccagtctggccaacatggcgaaatcccatctctactaaaaatacaaaaattagctgggcatggtgacgagtgcctgtaatcccagctacttgggaggctgagacaggagaatcgcttgaatacaggaggtagaggttgcagtgagccgagattgtgccattgcactctagcctgggcgacaagagcaagagtccacctcaaaagaaaataataataataaaataaaataaaaccttgtgttgactattgtataattccatttacatgaactatctagcaaaagcatatctttagagagatgttgatcattggttgcttggggatagggtgaaaaaggagagtgagaagtgggtaagacagatcttttggggtggtggaaatgttctaaaattggattgcggtgatgattgtgcaactccaaatttactaaaaatcattgactcataccctgaaaaagggtgtattttatggtatgtaaattatgcctccgtaaagctgcctaaacaagatccagtgctgagctctaaggggctgtgattgcctagtctcgtgcttgttcatatatcatgtgatatgaaatagaaaatacgttggcatcttcttattaaagctctacccttttaaatcattgtggtgaagggatacaatttcacttagtgggtgcttcatgaaggataggacattttaaaaaggaattattttgatggccctggttcatggcatgtaggggatgtcattggttggtttggatggaggaagatggttcagagagcggggcaggcaggggttttccaggataaagagccatgtggacgacagagaggtgggagagggatgatgtgatgctctcgggcctttgcctgtggacaccaggggtcactgcccagagtgttagccataggactagagtgtccatggtgccctatagactaaagaacttgggaaaggtgggccttttttctttcattccttcagctttgtttggagcctgggatttccatccatgaactgcagcctcagatggacagtgaacttggaatactgcaccttccccagttgtcaagtcctgtacttaagccctgcttaagctcttgtaattactttctactggatcagatcccacctcccctgctcaggattcagggctcctcacctgagtccttcaccagcctcaccttatttagccatatctactcccacctccatgtctgccatgattaccatttattttaggtagcttcatctttatcctgtgggaggtctcctcctatagtaatacagtaaaacatttaagtacatttcccctacttttttaagattcagcctcatttaaccgtctggcagtctttcagagtagaccaagaaaattgttatcttccccttttatcagtgaggatcttgaagcttaaagtaatgaacagatcagctgtcttaaacatataaagtaaaatttaaagtaatcttaacctgtccttactggtacaggatacattttatattattaaacaatgttttgtcctgaaggcagggaccatttctttattattttgttaaactaatagtacagggctgagagcaatataggggcctcatgcacatagtttaattttgtgtgttagagaaaggatgaagtttagattgcagaagaggcatagaagccttagtttatttaagctgaatcactcctctgtgtttctgttggttacaagtttgctctgccccatcaaagagggccaagatgtcttgtgactacagcggacagtgaaatatgactgccatttaaaagcctcaaacttgatcacccgcctaattttcagtggagccctggtgactgtgtaatatgcaagacacctctgcagctggttcattaaatttggatgattggcattgagttggatgagaataaatccagccattgtgtcagatattaattgtaaatcagaacaagctatttataagtcccaagaagtttgataaagctaatttttccagggtttgtgtttgatgtcaactctttaaaaaatatgcttcaaagtggttttgtgtacatgtatgtcattatttttaaaaattttgagcagaatgttttcttgccctactggaaaataacaggcctcattttgaagtttggctgtaagggactgttgcctagattttcccaggaactacttccagcaccttgcaggaaccttttgtttcaaaactactgttgctgatgtttaaaggccattcctttccctttttctttcttttttcttttctctttctttttgagagagggtattgctctgtcacctaggctggagtacagtagtgcagccatggctcactgcacccttgacctcctgggctcaagtggtcatcccgtctcagcctcctgagtagctgggactacaggcatgcaccactgtgcccggctaatttaaaaacaatttttttgtgtgtagagaatggagtcttagtatgttgcccaggctggtctcaaactcctgagctcaagtgatcctcccacctcagctttccaaagtgctgggattacaggatgagccactacagctggtttcatttttctctattttgaaatcttccctttctagtccttattgttattcttcttcagcaactttgcatccttaggaacgctcagtaaaggctgagttatataagaaatacttgaaaattaacacttagttacaagtttgattgtaaagtccttgaattctagttctggggcttgtttgtgtggaatccatggccctggcttggagtgttgactacgctgaatgatgccttaggtcatgactcttggaaccagtagaccacagagggctcaaggcatcctatggtgtccaaaaaaatattaagaacccagaataatttctaggacataagtgactatagtaccttctccccattctcaccttgtaggaatttggaagattcagttgaaatagtgtcctaaggttgaaacagtagtatctcagtttcattataactaggatctagggagaaaagtcacactgccaggatcttgtcttatagtgggtcaagcccaagcctgtgagtcatgaggctgggatacttgtcccagctctagtatgaactagggctatgtttgtggcctcgtatttgtggcctcagttctcctattcctaaaatgaattgtttgaactacatgatctttctaccagattccttcccccaactgatgtgcatatatatatattgctttcctactccaaaattaatttcacctctaccacttatattttttaatgttttatttttccttttaggtagaaatgcctctgttttcctcctgtataaaactttgcctggtagtaggtgtttcttttttctttttttttttgaggcagagtcttgctctgtcacctaggctggagtgcagtggtgcgatcttggctcaccgcaacctctgcctcctggtctcaagcgattcttctgcctcagcctcccaagtagctgggattataggtgcataccaccacgcctggctaattttttgtagacacggggtttcaccatcttggccaggttggtctcgaactcttgatctcaagtgatccacccacctcagcctcccaaagtgccaggaatacaggcgtgagccaccatgcctggccctggtaatggttttatacagtcagatgaaatggaatgggaagggctactagcatttattgattagcaccgaatgagctggatattattcgggtggagtacttggaaaaaagtgggttcagcaagacagtggttgtccatgctcagttgagttatttctggaggaaggttacatgtactccttagcagaggttttaggccttgagctgtaatgaatttgctagggagagacattccttatgcttttgttatctgtttgcattttaggacaacagtagtagcagcagctgccttcttggacgcctttcagaaagtggctgacatggccaccaacacacgtggtaagcagatggaggctgactcccagtgttaactgcattctgcacgtggactcttccccttgggtggctgcacaagaagatgcagcttaagttatcagagctgagctgactcgtattttcccattttttaaaactctgtgggattccacatattagaagttgcaactagttttctggataataaagcacatgtgaagaagaatgaaaaaggaagaaaatgaaccactgtttctgcacgagttggcttgatgggttctttgatcactttaatgacgtgctggttgttgaaccttgagctgtgcctttggttgcaatttgcgttttcctccttacgtgggttttccttgtttccttgtggaatgggaagcagtagggatgattggatagaccatttttctgagtttccataaaatgaagaacccttttaaaataaggatctcattgggttgtatctatttatgcgtccctcatatttgactgcaaacctgttgagatacagactatgacttattcatgtctgaagccccaaaacgtagtgcctagaacataggagatgtttaaagtatgtttattaaatcaatgaaaaaaatttaatggcttcagcaagtactgaatcatataaaagttattcataacatgtgaaaagtataaaaagaaaatgaatacccccgtatgcctgaccgtctttagaaatgcaacattatggtcaggcgcggtgggtcatgcctgtaatcccagcactttgggaggccaaggcaagagatccgaggtggatcacttgaggtcaggagtttgagaccagcctggccaacatggcgaaaccccatgtctactaaaaatacaaaaattagccaggcgtggtggcacgtgcctgtaattccagctatttgggaggctgaggcatgacagttgcttgaatccgggaggcagaggttgcagtgagcccagatcgcgccactgcactccagcctgggcaacggtgagttgggactctgtctcaaaaaaaaaaaaaaaaaaaaagaaaagcaacacatgcaacattaccagtaacagacaattaccctattcaaagggaggagggtgatttccttttcattgcaatgcagctactctcttctgcctcttactttgccttgtctttctgggtcttcttgttgtactggcagctataggcctgttcttttcattgtcgtggtgacattggaaaatttgggttgtagggcaagtgttggggactgctcccaggcacatgaaagtttctccgaaccacctgatgggtaccttcagtgcaatgatactcattcatcacaggtgcttaaaagtatttgaatgaatttgcagcaagaacccttctcattcattgaacaaactccttttatttcaggcactatcatgggaccacaaaaagcaatatgactctccttgtcctggagcggcttacaattgagtggggaaaatgagaagtataaataaagaatttcaacatagaaactatatgtttggtatggtaatagttgtagaacaaagtgctaggggaatatagaaaagtgagcaattaactcagggagtgaaggagtttttcctaggggaggtaatatttctcctcatttccgggatgccagcagggttttacagcattcccttggagaatgtgacacagaaactagaagcatggtttcttcatccagtatgtcagcttggtgtggatcttaaccagtatctttttaaaagtcctttaaaaaaattactccatagcttatgtgtgtctgttatagaaacttgagaaaatacaaccgtagagaagaacttaatatgcaaaccattgcagggcctatagtattgcattttatattttcttctacttcagcagtatctggaactggacttggcagccatatttttatctttctgtaatagccatcagtatagggttttttttttgtttgtttgttttttgtttttttttgagacagaatctcgctctgtctctcagactggagtgcaatggcgcaatcttggctcactgcaacctctgcctccccacattcaagcaattctcctgcctcagcctcccgtgtagctgggattacaggcatgtgccaccacgcccgactaatttttgtatttttagtagagatggggtttcaccatgttagccaggctagtctccaactccttacctcaggtgatctgcccgcctcagcctcccatagtgctgggattacaggcgtgagccaccgtgcctggcccagaatatgtctttttttttttttaagctgctctactgttttaaggaacttagatatctggcattgcatgtttgaggctctgtgataataatgtttttatattttaatgtttaattcttggatggatcctgtagatggactggaaagagattcccagattgtccataagttcctgtagtgggaacctgggattctgaagatgctgctcccagaatggttcttggcgggacactgcagggcctggaaattgtcatctttgaagggaagaaaaacagccattatttgtgcaaaaagaaaccaaagagcctcactgcagaagtgatgggggtagagtaggagtttggaggtgatgtatttcaccaaaggcaaataatctcatagtgaacaaactcctgctttgacatttttttttctttttttttttgagacggactcttgctcttgtcacccaggctggaatgcagtggcacaatctcagctcactgcaaccttcccctctagggttcaagtgattctcctgcctcagcctcccaagtagctgggattacaggcgcccaccatcacgcccagctaatttttgtatttttagtagagacagggtttcgtcatgttggccagactggtctcgaactcctgacctcatgatctacctgcctcggccttccaaagtactgggattacaggcgggagccaccgcatctggctgctttgacatatttttagaccatgggatttcagatcatttttagtgatgccaggatacgttctgtttaaaatccatacgtgctactattttcattgaatgtgggagtgtgagaactctcaaataacctaaaagtatatgggtgatagaaagaaggtatattttacagagataagagaaactcgaatgtccttcttagtaagtgtcagaagtgacttttattaatttttacttaaaaatttaaaaaataggacatgctctttagtttaaaaaattgaaataagtaggctgggcgcagtggctcacacctgtaatcccagcatttgggaggccgaggcaggtggattacctgagatcagaagttcaagactaccctgaccaacatgttgaaatcctgtctctactaaaagtataaaaattagccaggcagaggagtgggcacctgtaatcccagctacttgggaggctgaggcaggagaatcgcttgaactcgggaggtggaggttgcagtgagctgagattgcgccactgcactccagcctgggtgacagagcaagactctgtgtccaaaaaaaaaattgaaataaatatataaactaaaatttatcctccccacttccccgcccctcccgggaattgggtttagtgtcatttacagatgtttttgcatatataaacaaacatgctgggaggaaaaaaaaaaaacaacactagttttccacaatatgtggaatgacacatggaataaaatatacctgtgtgacctttttcagaaggtagcccctaagaaacattgttctgtgctttttactgcatagtatattatagttatctttccagtacctataagtccaccttattctttctagcggccaaatggaatttctgaatgtagcactgtctgaatatagcacaactgagtcattattctcttgatagatatttaggttatctccaggtatttgctactacaagctctgctgcaattaatgcccatgtatatatccttttggagtcctaccagtgatctatttttaatgatgtatggatcaccaaggaaatgataatctgtaaaaagtgcttcaagctgttttggtcagcagcaaatagatttgggcttagggttggtgtaggccgtgactctaacagagtttgtggtttgatatctaccttctccagaaagaatatccttggttactcccttgcttacagcctttacatgtatttttttttttttatccctcttgatggaagtggtaggagggaattgcagttatcattaagtgcatctcttctgggcaagtgcccagcatttcaagctagcaggtcgctctggtttccaaaatattagcatctcatattgtttccaaaagggaacagctctgagtggtctttgtcctttataggaaatcttttgcactagctattaataaaatttacttaggaaaaactttgaatactagtcactataagagcaaaatcaatctagttgttatgtacctattgttaaacagaatgtggaaatatgttagaacttaattgctttcattttttttaaatgaaagtgtataagtggatattataatgtgtatatttgggttaataattaaactataatggaatttcagtttattagcactaggcgcagttccatattttgttgattttagactctggatgaatatacaatttgttttaaatatgaaagtacgattttctgtattattgaacacaaagaattggtttctaggtatctggtagacttggaacccgaggctttgtggagcagggtctctgcttccttcacatccataatggaccagcacgtggctattacaggagctgagaaatatttgaactgagtggcatgcatttgtctgggctacttaaaaaaataagaaaaggaaaattaaggaaattaagaaaaagatggtaagtacctaccacataggctgtggtgagaacaaaaagacttaatacacatgaaccactcagaacagagcccagcccatggtacacattcaataaagcctagctatcctgattttcagtcttaaaatcatgcctactttttagggtaacaaatttaagattctggacattaaagatgatctagtctgcctgggatccatttccttccttctgagaatctgaaatgccttcctcaggcattggatgtattaccatctaaacttccctgagatggttgttcaaaaccatgaaagtaattacagaggcagatgaaaatgagagtcacacaacactgctcttcaaaggcccttgctgacacaagcagatggcacagtggccgggatgggccagtgctgactaagagggagtgtgtcgtccgctctgtactccgcgcaagtccctgatgtgtaagggcacaggcttacaggcgtacgaattttattccccattttgatcccattttgattctgaatgcattaaaaaaaatctgtgtagcacaaaaaataatctatgttgttgaaataacaaaagtctatatgcggtagttagaataacaactagcttgggatctgggatacgtaggtttgacttcgtgcctttgcagctatgtgaccttgagtaaatatttcccttctctgggcttccattttcccacctataaagggcctaggagcctagatcatcacaagtaatttttttttggctctaatattctatgatttaaaatcttgccttggttcttattagctatgaatgaagtgtaaatttccttttctatattatctttagagcttccaatttttgctctgagtacaaaggaagtggaggaagcaagattaagccaaagataatggagagagaaggttagaagagaaaagggaaaattacagatgggcatttgggttgaggtcccctctcagacttggagtgtgtgtaggaggaaggcaggtggacgccggaccttctaggacaggcatcgaaggctggtccatcagacatgcgctttaatcagtgagtctggatcgccgaggttggtgaagcatgttggtgaagaaaattgctgatggcttagttcttacaaatgtgttacacatttgcagtacagattttggtaaatgccatggtctccagatctggcattaggcatcacagtcactcaagaagttcactttaagggacagatttcaaggccctgccactcccatggaatcagaataactgggtgagacccaggaatctccaattttgaaaagctttccaggagatgttgctctccattgaggtatgtttgtgctgtcctgtaaagcctcttgccatcttgccataacccacctgtccgatgacatctccccacccatggccggcaactgcacccacaaagaactgctcactgttttctgaaacccttaaaacccttgatccctatctgctggcacatgtgcattccaggcccagaatgtcctttccagccctccccttcttcaccctgtttgtatgcttgaggatctgctgcttgtctcccaggagtttaagagctgtatcacttgtgagacctttgtcttccctcaggaagtaaactgggtccttgctcagggcctcgggggacatgctggggtcagaggattcccctagctgtgctgtcactatcttccccaccagattggagacacctctaacaggacctgctccttcctgaggaactcactttcccagatgctgagtatctggccttcagcagggtgcagacccatctgctgaatgaacgactgcgtgcaaacagtagcttccacttttatgcagccctcatggatcctggtgggaagcccgtcagttctcgagcaaggggctgttgggatggggtcttggcaggattcctccctggagttcagaatttgaatcttggtgacccctccctgaggtcaagtctctggtgcaaaggacaactgggtagaaggcactcaccctgcttcatggatggagtggaggaggggagggaatctttcctctgaggggagaaggtgctgggttgtttgggttcccagctgggttgtttcctggctccagccagactgctcttgtttgctcctgagttttattttaaccagattgtttaattgagacttcactagcctttaacttctggattgcctttggtgttcaagcccagaactctttcgtgtaattagagtcttactatttctacctagcaaactttttttttttctttttaaaaagattgatgcatccacatgttatgggggcacatatgatactttgataaattgatataatgtgtaaagttcgaatcatttgagaggccgaggtgggtggatcacttgatgtcaggagttagagaccagcctggtcaacatggcgagatcctggctctactaaaaatacaaaaaaattagctgagcttggtggcgggcctctaattccagctactcgggaggctgaggcatgacaatcacttgaactcaggaggcggaggttgcaatgagccaagatcatgccactgcactccagcctgggtaatggagtgagactctgtctcaaaaaaaaaaaaaaaaaatcagggtaattgggatatctatcacctgaaatatttgtcttcttattactacttaccaaactctttagcctcaaactgaaaacaattttttttcaaattaaaaacatcatataaaaggcccttcttttaggtctggaactgaaaattctttgaatattaccataaaggaatgtagtcaaatttcttcatttgattaaaaataaaaaggtatatcagccggatgcggtggctcacgcctgtaatcccagtgctttgggaggcaggggccggtggatcacttgaggtcagcagttcgagaccagcctggccaatatggtgaaaccccatctctactaaaaatacaaaaattagctgggtgtggtggcgggcatctgtagtcccagctacttgggaggctgagacaggagaatcacttgaacctgggaggcggaggttgcagtgaaccaagatcgtaccattgtactccagcctgggcaacagagcaagacttggtctcaaaaaaaaataaacaactcttgaaaccatctaaactgtatatatgtgtatgtgtttgtgtacatgtatgtacgtatgtgtatccatatactttttatattgagcactttttataatctcaatcttacataaagtacaaataaaatctataaaaatgattgctatttataataataggcaacatagctaaaaactgtggttattatgtaagcatatcttcaagataaattttccagctcctaagccctcctatacacagattttagagctgccattgccctagtgggaggtgatgtaaaaaaaatattgttttaaatgggtttgtaaatgtacagtctgcttttggtctcatcattttggtgtttttccacttcaatttgtcttgcgtcattttaatttgttagcacaatgtatttagtcatatacgtctgctatgaataaaacatctttttaaaaatggcccgggcatgtgaagtttgtcttacgattccccattttttttaaagctgtcattgtttggggtgtgctttctatgaaacttcagactttgtgttgagcccaggacagtagggtgtcatgcatttttagcatttttacaactcatactatacataagaactagaaataacaaatgaatctgtatatttttaaagagtgtttttattttataaatttaaaaaaataccttgtttttgatgtttttcagttgatggagttatggttgcttatgtgtttgattattttgacgggcaagtacgtatatttaggagatttgtaaccatgagcctagcattactgctgataaaacgaatccctcctttctaatcccattgctcttttcttgatgtaaaaactgatgcctggcgacagcactgttccccatttgacaagtggccttttattattgatctttggttgggtagcagcagttgccagagagaattgttcattgtggtcaaccagtgctcctgcctcagtcgtgttttgcttttaaccatgtcttcctggaatgacacttgaaagggcagtcatcatgtgttagcccagaatgaactcaccggaatcccacatttaccaaaacatatcctggatcctcagggcaggatgtcaccagaattctataatcctccagcagggacagtgagggatatcagaattccacacccaagcatgtgtgtctgtcctgctcaggattgtcttacccctaacagagagaaagtcttgctccattcaatggggtttccccattaggctttagtgtatttccccagatgatacttgaattacatctggatgtgtgtgtgctgttccctgtctaacctcggcagccttcatcaatgccggtgaattatgcgatggtggtggcggcggcgggagcagcagcagtggggaggaaggtccaagcttggagaggatgtgtgtttttatgggtgactgagttgatttgtgtgcagcgtggttatttgtgttgttaggcagtttacataataaagtggtttactcagcagttgcccacttctagctaacagagccaccgtgcattttgtatacaagcactgacaattctcccctcttctcctcccccacctctttccatcctagttcttgcctttgcttcccatagattggctttttgttttggcttaataactaataccccaccccatccccactgccacacacacataccttgtagtcacttttggtaaaatattaacattcatgaaagaatgcagttattttagttcatgcagatgaagcgaagaatttttttttttttttttttttgagatggagtttcactctcgttgcccaggctggagtgcaatggtgcgatcttggctcactggaacctccacctcccgggttcaagcgactgtcctgcctcatcctcccgagtagttaggattacaggcatgcgccaccatgcccagctaatttttgtatttttagtagagatggggtttctccatgttggtcaggctggtctcaaactcccgacctcaggtgatccgcctgcctcag

SEQ ID NO: 839 - DNA, 701 bp, Homo sapiens
ggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtaagcagatggagg

SEQ ID NO: 840 - protein, 98 aa, Homo sapiens
  VARIANT (1)...(98): Xaa = Any Amino Acid
ASPGPARSPAAPRVCPRPAGAGKMEAVIEKECSALGGLFQTIISDMKGSYPVWEDFINKAGKLQSQLRTTVVAAAAFLDAFQKVADMATNTRGKQMEX

SEQ ID NO: 841 - DNA, 65559 bp, Mus musculus
  misc_feature (1)...(65559): n = A,T,C or G
ccattcaccttttaaaacgtttatttttatcttgtatcttgagtgttttgccaaaggtgtattaaatatactccatgcagtcgggcgtggtggcgcacacctttgatcccagcacttgggaggcagaggcaggcggatttctgagttcgaggccagcctggtctacagagtgagttccaggacagccaggactacacagaaaaaccctgtctcgaaaaaaaaaacaaaaacaaaaaacaaaaaacaaaaaaacaaaaaaaaaaaaaaaaagaaaagaaaagaaaaaaatacccatgcacacagtatccacagagcccagaagacaccattggatcattggaactagagttacaatgtttcgagccaccatgcaagtgctggggtccaaaccatggtcctctgggagagaccttaaccactgagccagctgtccagctcctctaacttgttttctgagacatggtgtcattaaacttccttccaggtggagacatacacaaaatctacccctctccccccaaagtcttaaccacaaactaaggcacagactctgccagaagtcagtctagggaaccaactccgtgtgctcccttacagagcataaatgagggactatttataggagagtgggtgtccctcctccaaaggacacgctggaaaggggacttctccataaccacatagatggtgccctctcccttactcttccttggtctatacacaggagcctcctcctccaggtcacactattaaggcagagctgtatacatcaggtatatggtgtgggaagatacgtagaggctatcaacagacaacaagcccaacagggaatgatccttttgcaaagagaaacagccgaattcctaagatggtggttgcctgcctcaaaggacactcacacccaataacagacctgtactttgacgagactaaattccttagccaacaagctccaagaatcctcgtctctacttcccaattactggggttacaagtgcacatcaccacaccatgggtgccaggggtcagactcgggttctacgcttacaacacaagcatcttattgagggaacagctcccccagccctggtttgtacttttttagaaagagatcttgctgagaggtggtggcacacgcctttagtcctagtactaaaggcagaggcaggtggacctctgagtttgaggccagcaaggtctacagagtgagttccaggacagccagggctatacagagaaaccctatttcaaaaaaaaaaaaaaaaaaaaaagctcatggagcccttggttggctttgaactcacagagatcttcctgccatataaggtatattactctgccttctggtttatactttttgaagccctttgggacctgtgagggacattaacacaatcatgttcatcgggagccctcattttcttcttatacaaagatcagtctctccttctcagccaaatgtggcgacattttcttgcttggggaagaggtctgtgtaagatgaccttaaggatgtaccgtgaccttggatacctgaagtgtctatgtgcttgtgaaggaaaagaggccagaatgtgaaagacacagagaagtttggggccaaacccagggctcctgtgaatcagagcaggttccctgattgggagcatagaagctgttccagtgtgagaaacagtgtcactccgaagcaggagtggaatagactctcgctggaggctgaggtgggcaccatagagagcagatcctagagcagacactgcaggaaggcaggctctatagggagcgctaagcaggaatgggtaggctatgttgagccagcccactgttagtaatcaggctgggtcgcaatatatctagctggggatcttgaaacacctttgtcccagtttcttctttctctgttactgtaataaaaatactctgataaaagcaatttaagagagaaaagggttaccttgagtcacagttctagggcacagtacattgcacccacagtcaggaggcagggatgaatgcaatgctgctactgagttctttccccatgcttagtacaccccaggatcccagccactacctgcaatgcgcagaactcttctcacctcaattaaccaagacaatcgtgcacaggcatgcccaggggggccatcttgcagctcattcttgattctgccaagttgagaagtaacataaactgtgacaacctattagtgagagggcttggtgtatctattagatgagatactgtcacctgggggaacttaagtcaccttctagctgggaagcttgagataactatcagactagagaccttgaaacacctactaggctggaaaccttagggtaaaacccttctccctgtactctgaatctgaactcttctgtcaagtgtatatttcagagagatttgctataataagtagaacacattacatctcagcagtattacacctgcctagaatcccccagggaggggctgggggcgtggctcagtgggagagcccctgcctagaatcccccagggaggggctgggggcgtggctcagtgggagagctcctgcctagaattccccagtgaggggctaggggcgtggctcagtggcatggcctttgtatgtgagaggctctaggttcactccccagcactgaaaacaaagttaagttctaaaagaaagacatagattttccttgaagttgctactactgtgaaactttccagagatggaggctccctcctccactgctgacagttctgtgtcccatcctgaaggttagtgctattctcatcacacatgagtaatcttatttggtgagtgaatgtgtctgtgaagcctagatcacagaggcattggaaacctggccttgatctctctttccacttggatctccatgacttccctccaggaggcactaagagtccaggaggagctgggcagtggtggcgcacgcctttgatcccagccctcgggaggcagaggcaggcggatttttgagttcgaggccagcctggtctacaaagtgagttccaggacagccagagctacacagagaaaccctgtctcaaaaaccccaaaaaaaaaaaaaaaaaaaaaaaaaaaaaaatctaagagtccaggagggaagccagacctgatagcaagtgtgtatgtataacccaaggcctcaggaagctgaggaaggaggatcagcctgggctacatagtgagttccaaatcaccacactcagagaccttatcttaaaacggggcggggatagaggtgggaaaaggacaagtacagagagagccaagagcaagaactaaaagttggtcaaagggtagtgacccctacccctgggcacatagctagaggtacagagcccaggttggggtgacaagctagttgagggactggactgttggcatcctaggacattttactgctctgggataagaactttggaagtagtccagtactctcgagatccttgtgtcttctagaccttcaccatcaagcataaggggagaagaggtttgtccttgtgtagatgtggcagccagagaggctgctcaggaagtggcatggggagccacagggacagtagaactgctactggtccagatttatgctgcattaacctcgttccagttctacagtggggctgggcctctaccacctcaggttcatttcctcaggtctcttttagacagtgccagtgagcctcccagcagagaagggttatgcataacgcactccgcaattctgatttcacgtacgattggagacgtcgtagacacaggcgcagtgtgacagtaatgtcaacactatttgttgactcagccttcaggttccagctacagaccatgaacagaaaacctgcttagagcaccgactctgtgaagcctaagaacagaaaccgaggtcctgagagtagaagctggaggcagagaaggggacagaggcaggggcaagggctacattgcataaggttaagagatagtgtgactctgattaactgctcatcgctcaaaaactaaaggtccaaggctgctgcctcagtcatcatgactcagaaggactaatttaggtatttgaatgattatatcagaaagatatggaagtgagagcgagctgtgctttcaaggacattaatcaccagtaagacttaaacagttctggtctatagagtgagttctaggccagccaggcttatatagcaaggccttgtctcaaacaaataagcaagcaaacaaaagccccaaagatgtgataacttaagagacaacatctaaaatatcagtcgtaggaggtggtgaggtgactcagtggataagggtgcttgccgccaagcctgacgacctgagttcaatccctgggacctacttgatggaagcgattgtcttctgatctccacactcatgctgtggtacgtttcatagcaattcacacacacacacacacacacacacacacacacacacacacacacaattcaccaccaccaccaccaccaccaccaccaccaccaccaccaccaccaccannnnnnnnnnnnnnnnnnnnaaataggagggagcaaaggtctaaaggcctgtctgggttacctcaagttcaagtccagcatgagtaattaatgagtccctatcccagagctgattgaagaacaggaaatggggtaagacgatcccatctgggagataaggataaggatatgccacccccaaaggcatatctttttttaaaatgagaaatattaaatatgatttgatttaaaactatgtctttgtgtagggagacacatgctaggacgcatatgtcacagtgtggaagacagaaaactacctgttaagagtcagtttgtgctggatgtggtggcgcacgcctttaatcccagcactcgggaggcagaggcaggcagatttctgagttcgaggccagcctggtctacagagtgagttccaggacagccaggactatacagagaacccctgtctcgaaaaaccaaaaaaaaaaaaagccagagagagagagagagagagagtcagtttgttctctctactttgtaggtcctggggatcaaattcaggtcaggtcttacgtagggcttggctgcaatatgtagcccacctccactgggggaccggcctcaccagcctccccagtaaagaaggccaattatgtcatgtcagtaatgagctcccttctctatccttttgtttttcaaataactggatggtccttacttacagagttagcaataataaaccggaaaacctgttcttggaagacctctactgaccatgtcttcttaaacatctgcatttgcttatagggcagcggaagaggacagctaggccacttgtcttctctgtgtgacgtggggaaacgtcacctagttaatgttaggtttcaaacctgggacaaatgcctgaagcatctgctcaacacatcaaagtggacctgctacgaggttttcccagcatccctcagtccctaagtccctaccattacaggatctgctgactggcacgccccgcccacagccctggactctctccctttttgtatctttgggcctcctggttgctgcacctggttcccctttccctacacggcccacttcagggtctcctccactctggattcccccagatgtctctgcctctggctatgatctcccacaaatctataataaaccttccctccaccatccctaggaacagccatgttttctttctctccctttcttccttccttccttccttccttccttccttccttccttccttccttccttccttcctccctccctcccttccttccttcctttctttttccattcagtctagtagtttgtacttcctttgaggggaacttcaggctctgtcttttgctcaattatgttaattgatcttgcttatttaatttattggtaggggcttttaattatggatgtactctttgtttgtggctgcaaatattttctcctaattggttgtctttgaaactgtgctacctcgctcttcacacacatcaagtctttgtttcttttgcatctgttttatttgttttgggtattggggcggggatggggtgtacggtgtcatggaaaagcacatggaagtcagagaacaacttttggcatttggttctttctttctaccctgtgtgtcctggagatcagactcaggttttaggcttaggaaaaagtgcctttacctgctaagccacatctcaccagccttatttatttttcttctagattagatatcattacgtaatctagactgacccaaaccactatgcccagcttcctttttatttcctcctcctccctttttttttttttttttttttttttttgagacaaaatctgataccccagagtggcctccaactcctcttgtagctcaggctgtacttgaactcctgacactcctgcctctaccaaccaagtactgagattaaaggtctgagccgtcatacttaggtcttgcttgattttatgggatttcttttcttctcctcctcttctcctcttcctcctcctcctttgtctgagacagggtatttctacataatattggctagcttgaaattcagtatataaaccaggctagacttgaactggtagaatcctcctgcctctgtctcaggagtgctgggattataactatccaccaccatgcttggactttatgtcatctttaaaaatgtcattttgtccatatagtatctgagtgtgtataaggtgtgtatccactctacaggtttttcctgcacagcctatcaatagcatatttttggaaggcgaggcagtgatcaggacagtaaatgaagagaagaaatgtcattggctggggagcacaggagaaacgggaggcagaatacagtctggaagcttctggagttactcaggtgaaatgtgaacgtaggcgtgctggatgcaggtgagaatcagccagggcgggctcagaggtagattgctgcctagagttcccagtagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacacacacacacacagatttctactctaaaagcagaagcaggagtaggaagtcagatccagtagaacacatgaggaggaagtgtccaaagggtgttgaaagcatgacagggagggagtctcagatatggatgtcttctgaagtcaccctgggctgctttaagaggtgtcgttcattctgctagtagggctgggacagcccttccctgtggtctgtagaaatgaccaaacctgttgctgggatagatttaatttctgtgccagactggttccttactagctctaggaagtgtaacatgacagcacaatagtctttttatggagggttttactattacaccagtttgtttttggttgcctatttgatttttttttttttttttgctggacatgaacgagcttttaatctcagcactagagaggcagaggcaggtggatctctaagctagaggccagcctggtctccagagcaagtttcaggatagccagggctacacagagaaaccctgtcttgaaaaacaaaaacaaaaaaataagtgtgtgtgtgtgtgtgtgtgtgtaagtcagagcacaacttagcaagtgtttttacttgctaaggcatctcacaggactgtttttttttaattagatattttctttatttacatttcaaatgtgatacccttttctagtttcctcttaaaaaaatctcattccccctccccctgctccccaacccacccactcctgcttcctggccctggcattcccctatactggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagcagaaccttaacaacttatttttattgcatttccttatttattcgtgtgtaagtggcatgcttgtgccagaggacaagcaaagggaatctggtctcttcttcattgtttgtcctggccatagaacgagtcaggctgaaccgcaagcccctttacccagagagctaacttgttgacttaagaacattttctaataatagtaacagtcataaagataaagctgtttagaacaaaggttctgccacccagaccttatgctcctgttaccccaaaccttcagtggccagaggtgggactcttaactcccaatacagccgacttttctgttcttttgattttttttttttttctttgagggttacaagtaagtagctcacttagactggcctcaaactcactgtagttgaggcttagtctcctgttgcaatcttctgaatgctgggatgagaggcatcaagcaaggcttctggtagccagatttccaaagcctgttgccttcgcctctcccctagccacttctctcctataaacaggttagttttcaaatctcagtgaggggccccggggaccagcggggcctctatcagccacggccattttcagctgacaaaagacctgagatcaccggtgagctgaggccagcagcaggacgccacacgaggtggcgcacagccacgaccccgcattgacccaagcgacggagttcggctgccaaggggaaaggcagggtcacgcaaagcacaaacgtctgtcaaagccaagcaggccggtagccaaacctcggagataagcctgggagtgggcggagcttcttggcgaggagaggggggcgtggcccagagtccgggctaggcctgggagcggggcttctcggaggagagcagaggggcgtggcttagaaaatgagtatccgaattgagcgccgcccggctgcgaggcgtgccttttccgaggagaggatgaggggcgggacctaggagctgagagctgggcttaggggcgggacccacgagggccgtaccaacagcagagatttagaaggggagcaaaagcaagagggcctgcctcaagagcgcgcacgcggcttttgtgggcggggcctcggcggggttggccacgcctcacccccgcagcctcccgggccgtggtagcgcctcagtggtgcgggcttgcgtccggccccagtgcctcagagacctacaggaccgcgcgcggtgtgtgatctggtcggtaccgaggagcgcagggtgagtgaggaatgggggaacctcaggggatctccgcgataccgggtcacctcttgtcgctgccactatccggcttgtgactccggggagggtttttaggccgatctccgcacgactcacccggtgcggaaggcgagacttcccacctcggcccttctcctggggtggcgcttcccaccacgacctaacctgtcgcggggcgtattgggggtcgttctccttataaatgccttcacctgagggtcggatctttgcatctgcgggtggagagtcggtcctcaggactcctctcaggcaacgcaacagtccctcttcaagcctcagtttccccacctgtgcgacgggacttctggggagcagattatgaagaccactcactttagaatgagctcccagagggccaataggagccggcaacaatcaggtgggctcagtgaaggtgtcaccctgtgtgcatccctggggcagtccccctctcgggatagtgcctgcgacacacctttaccgagctcgcttgagcagcagtgacaccctgagctcttgggagcaactgggtgagaggttgtgatctgctaggcagcaggagaagggcatcttccagggaacttaacctgtattggctccccccccccctctcattttcttttctcaagacgactcagcattgtgtaagctagtgacctggactgaggatttcgggggacatttcagtgaaagcggtgtgtgtttgtaatagacccatcaaacttaagcgagtcgctctgagcctggccatgctgccagaataatgaaaacacaaagggagactcaactggtgggggtaaccctgggttcaagtgttcccaccatggcaggacacataacttctttgagtctgctacctgatcctagggttggctttttggttttggtgtgtgtgtgtgtgtgtgtgtgtgtgtgtgtgtgagtgtgtgtgagtgtgtgtgtgagtgtgtgtgagtgtgtgtgagtgacaaggctttgttatgaagcctaagctggccagcacctttgtagctttgtagctcttaaactgattgattctcctggctcagcctcctgagtacagaaattatacgtgtgtgccacacctggcctgactagggttttgacatttttgaggacaagagataatcctggagctgttccagtactttggaggttgaagcaggaggattgcttgagttcaaggtcagcaagttccaagtgagccagggctgtacattgagactctctcagtaaaactgaagagagtaaaggcgggcatcctggctagtggtattgagaactgcgctggtctttgtaagccaagtggttatctaacctcggggatttgttcttaaatacacagggcataattcctggagctattggtagctttggttcattaaccacatataaactctaccctcatcgattctctgttgatctttgccttgctagtggaaaaatggcttagaaagcacaaaagtaccaaaccagtgaacacagaatggcccaccgtggtttggttgttattccagtggctcctttaaagagatttcactttctctcttttttttattttttagatttatttatttattatatgtaagtacactgtagctgtcttcagacactccagaagagggagtcagtcttgttatagatggttgtgagccaccatgtggatggttgctgggatttgaactccggaccttcggaagagcagtcgggtgctcttacccactgagccatctcaccagcccgagatttcactttctttggagagtgagtggctcttaacttttataccctctgatactggaattggtttcattgagcacattgctcaatcattatcaaaaagtggccagaaaacaggcccacgttggagaggatggaatattatcgtataaccctcacatctggcatttagaaagaggtatatgtagactgcagaagatgccaagatggactttggtacctggaaatcacaggcttgatggcagctaggatacctcaagtgaagacaccctggtagtaggagtttataaataaacatccacaggagatgtctgtggcctgagaaacctgaaattataggcccactcgctctccgtggagggtttcttaactccttgccaatcaggatctgcattcgttaggaaggtctctgtgtgcttagcagctagactgtttgaaaaggacttcctgccaagagcaaaacatttacttactaaatccatgggacatgttaacattgcagtattaagtctagttgttttgagacaaggtctcaggtgtcccaatcctcctgccctgcctcgtaagtactaggactagagccaccttcatatagaatctagatctaagggatgacctctctttgtgagagcttacccagttgtcattctctttgtcattctagaggcctggcatgtaagcacttgacacaccaggccaggccggtgggcctcagctcagtgagatgtaactttccctagttttttttcttctttattgattttcatactggtatctattgtatattgagcatattccttcacacacacacctatgtggctctgttttttcttttccggtttaccatgtgctcgacactttaccaacccactcaagaactcctctcgatttctgagttcaaggccagcctggtctacaaagtgagttccaggactgccagggctatacagagaaaccctgtctaaaaaaaaaaaaagaagaagaagaagaaaaccaaaagggtacaatatcacaaagcacaacagagtacacaccatcttgtatgtcttactacatattgtataatgtttgtttctttgtaaaagaaatagataatttgtatcttagagacagaaaataccttttcattgagttttttgtttgtttgtttacttatgtgtttgcttgttttgtttttaaccccttgttgtttgttctgtgacaaggtcttgctgtgacaaggtcttgctaagtagccccgactgactccaaacttgtagcaatcctcctgcctcagcctcccatgtgttgggtttacagggtacactgctgttgtttgtcacctgacagaaatgctggagtagaagcactgggttaaaggcagcttatctgctaaggcaaaccataggtacaggctgggctctgatttcttcatcagtaaggctggaggaagaaaccctgttccatccatctcccagattacctcgggtgcttgctatgcagctcaaagtgaccatgaactcagctcactatgtagctgcagatggccttgaactccttgtccttctgcctccatcttccataggttagggcttcttccttccttcctccctccctccctccctctcccctcttcctcctcctcctcttcctcctcttcttcctctctctctctttctctctctctctctctctctctctcttctcccctcccctctcctcttctttattttaaccaaggtcttgcctctaagtagcagccctcctgccccagtcatcttaagaatgatggaacaacaatatcaaccaaccgggtctggtgagatggctcagtgggttagagcacccgactgctcttccgaaggtccagagttcaaatcccagcaaccacatggtggctcacaaccatccgtaacaagatctgaccccctcttctggagagtctgaagacagctacaatgtatttacatataataaataaataaataaatctttaaaaaaaaaaaaaaaaaaaaaacaatatcaaccaaccaagctcccagggactaagccaccaactaaagagtacacatggctccagctgcatatgtagcagaggatggccttgtcatgtatcagtgggaggagaggtccttggtcctgtgaaggcttgatagatgccccaatgtaggggaatggagggctgggaggcgacaatgggtgggtgggtgggtggaggaataccctagtagaagcagggggaggggagatgggatagggggtttcttctgagtgggggaactggggtaaggggataacatttgaaatgtaaataaattaaaaaaaaaaaaagagtgatgggcttccagatgttcaccgccatgcccaggtagaaggttgctgttgattcttgctgttcttggcaggcttaggtccctgtggaatgacacttcagaggccctcagggtgggtgggtctgtgtgggtttgggttcagccccttgagaacctggctggggagggaagcaaacagaaaactaaatatatatggaggagtaagccaagtttctcctgaggtgataggtgtgaggtgctgtgtggtgctgagtattcatttggtaaccacctggaagggaacatgagcaatggagcatgcaagaggcgctgtcttgggaggcagggaactgtgccaggctcttggtagctggtgccctttgaatcttgatgagtcagtagggatcctaagcccatcaaagaatcctggtgcacaccacctccgggatacctaagatatgggtggcgggaggccggggttgcatggtgggccctacctgaacaggttttatgaatgtgtgtgtgtgtacacagggatagtctagcttttttttttaatgctaagttttggaaattgacacactttatcaaccaggttatctccttacctcctgtttctttgattaaatttttaaaaattacacttatttatggggtgggcgcctacaccatggtacatatgtggaagtcagaggacaacttggagaatcagtctcctgccaccatgtgggacccagggatcacatttaggccgtcaattatggtggcaaatgcctttacccattgggccttctcacttccttcttagatgtttttgttacagagtcttctgtgctgtaatcaaggatggctttgaactcaacactcctctgactttagcctatcaagtgctaggaggcctgaggaaggcattagttctagagctagtattcaggtggtcgtgagcttcctggcatgggttctaggaaccaagcttgggcctctagaagaacagcaagttcccttcatggttgagccttctctgcagcccccatcatcccacctttttaggtttaagtttcatgcattctgaacatgaaaacacaaaaattatgcatactactagataacccggtgttttatttttctgattgactattgtcatacattattgacagcaatctcctttattcactaagccatcttgcttgcccacttatttcaatttttaaaaaaaaatttttatttattttatgtatatgagtacactgtcactgttacaaggtggttgctgggaattgaactcagaatctctggaagagcaatcagtgctcttaaccacagagccatctctccagcccacttactttggttttaagatatgtcttaggtggaggtcagtctttcagttggcattctgggggctgagaccttccaatctatgtatgatatagataagagaattccctgtgcttttcagaagctaagcagtttctgactggggatgtagctcggttggtagactgcttacctaccacacaggaagccctgggttccatccccagtactgcataaagtaggcagagtggtacctgtgtatacttcaagattcaggaggtggaggtaggcagatcaggatttcaagactatcctgggaaacagtgtgttggaagctaccctgggctaggtaagagcctgtctcgtaaaaggagggagggagggaggaaaggaaggaagaagggaaggaaggaaggaaggaaaaagaagaaaggaaggcttttaaagtataaaggataattagacattactccagactctggtgccttagcaatgatctgttccgtgagtggacaggtgatagcctgcggtagagcaataatctggaagattggctcttgtttgcctgattgtataacaggaagaataatagacaaggtgtgccttccaaggtggaacctacgtcattttcttgtgagtgaaagttacaggtggtattgagtcatttgactttatgtaccctggtcaccagtgtctgtagccctcacctgcctaaccccttctcagagttcactctccacatcatccctccccgggacaggtcatgttcataacaacaggaacttgtgtggctttgatcttcacagtgtgtattgtgtactgggtctgtataaaggttcactggaccgggtagatacataaaaactcttggtaaccttcccggcacacagatgcaatggttgagggtcacccagggtcggttttcaacacagcaaacagacgaaggccccgggatacacagattacattagccaattgggtcaggctcctctggggtggcgctgagggaagtactcattccaagcatctcaggtttctggcctgggtttgtggtctggtgaagcaggtagtgtgttggctttgtttaagggttcaatgactgtttataaaaccacgaactcacttaggtcagtggggggtcccttatataatgtgatctgaagcctgggcatgtggctaaatagaagacagtgcctgttatgggcttgctcactgggcattttcacctccctccctccctccctccctccctcccttctttccttcttttcttcctcccttcctttcttcattcagagagagagtatgtgtgttttcatctgccatgacgtgtgtggacgtcaaaggacaactttgtgaagttggttctccattatgtaggtcctggggattgaactcaggtcttcagtcttggcagcaagaatcttttctcactggtctataaaaaatatttttggagactgggacctcagtactgtagcacttgcctactgtgtggaagggcctggggttccatccccagtaccataaagacaaataaacctatacaatatgatctgaagatcatatagtacttcagcagccacaccctgtcaccaacatgaagtgagtgaccctgccatttttctgttgctggtcctcagagctctcgaggaaaaatgctaccttcccttttcccttttattctgggtctgcagctgctattaaatctttgtctggttttggtcttcaaagttgattctataattgcatggtctgacagcagctgttgtgccagtccccaagtgggccttaaacattttttaaagtatttttatttgttattagtgtgtgtgtgtatgtgtttatatggtgtatgtgtgtgtgtgagtgtgagccatagccccggtatggaggtgagaggacagcttggtggagtcaggtctctcctgctaccccctccatttatcccagggattgagctcacattgttgggcttgcacaagcaagtgccacctctctctgagctgcccagatgcccacttttctttctctgagtcaggattttgcctagttctaggctggccagggattcctaattctctgcttctccccacccacttcccaagatctgtccatggtactattgctagattgacaacccccccccccaatcatagatttaaatatctctttttatttttatgtgtatcagtgttttacctgcatgcatgtatgtgcaccacaatgtgtgcctggttctggtggagccagaagagggtatcagatcccttggaacaggagttacagataacctagcatattggtgctgagaactaaaccctgccctctgcaggagcagcgcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctgcctatccagcgctgggcttacaggtgtgcatcaccaggcctcatttgaactctgcctttttcctactccttgactgctttgcttaaaaagttttgtgtagccagagacagaagcaggtgctctctgtgagttctgccagcctggtctacaaatcaagttccaggacagcctgggctgttacacagagaaaccctgtgtccataacaaaaaaacaaaaaagaaattttgtgtttgtgtttgctgggagctatttggttggctatgaaagcagggattcatgtgtggtggtgccttctctacttttgagcaacaacccccccctcccctgcgccacccccttgctcaagagtttggaactaccctccgtatctcttgagtaaatatttttcttctttgtttatgttctacaaagtagccagcaacaaaagtagcctagccaggcatgcagctcatatctgtaatcctagtccttggctgaagtaggaggactcaagtctgaggctatcctgggctacatagcgtgccagtgtctcagaaaatgaaatgaagtaccttctaccactgtggcagtgtagttggaatggaaggtgagtcgagttatttctgtgaggagaagccagtgcttggaagagtgccagtgataagcactccactggtataactacgcgaatagatgagagtgaatgaaccttgcattgcatcatcctcccaagagtattgcccatcttcgtcctgtgtctcagtgagcccagatgtccagttaagtcaattttttttttaaggagacttaattcttttatttttcttgtacaaaatccttatgtagtagccacagctggagcctgggtcctctgaacagagactctcgtgtgggttttcacaagatgatccgtgaattcctgataaggagacttggtgaagacagtctctttccagaggtcgggggtcaggtagctgtaagtcttgggagatggcatcaaaggtggccttagcaaagttgcccagggtggcagtgcagcctctggctgaagtgtagcagtcatctatactggccaccatcaggagtttcttgggcacaggagcagagacaatgccagtgcctctgggggcagggatgaaatgtaccagcacagagccacagcggcctgtcacctttcatggaacagtgtggggcttgccaatcttgtttccccagtagcctctctgcacagggatgatggaaagcttggccaagatgatggcaacctccttggagcacttaacaccaagaccaacgtgaccattgtagtccccaatagcaacgaaagccttgaacctggtccgctggccagcctagagtctgcttctgcactggcatgattttcagaacctcatcctttagggacgcacccaggaagaagtcgatgatctcagactccttaatgggcagggagaacaggtagatctcctccaaggacttgatcttcatgtccttagccaggcggcccagcttggtgacgaggatccactccttgtcttcagctttacttccacgagccccgcggcctcaaccatggccatggctttggccgaatcctccgcgcggaagctggaagctgccgccgccgccgcggcctcctaatcctgggtccccgggtcctccgggccctcccgctgcaccgacgtcatccgccacttggtgttttcccgaagaagaagcgttaagtcagtttttatgaagattgtcattctgaggtacattagctatggatttttatttttattttttggtttttgtttttcaagacagggtttctctgtatagccctggctgtcctggaacttgttctgtagaccagacaggcttcaaacttagggatttgcctggctctgcctctgcctcccaagtgctgggataaagtcatgcactaccactgcccagttatttttactttttttttggtttttcgagacagggtttctctgtatagccctggctgtcctggaactcactctgtagaccaggctggcctccaactcagaaatccacctgcctctgcctcccaagtgctgggatcaaaggtgtgcgccaccaccctccggcctatttttacttttttgtattaagaattttgtgtgtgtgtgtgtgtgtgtgtgtgtgtgtgtgtgtgtgtggtatgtctgtgtatatgtgtgggtgtttggtgtgtgtgtggtgtggtatgtctgtgtgtgtggtgtggtatgtctgtgtgtgtgtttggtgtgtgtggtgtggtgtgtgtgtttgagtgtgtgtgtgtgtgtgtgtgtgtgtgtgtgtgtgtgaaggcatcagatcccctgcagctggagttataggtgctggggcaagtggtggtaccagatgggaatcaagagaagtggctgggctggagggatggctcagtggttaagagtgttggctgctcttgtgtgatgtgacccaggttcaactcccagcacctacatggcagctcacatttgcctgtaactccagttccagaggatctgacaccctcacatagacatacatgaaggcaaaacacccatgatccacgaacatgtatgtatgtatatcatggactaaagtccctgagcagaaccattcacccagggcaggaaggcaagccaggctccatgtcggagggaccaagtagccaacgccttcacatgagactggtcctctccaacttgggcaaagcatctcttcccactcactgccctagattcccgagctgtaaccctgcttgccacaaggcaccattcaggctctgccctttctcctatgcccagagttctatctacccttatagagtttcgactgagcctgaagtcccatgcctttagctacataggtctaggtagagtaccccatgggtaccaatcctccattctttaaaagaagtaaaaaaacgactctatttctaactgtgagtggtgggggaggatgaatgtgtgagcacactgtccttggaggctgtaaagagcaaccgctcccctggagctgggcgtacaggaagttgagctgtaggacccctcccaccttcttttctttctttggtttttcaagacagggatttctgtgtagtcctggctgtcctggaactcactctgtagaccagactgtcctcgaactccgagatccaactgcctctgcatcttgagtgctggcattaaaggtgtgtaccaccacccctaggctcatttttcttctgcctcctcctcttcctcctcctcctcttcccctccctcctcctctcccttcttctcctcctcttcttcctcctactccttcttttttaaaatttacttattcttgtgagggtagggtgcatgttggaggtcaggataacttgccagagccagcacatggtcccagggatggaactcatgttgtcagagttggcagcaagcaccttttagctaataagccatcttgctggcttctgatgggcaaacttgtaaatggtttagtaattgtagatcattttatagacatcacaagaaagtcttctatcctgtggttggagatggcccactttttactgatgtgttcaagttgtagacttaaaacacagtagggctctagatgccggtactcagtgatggacatgaccttggctgatgcttacagagataagggtctccagtaacccaagctagccttgagctctccactgatctttctgcttctaccctggcagagctgaaatgacaggcgtgcacaccccacccccacccctgtgcatccccagccatggcagctttaatgcttagctatgctctgatgttaacctgaaatgcagacagacactggggtgaggtgggcctcagaacagtacagtcagagccctcagtgcagtgacagtctttggcctgacgccttgataaaaaattctggactctggttttggtaagtctcacaaattctgacttgtagaagagatggctagaagccgttttggggtagaagagaggctcccgagtccctgtttctctcctagtcacaggagaagtgcagctgttgttgatgacatagtctgaaggattgtcagccctggaacccctagcaccatcatgagccagccagccagtcaccttgtcttccgcagccaatgacagctaggatggcagcagaagtatcagagtcccacagggtccttgtgtctcaccctggaagttgctggctaggggaccatgggtaatttgcttggcaaagtgttggtctgcaaaatgaaagataatatttctctaagcagggttgtcatacaagagaaaggacttgtattgtgtacttagtatggcagttgatgcacagtaggtatacatggaccttggtgtagtgagctggcagtgacacagtgcgtctttgctctaggtggatctttcttctgcagttctgactgctgtttgtctgcttatttgcagtactagggtttgaacctagggactcatgcatgccaggcaagcactataccttcgagccacttctccagctcctcactgggtgactccaggcaagtgctccaccactgagttcactctcagcttcttgcttttctgttttgaaactgggtgttagtggtccaggcgaaacttgaactgcgtaaagcaagctggtcttgaactctcagccatcctcctgcctctgcctcccaagtgctgagatttgaggtgtgtttatcaccatacttgccccttaattctgcatttgtatgtgtttgtgtgtgagtgtgcatgctcaagtgtgcatgtgtgtttgtatatgtgtgtacgtgaatgtttgtgcacaggtattgtgtgtgtttgtgagtgagcacgtgtgaatgaatatgtatgtgcacatgtacaggtcagaggaagccttagtaactgtccctcaggagctgtctgtcttctgtctcgtgtagtatttgcttgcatatttgtctgtatatcactgtgtgcagtgcctgttggatcagagccctggacctggagatctaggaatggaacctgggtcatcttcaagggcagcaggttctcttagccacctcgccatatctctggctttccatgttgctttttttggcacatggtctctcattgacctggcacttagactggctgaccaatgagctctaggcatcctccagccttcttcaagtgagctgacaacctcttttggccttgaacatccgaactcacacgcacgtaagcacatacacatatacactattgaacacgaaatacatatttttaggaataactactttaaagtgggatgcacaggctgaaccctcgtgacgtgggtcctggggatgggacgcaggtctccaggctttcagtgcaagcagtctgctgaccgagtcatttcctcagccctgactctttaatcttagtcagtcttacccttacagcaattgcgaaatatcacagcgtttctttctattctcaccgagctttcccgatgctcacgtcttacataaccacaccaaaatgatcaagagccggaagtagcattggtacagagtgattcattaagtcagacacactggcagacttcctttgtgaggggccagatagtacattcttgaagcttgtgagctgtaagatctgacagctgagcaactgctgttttatttagcaaaaaggcagccataggtggtgtgtgagtgagtgggcacggccgtgctcgcgagagaagtctttgagaaagtaggctttgaatgcaggccaggccttgctgatgcaggaaggtgccttggtggaacggcgcccccttccgctctagactgcagctgtgatggttgatcttaactgtcaaaccagaatgcctgggggttgggctgtggatgtgactgcggggcttatcatgattatgtcatcaatgtgggaagatccatcttgactgtgggtgagcctggcccatcatgaactgtataaaatggagaaagcgggttggaaagatggttcggaggttaagggtgtttactgctcttacagaggacctgggttcagtttctagcacccagatcatgcagctcacagcagcctgtgacttgagctccaagtgacctcatagcctctcctggtctcgaacatccaaactcatgtgcacaataatcacacacatatacacataactcaaaataaaataaatatgtgtttttaactgcgactttaagatggagcaagtgagctgaacactagcccgtattcagtgtgattctgattattgtgaccagctgcttctcggtgtagaccaggctggcctttaacccatgccggctcctcctgcctcaacctcccgagtacgtggattacaggcctgagtcaccacactgagctatttactggggtttccatcttgccttcgtacctgccatcctaccacttggtcacctgccatcttgtattcctttggtcaagaaatctggcatgacatctggggcttattttagactcacccagtcaggagctgggccttggtatctggcctgtgttttggggggcagggagtgccccccaagaaaggcagacgtccactctggcttggtttgttcttctgggacacaggtgtcctggcctctttggactgttctctgtggtccacagctaaagtgtgccctcccagctccaggcctctctgcgcagtcgcagtgtgccttgacaatgacgagctgctgggaagcaactgctttctcaaagctaatttgatagtaagtcagaagccttaaagataatccctttggtggctggagggctggctcagtggttaggagcactgactgctcttccacacttcctgagttcaattcccagcaaccacatggtggctcacaaccgtccgatgccctcttctggtgtgtctgaagggtgtattcacataaaacaacaacaaaaaaaccctcacttcctttgattcagagtgttggtctgagtgtcgtatgcttatatacatacatgtgcgtttgtatgtatttgtgtgtctcactgtgtttctgtgtatgtgtgcacaacgtgtacaaaaatgtgtctgtatatgtatatttgtatgtgtgtctgggtggtactgtttgtggggtattagcatttgtctgagtatgtgtgtatgggtatgtgtctttgtgttaatgtatgtatttgtgtgtgtatgtatgcctgcacatgtatgtgtgcctctgtgtgtgtatgtatgtatatgcatatcagtgtctctctatgtgtgagtctgactgcatgtgtctctatgtttatatttgtatgtctgcacctgtgtgtgtgcctaggtatgtatgtctctatgtatctctgtgtctctgtgggtatgtacatatgggtgtctgtctatctgtctgtgcctatgtgtgtgtgtgtgtatatgtgtgagagacaagctgatgctggggatggattatagggcctcacatattcaatcactgggttcattttctatgtaaatttcaaggcattttctcctaatccctgtgcaacagagagggccactgtggggagttatcaagccccagcccctccacatttgcgctgtcctttcttttctagctgaagtctgctctccagtctgagagacacggtagacctagttcactactctttgcctttgatctgaacttcttttgtctctcatgaccctgacatttttcagaaagtagggccgtgtctctgtagtcagtccctttatattcgtttggtgttttctcagtcacccgtcatccattcatgacttagtgctagccaagttatctgctgtgaaattcaggttttccctttgtgtttgtttttcgagacagggtctcactctagcggtggctgtcctcgaactcactatgtaggcaaggctgtcctcgaactcacagaggtctgtcttcttagtgctgagatgaaagccctctaccaccatgcccatcttcagattttccctttgtgatcaggcgttttcttattaatcatcaaagttcagttgggggaggggcagaggctgctgtcttctgtcttccctgatagctctctgctttatttttgaggcagggtctttcactgagcctgtttcatcagttggctccactggctggccagttctcccgtccccagcatcttctcgtcttcctccatcccctggtgctgaggttgcagacacactcggacacttcagctttttacatgttgtacagtcagcactttatccactgagttgtctgcttaggccagctgttgcgagttctaatgcctgtggttggtcaggacagtcacagcttatgatttggatctggcttgtgtccccaagtggcttgtgtgggaagctgggcctccagtgtcctgatgttggcattttaagtggtggggccttcagaaaaaattcaaatagatatttttatttttaaatgatgggtgtgggtacatgtgtgtgaatgtagttgaacccaggagagtatgttgatccccagaggtggagttacagggactatagacaggaacagtgggaagataatcggagttttctgtgattccttgtgaaagactgatgaacatactgttctcatgagtttggacagtctttctaagagaagctgtagtttatagtgctgcatagtattccattgttgttatggaacatataggtgtccagggtgagccctgctgggaataccacagtgaataggctaccaggctgagtagggaaacatcttctaagcagagggttcccccatccaagggatggggaatccccacccctgttttcttccctaggaaaataactttagagctagacaagatggcccacgagtcccagcacttgagaggtacaggccaaaagatcaggtgtggctcagctgtcagagtgcttgcctccttttctacacgcacctagtatttatttatttatatttgatatttatttatttatctatcttgtttatctctgtagatctctgtgtttagatgagtgtgggtgtgcttgtgccacagcctgcatgtgagtctgttctctccttccaccctgtgcggtccagagatgggacttagagcatcaggcttggcgggaagtatcctcacccactgagccatctcaccagccaccagtttctgagaatctaaagctaggcatggtggtgcacgcccttattcccagcactctggaggcagaggtaggtggatctctgtgagtttaaggccagcctggtctatccagcaagttccagggctgcaaagtcacaccttgtctcaaaaatccaaaacacaaaacaacaacaaaacaagccacagtatgagtatgtcagcctttggtcagggtatgtgtatatattttgtgctgtttatatataatggaaggggtaaattctacagagaatataccccacatagggtgaaattctggctggagattttatccttgaacctgtaaccttgtcttgttttgttttgtttttttcaagaaaggggttttctgtgtagccctgactgtcctggagctcacactgtagtccaggctggcctcgaactcaaggatccgcctgcctctgcccattgagagctgggactaaaggtgtgcatcaccaccatctggcaaccttttttttaaaaaatgagaatattttatgtgaggctagagaatggcttgtgggaatgggtattttcctcccaccatgtggaaccctgagattcttagctcatcagacttgctggtgagtgcctttatccactgagcccacatgcaggctagaatctgtaactcttgaccagagggagggggacctgagttcaagggggtgatccatgtggaggctagaatgccacttgggcagaaagcgtgggtgccagggcaggaaggcctgcagcctgggattccttcctctcccgggaggagcaggtcttttgtccatggagacttggcagatgaggagtccgacctgatggagccctgggaggcaggcagcgcaggcaggacgtgctgctcacttacttctccacggtctgttagagcaggatgcctgcttctgagcacagcacaggatgttcttggggctgctgtttttaagtgtgtgtgtgtgtgtgtgcacacgtgcgcacgcgtgtgtgtgtgcgtgtgcgcgcgcgtgtgtgcacatgcatgtactctcgaatgcccaaggaagccaaaagagggaatcagatctggagctggaattacaggcatttgcaaattgcttgacatgggtgctgggaacctaacctaggtcctctggaagaacaggaagtgtatctaaccactgagccgtctctccagcccctacactttgctgtttgatagaggatctctcacaggcctggaacttgctgagcaggctggctggccagggagccccagggacttgccagtctttgttccccagtgcatatgaccagctgagcacttttcatttgtctttgttttgttttgaaacagggtttctctttgtagccctggctggcctcaaactcccagatatcctcctgtctcccccaagtctgagttctggcatttcaggcctgcatcacaggtagggcttatgcagtggggagggaactaagagctcctgtatgctgggcaagtgctctacttagtcactcctccagccctagcccaaggccatcccctgaactgcagagagggtttcctgctaagtcatgctttcactggtgcctctcctggccaccttcctctttagcagcagtgcctcagccacgtgtcagtcagatggttccaaattaagccctgttatatggggggaaaggccatcatcacccaggggcattgtagacttggctaggaaaggttctctaggacactaaagtcaaggccaggctgggttggcacaggaactgtgaacattgacctggagaaggcttctcattgggctactgctcacctagctctcctgtttcctcagggccctgggtctggccttggcccattgtcaaagctcaggtctcagtgcacaactgtccgtccctccctccccaaaacactgccttttgctccttactgaattctcactgaatgcagccagcccaacaagtttgtgcttcctgttctgtcagttaaaaaaaacaaaaacccgatagccctggctagcctggaacttgctgtgcagtctaggttggccagactgttggcctcgaactcaaatcttcctgtttggtttgctccaccacacccgacttagattgtaatcttggaatttgcccattatgtatttccagtcatcagttgcttccaaagagacattatgtggaagtcatcgattagatggtcaagtggattttctaaggtgggacccagactctctgagagactggaggcatggctgcttgaggcctaggctcctatcctagcaaatccagagaattttctgtgtgcctaggtctgaggaacttggctggaactatggtttgagctcagaaaatagaggattttgtttgtttgtttgttgttttttgtttttattttaaatgaaatggagatctcatttcatggttttttcttgatcatctagaaattatagtaaaacaatttgacattacttacaatttataccatgtttgttcagtttaattgactctattgcagtataatcctcacaggtaattttagattagtcttgtttaaaaaaaaaatcaaggccaggtatagtagtgcacacttttaatctcaacactgggaggcagaggcagaggcaggggtggggctcggtgagcttgaggccagcctggtctacagagcgagttccaggacagccagggctacacagaaaaaccctgtcttagaaataaagtaaaaaaaaaaaaaaaaaaaaaaaaaaaaaaaaaatctaagggctggtgagatggctcagtggataagagcaccagactgctcttccgaaggtccggagttcaaatcccagcaaccacatggtggctcacaaccatctgtaacaagatctgacgccctcttctggagggtctgaagacagctacagtgtacttacatataataaataaataaatctttaaaaaaaaattaaaaaggaagaaaagaaaatcaagttcacaccaaaaactaccttacgtcacatgcagtgttcaataaagttgttaaagttagtctttgttcacagaaatttccctctagacacacagcaccaaataggctgcaccaccatgtctgacttgagactttgtttgtttgtttgtttgtttgtttgttgagtccaggttataattttaaaaaatcatatccgagaaccaggaaagccaacttgaatgagaaacggtgacaggcaaatgcaaacaggaagataccaataccagaaacaagacctaacagaggttgtagagctgatgacagtgacagaggaagccagctgtgttagggcacacttgtgatccaagcacctgaggccagcctcagctacacactgagtttgagggcaacctgggctacatgaaaccttcaaaaaccaaagtggcaaaaaaggactagggatgatagttgcctagcacgcacaagacctttggttctgttgcatatttccttctgtggctgtgttaaggtactgtgaacgaaaacagctcaggggaggatggggttccggtcacctcacacctcacagcccatcgttgacagaagttagggcaagaactcgggcaggaagttgaagcagaaactgtggaagaacactgcttcctggcttgattctctgctcatgcttagctagctttatcatattataccctagtactgactgccaagggaatggtgctgcccacagtgggctgggctcagctccgctacatcaattagcaatcaagatggtttcctgcagatgtgcccacaggccagtctgatctaatgaagactttcctctcagatgaatgtaggctagatcagggtgacaaagctagctaggactggtttttgccatcccgacactggggcacagagagacggctgaatattaccatccatgggcttgaagatagacctatatagacgctccagtctgaactaaaggaaaactgggtttatgttgacagcgagaacattggaggcttgtgagaggataagtcatgaagggcactggagagaggccccattggtgaagagtgcttgtacccacatcaccctgtaacatcagctccaggggaatcctccactagcttcttgcaggtatatatgcatatagataaaatttaaaaatatatagaacttaatccagaagcagaaagagaggttagggctggggaaaagagtccagtaagtcatggctaaaacgatcctcaaagtgcaaaagacgtaaaactggcagattcaaaaagcccatcccccctcctcaaggaaaacccagagaaatccataccaatagcacatgggttcacatgccagcctttctggatagcctgcccacggctggctcccagtcacccttgcgggcaggttgccttagggaacagtttccctgagcatctttggcaggggagctgtttattatgcaacagtaggatttgtttctttgaagcctccagacctaggcagagttctgtgagcctgcacagaccctctttcctccctgaaggttcaagatggacaccaattcccttggtctaggcatctgtgagttgaactgctactaagctgtttgatagtgaccgctactcggcagcacgtggagccagaggaactgctagcctcttccccactttgctgtttttgcacaagtgtctgactcatcctgctttgcatgctggtccctcctcagttcagtgaagtaaccagaagttgcaaaaatgctctctggaggatggccttgcttgcaaccttactccagtgttgtaaacagtctcctggagaaagagagagcctttctgttacttaaaaggtgaataaacaaaaaaacccatcttttaatcccagctcttgagaaccaaaggctgattgatctctgtgagtttgagccagcctggtctacagggtgagtccagagtgaccagagtggcctaaaggaagactctgtctcaaaacaacaacaacaacaacgatttttaagttccttttgtgtataccagtatgtttgtgtgagggtacagatctggagatcaaagggcagcctgcaggaaccgagtctcttctatcatctggatctgggaatcaaactcaggtcccttaagattggcagcgttcgtctttacttactgagttgtatcaatagcctcaaccctagaacacccaattatcaggctgtccaccttgcactcagagatctcttgtctcttccttgctagagtaagaggtgtgaagccatcacacatggacctctagatagatattttctgaggttggctgactcgcaaacatgggacctgcttcagggctaaccacacactatggcttgaacattaatcttcctacgtccaccagctggccaggttccgccaacctagtaaggcaaaggggcagcagctcagctccaggacacggtcgagcaaggtggacagcttaattattggctatttctgctagtggatgctgtttgaaactgctcagtggatctacaggcctaccgagcctggctacttctcttgaggtcagagtcgagccagctgaggaaatggagggaccaagataaatggttaaacaagaagaggagctttttgagttagggtcccaagtagcccaggctggccttgaactcattatgtagctgaggaggactttgaactccaggtccttcagcagtgacctgctgggataacggatgtgcctccatgcatggctactagttattgcttctcctctctaggacggggtcttactgtgtagcctggttggccaggcgtgttaagtatgttatgcactgctgtgaaggatacctgacaagagcaatggaatggaactgtttattttggttcatggtcaaggggacagcgtgacaggagggcatgacgggagcttggggcagatggtcatactttatccactgtcaggaagggagcgaggtgaatgctggggctcagcttctttctcctgcttcactcagcccggaccccagcctgtggatagtagcgcccgtcttgggggagtttccccacctcagctaacctcatctagaagcttcctcacagcccagaggcttgtttctatggtgattctgaatactcccaagttgacacttggtatttggatggggtggtacacatctgtaaccccaccctcaaccccagcacccgggagacctaggtgggaggattgaacctttggagttagcctgggctacactgtttcaaagtacaaatgaaaaaagaaaaaaaaggcaaaaggacccacatacagggagtggtctgaccatcacaagccccttgcagtggcctaaatgtaatttggggggtaacaggtacatcagcgcccctgtgccccacactctgctgccttaggaactgcacacaaggaagggcagtcagccctgtgacttggctttgtgagcatctgtctgctttccttgaaagccaggggcccaggctaccctagtaagacaaagagtccgtatctgttgcctgctggctctgagaggaatacaagtacttgcttttccgtgttagcatatcattcctgagcagaccccagctggctgcagttgacttggaatgtctgtttcatcccacttctgtgagacagactcttctagaagcaggtcctacacacctcctggtctcaatttgtgaatgtttgacagaaggtgcgtgggcttatcaaagacgaagataaggttggacagacacagtcagcactgaatacatagtgtggttgaaatatttaatacagtattcttgaggacatgagagttaaatttgtcctttagtgtcagataccaaaaaaaaaaaaataaaggccgggggtctgggccggcagtatagtagaacccccttcctgaggctgggagctttactcaatggtggagggcctgcctaggattcccagtgatgggctggagacgtggctcagtggtagagcagtatctaccctgtgggaagccctgggtttcattcccagcaccaccccataaggacgagtaaggataagttgagatgagagccagctcttagaaaagcatttgtctaaaatccgagaagaagctgactctcaagtgggctgtggactggaaggacagataccccagattgaggctggttggctcagtgcctgaagctgtgacagcaaacggaagctgacaggaagccacctcaactggcctgggttgccgagatatgactcaggcatttctgactgagttgtgactggagcagcgcacactcagtcacaggactatgaggaagcagaagggacagcctgcccctggggttctggacctcatgctgttatgaccctgatcagatctacctacctgccaggttttcatgctgaataggccagctgagcactcccaagaccatgtctggttcagtgtctccccaggactgagaattgaggaaagcttttttttacttacaactgtggtgtgttacagcgtggggggtgggagctgaagcctggagggcggggtgcgggaaaggctggggtggcatttccagttggcctctccttgcgggggtggggggcagtggatgacatttcattctgttggcaatgatggatgacttcctgtatgaagcagagatggtccctgctttaacaatggcgtgaaaagtcagcgagttggtacctcgtaggcttctcgggggatgattttgtccaacagaccatgaaactgtcttgagcacctctcatgaagccaagatgttacagtatttgctgagttagtcatattaaatacagtgtgtgcacacgtgcgcgagtgctcctgtgtgcgtgtacacaccagtgaacaaccttaagtagtgttccacaggaaagccaactcagtcctctgccctctgccttcccagcactgggactgggatcactggcatacctggctttacagctttctatttttatttgtgtatgtgcttgtgtatgaaagcgtgtgtgtgtgcacgtgtgcgcgcgcactgaagcatgtgtggaggttagtagacaattttcaggagtatattcttgttccaatgtgggtcccaggcgtggaattcaggtcattgtgcctaaacctgctgagccacctcaccaaccatagtcagctttgttttttttttaaatacaagctccggggtttgaacccagtttctcagatttgcaaagcaaacacttagtcttatcaaccccttaaatatacttttaagtcagtttatgatggtagtctcaggacctgacccaagcatcagttgaaaatcagctgtgatcaacggtaaatgaatgtccttagagccttggcatcaaggatattgtgggcatcaggcttgcaggtctggaagcctagactgtgtcgctaggacctatggatgtcaaaccagctcagggtttccaagtaccagatgccaggctgtgtgttagagactcactgttagttggacctgttcttgaggcccagggtctccagttaatgtattctagtcagccagaatctccagggccagttgcaaagacttaggaccatgtcccattcagacaactcaagagcccagcctttggggcaaaggagctatctctctactggggtcttaaccatgtctttgtctttgtgggcatgtgtgggggtctttgcaaacaccacagccatcagcgtgttgattcaggagaagcaagagggagcttcgattcaataccactaaggcaggcttggttcaaattttaggcagtttcttttaggcatatttaagcacagtataatttaggaaaaagtttcttgatgataattaactcagtcccatgtgtacagcaaagtttaagacataattacatcagagctcttgtaaaggacaagtgacatcttccatagagataggttctgtagacgaacgaagaaagcaggctcaaggtaaaccgtgctcagataaggctctcccgaaggatagcctgcagattgacggagataaacctaagagtctgggagagctgttgtggctgaacatactcagagcacggaggtcaccaggccttaaccgcatccattcctagccttctgggcagaaaacaggttacacacacacacacacacacacacacacacacacacccctttgaagagacaaccatgtgtgtttaaccatcctggtttccttggtgcttaatggtgagcacaaggacctacgtgtgtcctacagagttggagatgctcagggacaccaggagccatggtttctgttctcatcattggctaaggggctcatcctacctgtgacagagccaccaccatcagggtggtttgcgggtgttagctcttccctaggctgcagtggcctggactgaagccttgcggaggcaacttcccctgctcggtctgtgcgaccctcactctgaagcgttcagatgggcacctctgctggcctcggggccactcgactccttactgacatctgctggttctctcctgacagttgtgtcaccaacatgggggactctcacgaagacaccagtgccacagtgcctgaggcagtggctgaagaagtgtctctattcagcacaacggacattgttctgttttctctcatcgtgggggtcctgacctactggttcatctttaaaaagaagaaagaagagataccggagttcagcaagatccagacaacgtgagtggtgccctcagagaccccttggctatctacccctttcactggacatcctggacaccccttccttccacactgttccccaaggtggggcgcaggacataaggagccagcttcctggggtttggggcgtgaccctctgcttttgagtcttctttaataatcagacacacaccacccataaacatagagaaaacaaaggagaactggatttggtctcaccttttccatcaacgatttactgagacactgtctcctaagatctttgcccactatgtcccaaaccctctcagaatctgtggctgcgactgaagtagactctggcttccttgagtttatggtttcttgctgggccaagctggtgagatgctgacccttattctctctctctctctgtttcttggtcaacttagtggccccaagcgccactctctgtgagcacttgatgagttcacggtgtgatttacccaccaagcctgagttccccttgctgctgaatatgtcagcggccgaggatagtttggaccacgctaaggaccactgagatggcagtgcatgaagaagctgaggcctgcaatcccagcaattagagggaggcaggaagatcaggaggtcaaggtcaggaagatcaggaggtcaaggtcatcctaagctgtgtgccagcttgggctgactctgtacgagagagagagagagagagagagagagagagagagagagagagagagagagagagagagcgagagagagagagagagcgagagctagcaagctcctaccatggtggtacacacctttaattcagcactcaggaggcaggggcagcagatctctgtgaattccaagccagcctggtctacagagtgagttcaacgacagccagggccacacagagaaaccaaccctgtgtcagagagagttctggaagtagtttgtagataggtattttggaatgctttcctgtgcattgtctgcctggatagtcaccttctgccccttctgtctccccttaggcagtgacaggcccaggtggctaaaaactagcagaactagacagaggaacacattccaggacctccctcgtatagcagcttggaccctgtcctacaggttgggtcacaccgggggctagggacctaggaagggtgagcgagtcggaatccagctggtcaggatgctttgtggctgggggggtgggggaggaagagggcagtgcttgtggggaaaatgtgtcctactgaagagaaggtgagccgtgacctggtcccaggctccaagctgcccctaccctctgggcaaggctgtgggaccgggagctgcctccctacttcatcacccactctcgcgacatcactggctccagacttgtaaggtgaacatggtggccaagctggaagctcaggcctatccccaccactggggagactgaggcaagctgaggggtgcctgtacaactcagagactttgtcttagaaataaaaaatagggtcaggaaaacagcccagtgggtaaagcttgccaccaaggctggcaacctgagtttgattcctgggacccacatggtagaaggagagagcaggctcctgcagtttgtcctctgacctctgctagtacactgttgctggggcaccattctctgtctctctctctctccctccctccctctcatcactcatacattcacagagtgcacacacacacacacacacatataaatgtaatttttaaataaaaagtaaaaagactggaacacatctgtaatcccagaacttgggaggtaggtgcagaaggatcaggagttgagagtctcagctatatagcaagtttgaggctaggctggagtctagcctggactataaaagcaagaagcagagctgggcgtggtggtgcacacctctaatcccagcactcgggaggcagaggaaggcggatttctgagttcgaggccagcctcgtctacaaagtgagttccaggacagccagagctacacagagaaaccctgtctcgaaaaacaaaacaaaacaaaacaaaaaaaccaaaaaacaaacaaacaaacaaacaaacaaaaaaaaaaatagcaagaagcagccgagaagcgagagtgatataatgtgctttgtagaagcagatgatgagaaacttcagtgtgccttgtctaagcagggcctctagactgcagctctgatctgggctggacagacacctgtttctctcctccctgaggctgttgcaggaacccagcctgctgactggatctttagggtaagactaggaaacagtcctgagggtagagccacccctaggctgctgggaattaaggaggacagagagctggaatccagcctctccggctggggctggacctgggtacgttcctggggtggggacactatttgtggtgatatctgcccacctggagctaaagggaccagtagcctggccccaccctccaagttgaccttattctaccatgtatgaaatggaggtcgcccctgatccccccacaagcatatgaggtgcagaaccaccgaccttttccaggttttagcctcagttacagagcaggctcaaggccaacctaggcaacttcagcaagaccctgtctcaaaaaggttggccagccttgatggcacacaccagtaaccccaacacaggagagatgggggaaggaagattaaacaattcaaggtcgctgggcaaggtggcatttgccattaatcccagcacttgggaaactgaggcaaatatggttagctggttcttagcttggctttttacatttgttttgatttgtgaatagcagagtgagtgagtttattagatttgttaaaatacactgaacacgtatttttgttgttttgcggtttttttgttgttgctgctgctttttttaattttaattttaatttttaatttttttttaatttttttaagacagggtctcctggtgtagcccaggctggcctcaaactcacagtaattctctctctctcctcacttctggggtcaaaggcacatgccagccggtctattatacttttttaagttgttgatttgtttgcttatggtttttcaagacaggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgaaaatacaaaataaataaataaataaataaataaataaaagcagaaaaaaagttagatttaaaaaattcagtatctgaaacccatttattgcaattgatcaatacacatatgcctctttgtggaggagaactgggtaaattcagatataatttgcatttaataaaatccctcttctcgttttttcgttcagtgctaaggatgaaccctgggttgtgcacccccagttctaattttaactatacacatggatcccagggattgaactcaggttaccaggcttggcagcaagagcctttacccactgagttgtcccgacagccccatgagtcttgacatccacaaaattaggtagtcagtctcatagtcagcaatgtcccatcaccccgaagcgccccagcaccagccttgcagctgcctcttacatgccacccatctgagaacggcatctttgcccaaacccagccttggctccatgtcagttcttggcttctgtccacttctgactcacccatgaaacacgtgtgaaagaaactccagcccgttgtttcatagtttcctatgatctggatttggccgattgtgcccctctggggcttgtttagaaaagccgcaaagactctcatttcctcaagtgacctttattttgggatccgctctcctttaaaatcgcagcactgcctggagtcaaggctgcaggcggctcttacgtccgtctgtctttatcttggcgcgtcagcagatggaggagcatctgggggtcttggttcttccagtcagggacaccctttttatatagatggccttgcacctgtggtcactaagctagaaacacagatgtgtttcttaaagaaaaaggcatggctggaaggagtgctcaacagttaagagcactggctgctcttacagagggcctgggttccattcccagcactcacatggtggctcacagagggtacctggttacacacatggtacacagacatatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacttctttgctgtcttggctagggtttctactgctgtgatgaagcaccgtggccaacaggagcttggagggaaagggcttatgtagctcacagatccaagaagccaaggcaggaattcaaacagaggaggaatctgtaggtaggagctacaggtgccgaggccacaggggagtacaagggtcaaggagcaccacagccagcagagtaatgatctacaagaggcaagaaaagtagttcacaactaagtagccaggattggtttgaccttagggaattggaccccaaatagtttattgtaggcacatctaagcacagcatgatacagtgacaaccctcctggtgataattaactcaatctcactatacaataaagcttaagacgtaactacttcaaaactctttgtaacttacatgtgacatcttccataaagatggagcctgtaggtttgactacatgtgataaaataggttctgtggcttgatgagctcacactctagggaggatctggtgtggtctctgtcacactgatagcccaaaaggtcaccaggccagccttctgggtggatggcgagtgctgcttaccggtttgctcagccttagctcttatagaacccaggatcaccagcccaggaatggccccacccacagtgactggggcctcccctgtcagtcactaattaagaaaacacgctacaggtttacctacagccagatcttatggaggcattttcttaattggggttcctgcctcccagatgaatgacattagcttgtgtcagatcagtaaaattagccagcacggtggccctggttttttttgttcccctttccttttgtcgtctcactagctcaggctagcctctgctatgtacctgtgtagaggatgacattgaactctgattcttcctagtataaatgtcccagtcatcgcaatggcaagttatgtggtgctgggggtggaacccagggcttcgtgtggtagaaaactactcggcccactgactatatccccagctttctttgttgttgtttttgtttgtttgggttgtttgtttgtttgttttggttttgttttttgagacaaagttgctctgtagtctagactgaactctgtcctcacgtcttagcctccaaagtgctgggatcggagatgggcaccaccacctggcccaaatctttttcaaatttaattgctgccccctccccttcctggccacctctcccacaatccctccccacttctcctctgagagggtagagtcctcccatcccccatcaagtctctccaggaactaggatttgacctgaggcccctgtcagctctcgcccttagctggctcctagctccctttgaagtggctcccctgggagcgtagccctgtggagcgctacctactggttttcatcatagctccacacagacagaagccggccatctatcccagcggggagctgctgtccccttctgccactgttctcatggccctttctgcctgttaaccctgtggcctggagacgttagtcaccagacagccaggctctacaagttcaaaagcagcttcctgggtccctcccaggcaggggaccatcccaggaggaatcagttctaacacacagaaaattagatttgagttgcctcggctttcagaagtgctgcttctccttgcctgggactggagaaaaaaaatgcacccccttgaggcatctgggttctccctgtgactcagagctccccccccccttcctctcttcttgcccactctggtggcctgaagctgacttcagagacgcctgctcccagtggagggctgggggtggggtggggggctaattggaacctttcaggctctgctatggagccatgtggtgtctggctcccacaacatgggccagctgccacctgcacaacgctctggggtctgggcctgggtaccaagaaaggggtttcataagacacgcaaccttttgcttgctgtccccactgcatggggcaggaagggaaagtctatctccctgtagtggccaggatgtgcctgggtgccagagccccagtgtctttgactccccagttctctccaggggctcttggagcagcgaagggtggcttattgttgcgacctgcacagcgctctgtgtcagggctgggacagctttgttctccatcctttttttctcctaatgggaaagggggagggtgtggggagcagggctctgatataaacagttaccaaggagactgagtgggggtgtgtatgtagaaaggttctcgccttccctcagtccatggtgtgtgtgtgtggtgggggggtgttaccccagccgcaggggatcatgggaggctgcagtctcagttcggagtcctgctggagctgccagatgttgcagagttcacaggctcatggggacagcggcaggcagaggtgccgaagaattctgagaggacttctggggtgtctggtggcactttcagagtctctgggcccaagcagcctaccccatcacactgagaatggacaaaagcgaacttcctttctgtgggctgccagccagctgccgcagagctcagtgcgggaccctttttctttaatccctgctgggaacgggagcaccatggggtgtgcatactcgtctcagccgctggaagagcctgtcctgcgaagaaggtcagtttcagccctagttcagatgtgtggggagctcatgggccaggttcacatggctgccatcatcaccaaagggagaggcagctccctgagctagggccaaatgggctcctgttagttaaccccctgggtgggtgctaccaggtctgcttcctggagctggctaggagttgttcccaggcaagaagggctgcccaggatagacatcgtgtgattgtccagcacagggtcctctgactccgtttgcccagaggccactgcctctgctgggttcatatgagtgagggcgcagatggacagtccttcctgtccccagggcaaagcagagctaattaaaggacagggtgggcctcagatgtgttcaggtgtggatggggagatggctccgttaagtccttgctacacaagcgggagtttgatccccggaacctgtattaaaaagctgggcattgaggtaggcttctaatccccatgctaggaaggcatggggtgggcaggtccctggggcatggtgtccagccagcctaagcagcgtggtgagctgcaggcaagtgagagagaccttgtctgaacaaaggtggacagcacccgagggccacacacatacacacacacacacacacaagaaatgcacagtgtcacggccttttctcccagggtcaagggtgagtatttccaggtaaacctgtccagcaccctcaccttaccatagtcagagccagctggcctggagtttggccctttccacccacagcaggacactagcctcagggctgggcccttgggagcctgctgttgtagctcttgagaatggagcccagccttttgtgtctctctggctctagcacctctgtggctttgtgccaccttaggctgctgggcaatttcagatgaaatcacagactggcccagatagctactcactttccaagaagacctttgtccccttgagtgtcactcaagttccaggtgcctggcaggactcaggagatactgcagagtctagttaaagtagctaaggccttcagggactagggctgggatgcctgtcacatgcctatgtggtgacagggcctaggtttgcagccagttctgcctctgacgtggctctcttctcctgctgtgattcccctgggctccagctcagggacaggacaggcccttggaagccagagatggcacattctagtccctaccctcagcatctggcatggagcccttgcctgccctgggtgctggggctggagatgggattcctatggatacatctgtctttttgagaagagccaggagctggcttctcaacccagagggaggagggagtgggaaatgtccccagaggctgctgtccacctctgtctgccagatactgggtgggtgacctggaccggccattgcaggaaagccgtgaattgtgtgtggagtgccaggcagctcccgttaagttattaaagccagccctcaaggcaagcaaactgaatatgtggagggaagcgccacgcgcatgtatgtgccctgttatgacagtggccttgatgctaggggaggcagggaaaggttgctctgaggaagctaatgttgtgttgaaggacagtaggggttggtaggaaggctcagagaaggccaggtcaggggtcatcaagtcttacaagtgtagtgacctggccagagaagttaagagctgggttttcttctagaataccttctctcataccggtctctactcgggcttcccactttttattttctgaaacggtttctctgtgtagccctggctgtcctagaattctctgtagaccaggctggcttcgacctcagggatccgcctgcctttctgcctgtgcctctcaagtgccaggattaaaggtgtgcgccaccaccgcaggcggccgcccacttttcccctgagtttgtctttgtgtctgtgtgagggtggccgctcatactcatgcacatgatgtccaggtatgcagaggtcagaagtcacctcaagtgctggaaaccttaccagactctgtgtatatattctgtgtaagtatatgcagctgtgcgcacatacaggctagaggtagcacaggatggccagcttgtcgtggtgtgggatgcaaactctcatcctcatgactggggatcaagccctcttcgttgctgggctatctctgcacatgcacagccctccccccccccccatacaccccggcccacatctcacactcctatcccctgagcacacttggttttctcccattggatctcccattggctcactgtctcaggctggagctagagcacctttcagcttgggccctgtctgcctgagatgaagtcaagggaaggaaggggacagaagatggagagggaagagagaggagccaagacgctagaaggagaacgtgggcacataaccaggccagccttgcgctgtcctgcggctgaccgatggccataagcgcactggtgattcgaggcatatgacggagtgattataccactcccagctgttggctctgccactagggcctagcacaggtggactgacccctggcaaactgccaagggtcgcacagcctgtcacgcccatcctgcaacagcgtccccatcagactgtcttgtttttcagggccccacctgtcaaagagagcagcttcgtggaaaagatgaagaaaacggtgagactcctatttctgcttttagcagagcatgtgggtggtgggtaccaggggggcccaggagagggctcggcttcctgacaggagggctgagggctactggaaccgagcaggtcaggatgctaaggacatcttcatcttaccacagcaagagagactttagctcctgcaggttctggtatcttgtgaatgggaatcatggaccctcacagataccaaaggaccacatccactgttggatggagggctgctgtccatgcttgccatcactcaccttctcgggttttttaagatttattttatgtatgtgagtctattgttgctaccttcagacacattatagcccattatggatggttgtgagccaccatgtggttgctgggacttgaactcaggacctctggaagagcagtcagtgcttttaacttctgagccatctctccagccctcaccttcccttcttatactcagtgttaggttgtgttttccttgggtcagagtgtgatcttgaaatgagcgtgaggttcctttgactccagctggagttctttgggtgacacctgccctcttccatcacagcatctatgacagccaggagagagaggacccttaggagggctccatttgccaggcctgcgctgtgtctccatccccattactgactccgtgtgtctgccttttccctcagggaaggaacattattgtattctatggctcccagacgggaaccgcggaggagtttgccaaccggctgtccaaggatgcccaccgctatgggatgcggggcatgtctgcagaccctgaagagtatgacttggtgagtgtgccccaccctgctgctcaagtgtgagggaccccgtgatgcctcttcctcggctatggaaggtgttgaatggtgtcatctcagagagctctaagcccgtcttatgttgaggctcttagtaactcgtacgttaaagctgaggacagagtcatggtggggctgggagaggctatggttagggccagtggagtcccttctcatccatacgccattgtgcccatgctgttcctcacaagccagtacaggatatggcagaccccagccatgtccttaagggctagggcaggagcatcattgcccctgactctccgccagctcggcaggcttattcttgtggtactgcctaccccatccccttacacagctggctctgtgcagtgcacgaaaccgccagcaaccccgggaagggagggagcaggtggcctaggagtagcctcgagcttccatgtaaggtcactgacagcacaaactcaccccagtgcccttctggagagacgtccctgtagggtgccccttgtctcgtagcctccctcccctgaatgcccactcctgccatgggggtcttcttccatctccagacttggttttagattgatgggagaggtatgaagggcttcctggcaagccttcctgcctgctgctctgttccacagcagtgggctcaggccgaggtggtgacacccctgtctctctaggccgacctgagcagcctgcctgagatcgacaagtccctggtagtcttctgcatggccacatacggagaaggcgaccccaccgacaacgcgcaggacttctatgattggctgcaggagactgacgtggacctcacgggtgtcaagtttgctgtgagtccccacagagccctgtgggcacatgccagcctgtggcagctccccagaaccctagcattctcctgtggaaaccgcccctctctgttcctccacacattgacagggcaggtagcttccagcagaaggcctgagccttcctctgctggagccactcccagagtgtcccctccgtgctaccagctggtccccaggaacactggttacgggatgaaaagctaaaacagtataatttgtccaagcaaggaagactggagcctccagctaagctgggtttgagacataggactggttgtaaaaggagctacctctaggctgcaggtctcctaaacagccatcagctgttctcagggcccatagagccagagacttccagtgcagggtacagtccaccccgaggacatcagatcccaccagacaggctgcagtcctggcctcagagcctctctgctgtccacacaggtgtttggtctcgggaacaagacctatgagcacttcaacgccatgggcaagtatgtggaccagcggctggagcagcttggcgcccagcgaatctttgagttgggccttggtgatgacgacgggaagtaagtgccacaccccagttgcgcgggacctagcctggcatgtgggcctgcctcttacccctagcaggggtgagagcaggctggtggctagcctggccaaccctctcctctcctctctctccagcttggaagaggatttcatcacatggagggagcagttctggccagctgtgtgcgagttcttcggggtggaagccactggggaggagtcgaggcaagtgcaaggccacagctggggcccttgggacacagtgaggtgtggtgtgtgtggcaagagctcagacataggatggggagacccttgttgtaggggaaggggctccctgaaggtgagcggggtgaagtggggtctcccttactgtccgtgtggcatcaccaggacactggctttcctcccatctgtgctccatggccagcctggcctctcaggccctcggtccacctcagctcgtctcttacatctgccacagggtcccctgctgtcacacatctaccacccaggtctcctttagctcaagccctttctctctctggctcaccccgaagcttccctcttccctgccctgaccacagccttggtttctcccttcccagcatccgccagtacgagctcgtggtccacgaagacatggacacagccaaggtgtacacgggtgagatgggccgtctgaagagctacgagaaccagaaaccgtgagtgtgggaagggacgtggggagacgcgtgtccctccagagtcacgtgaataagcacagtggggcacccctatcgtgtccgttgtctggaagggtacaagttgcccaaggggcaggtgctagtccccactcaggccctaggagctaagccatgttaaaatcgggcagaaagtcccattccttccttagaatccaccaccattgggcatgcagctcaaatggctgagtgcttccgtaacacatgtgaggcctgggttccgttcccaggacggcataagcatgggcattagcagagggtccacagctatctcatcctcagcggcatagcagcttgcctgggacacatgagaaagatccaagtcatgtcgcccgctctgacccttcctacctctcggtgctgcccagagtcatgctggagccctccctagtcatcctggtcacacggagtcaagctagccatcctgctggcccagactcctccacttgtcactcgcagccacactgtggtccctgaatgtgagggtgaaaagcaaatgacatgcagccatctcaggacctaggcagctcctaccgctgcccaggcccccataggcagtgtgcagagggtctcaagtttcttaggggccagcctgctttccagtctgtgtccctttggcttacacatttcattacacttattgggtggggacagcccatgcagtattctgcttggctctttcatgtccctggaaggctcagaggcctccccaccagttcttgctctcggggatcgtataagccggtcccaagcgagtcactgatctcctatcttcccatcagccccttcgatgccaagaatccattcctggctgctgtcaccacgaaccggaagctgaaccaaggcactgagaggcatctaatgcacctggaattggacatctcagactccaagatcaggtgcctgcttcctccagtctcccctgcggccagcctggccccaagtcctctgcgtgcttcctcttgactcttgcactcccgtctaggtatgaatctggagatcacgtggctgtgtacccagccaacgactccaccctggtcaaccagattggggagatcctgggggctgacctggatgtcatcatgtctctaaacaatctcgatggtaagttccagaactgaggaccttgtctaggcctgaaagttgagccttcaggtgctaaaggcccacgtcccaagacaccatctgtatatctggcttactgtctatcccctgtgatagttatagaagacctccttggccaggaggcagagccagcctgcttcccatgtagctggaaaagccatcagccaccacatcctcctggacaagggctgcgaaaccaagtcttgtgtcttaggcccggggttctcaactctctcagtggctgtgggctgctggctccctgctcctgggcctccatcctcactcataaatgtaagaactggggtcagcagccctcggcacccactaggtagggcccgtggtgcacagatgctagaggatgctgtaacacacccaagtcctgcctctgccctcagggacttccaatcagagctcatgaacctggagctggtttctgttcaagctagccactcccctttccccagcacatacactgtgcttcctctaagacctggcgcctatcatgggcacttcctgcctggcctgaagttcaagcctgacagaaagcttgagccttgtcacacacagtcagggaggcaaatgagggcaggctggggtgccagcttcctgctcacaaaggcctgcagcatctaagggggcgagcctccaacgccatcctattcatctcctgctgcagaggagtcgaataagaagcatccgttcccctgccccaccacctaccgcacggccctcacctactacctggacatcactaacccgccacgaaccaacgtgctctacgagctggcccagtacgcctcagagccctcggagcaggaacacctgcacaagatggcgtcctcctccggcgagggcaaggtgagcctgcgcacccctgtctccacatcccgcccactacacacacgctgcccccaggctgcccatcccctccgtccgtgtccccccaggagctgtacctgagctgggtggtggaggcccggaggcacatcctagccattctccaagactacccgtccctgcggccacccatcgaccacctgtgcgagctcctcccgaggctgcaggcccgctactattccattgcctcgtcgtctaaggtgaagggcaccagctctgccagggagggcggtggccaccggatggccgccgaggaagggcctctcgggggttgaagccccgctcacaccagcccttcctccaggtccaccccaactccgtgcacatctgcgccgtggctgtggagtatgaagcgaagtctggacgagtgaacaagggggtggccaccagctggcttcggaccaaggaaccagcaggagagaatggccgccgggccctggtccccatgttcgtccgcaagtcccagttccgcttgcctttcaagcccaccacacctgttatcatggtgggccccggcactggggttgcccctttcatgggcttcatccaggagcgggcttggcttcgagagcaaggtaaaccatgggggcgctggttcgtggtcagcccgggccgggccaggccagagctccccttaaccatcgccgcacccccgtccaggcaaggaggtcggagagacgctgctctactacggctgccggcgctcggatgaggactatctgtaccgcgaggagctggcgcgcttccacaaggacggcgccctcacgcagcttaatgtggccttttcccgtgagcaggcccacaaggtgagatgggcggctgcgcccgcgggctgggccgccccaggaaggcggtgctgtggggtcccgaccctgctcaccgccgccccttcccccaggtctatgttcagcacctgctcaagagggacaaagagcacctgtggaagctgatccacgaaggtggtgcccacatctatgtctgcgggtgagtacaagggacaggggaggcacggggtgctaaggatccgcctatggggtggctccacccacaaccttccgccacaccttcttgtcccctcttctccacctagggatgctcgaaatatggccaaagatgtgcagaacacattctatgacatcgtggccgagtttgggcccatggagcacacccaggctgtggactatgttaagaagctcatgaccaagggccgctactcgctggatgtatggagctaggagctgccgccccccacccctcgctccctgtaatcacgtccttaacttccttctgccgacctccacctctggtggttcctgccctgcctggacacagggaggcccagggactgactcctggcctgagtgatgccctcctgggcccttaggcagagcctggtccattgtaccaggcagcctagcccagcccagggcacatggcaagagggactggacccacctttgggtgatgggtgccttaggtccccagcagctgtacagaaggggctcttctctccacagagctggggtgcagccccaacatgtgattttgaatgagtgtaaataattttaaataacctggcccttggaataaagttgttttctgtatttgcctggtgttgattgagtttttatatggggtcagtcttgggatctgctgcagttagacaccccaccccacccccctcagaggagccaagagtcagtgccttgctggggccccaagccttgtgtcccttgcgcaaacacatccacagtccatcagatatctccatgcctctcttcctttattgaggcctagagcccgaatcctgcaagctgggctccaggcccaggccttcctcagggcccacagagcccacaaagctcagggggcacagaagggaaccccctacacaaggggtaaccccaacctgctgccccacctggcacacaggtcaaaaagcccctttggggctggcatcagatctagctcagtccttcttgttcccgtgctgctggctgtggaacttctgatgcaccactcgcagggtggtgaagaaattgccgaggaagaggaggaggaaggggaagccgcacatgagcacctgtagggtagggaaggaaggccaaggtcaggacagtcaaggtctagatgggacctccagcacatccatccctcccggacccctggctcacctgccactccttgcactccgggtcccgggccaagttaaacaatgtcagcgcattgaagagttgccagaactgtaaaggacagacagagtctgctcagtaagtgtcgtgttcagtgggggccgagccagaggtggacacccaacgggtggatgaggacaccccgtgtgacttacgtgtccaaagaagaggaacggaagcaggaaggtgaggcctctccacatccaagactgaaagccctctgtggggggtattaaaaaagcagaggtagtggctaggctggaaggatcgggtaccttcctcaggaaagcccgctccccccatttccccatggctgcacaacagggccaactgactcacctacggtgagatccatcgtatggcgctcgcccagggctcgcaggcggtacaggcacccgctctgatagtaatactgcaggaattgcacaaagcctaggtggcacaaagcagcacggtgagcatgttagacctgctccaggccgcagcttctctgcccccttgtcccctccccagcaagggaactcactctggtacatggagaaagacaggaactggttccggaacttctggtacatgagtccatctggcctacatttcgggagaaatcagaggaagggaggcataaggcccggatcttccgcctcacgccattcccctaccagctgaggtctgggtcactcaccaggtcagcatgactcctgacaggaatgtggacacataatgatggaaaacccaccagcctttgatcctgtaagagggcatctgttaggtggaccggaccccacagagagcacaaggcgtggcacgacccgccctgctgcgcatgcgcacctggaaccattgttgatgaggatgctctcccggatggtcagcgtgcaataataccagaccagcaggaagttgaaggctgcgtccgtcaccctggggagtggggagcaaagaactgataccagagccttgcccctgacactgtcccaacccagaccgagaccgagaccctcacctggagttgagcaggaagcggcaggtgaaggagatgacgatgaggatgatggtgaggtagagcttgaatttctcgtactcgtctttgtaagcgaacctggtggggagagggacgtgtgcgttcatgggcaggtcgcctgaggcgggggaaggtcacagaccagcctggagaatttgacccagaaactaagaccataccaaccaacccaagtcagggtagaggcggatggaaccctgggtgagacccagcccttggcaacgacctccacatacttagcctgcttgctcagaagtgtcacgttgacattccccagaaccagactcaggtacaacctaagggacagagagaggcctcggtgacagaggaacaaagagcgcagtccagaacttgcagtgtccctgtggccgtgctatattgctctaaactccagggggcgccactgagcaactacacatccttgcctgctcctgaatcctgccctccctccaggtaaacattgtctctagccctaaggtgttttgcctgggacctccctctgttggcaccttgagagccctagccgagccatcctctgggagaaaccatccccatatcccagacttgggtctgggcatggggagttggcatctcaggagatgggctccatcgctgtttgtttgctgttatcctcgtcttgttttgattttttgttttttcgaaacagggtttccctgtgtagccttggctgttctggaactccactgcagaccagtctggcctcaaactcagaaatccacatggctctgctggattaaaagtgtgtcccagcaccacctagcttctctttcttaatgtgttatgtgtttgtgctgggattaaaggcgtgcaccaccactgcccagcttatcttcgatttttcaacctcaagaaactcagcccggagtgagtgcccttcagtgtgtcccatacatagccacctcgttcccacctcaatggcctctcttcaaaactccaggtggaggatggctcagctggtaagagtgctgcctagcaccacataaagacaaatgtaatcccaggacttgggaagttgaggctggaggaccagagttgaggctagcctgggctacaatagaccctgtctaaaaaggagaccaccaaactcaacaaacaaaaccaagctacttgtatgtctacccctcttactgatgaagcccatccgtcctcagtcagagccactccagggtgtaagcaacactgtgtcctttagtaagcagctgcacccagaagggcttcttgcccccatttgggcctcagagcatagatagcagagagttgccggaggctgcaaaggaggttggaagcctgaactccccgtgaacctcttcccagcagtgatgaaacaaacagcaggatcaaaagcaacttggggaggagacaccgtttatttggatgaccaatcctggatttcagttcattgaagaaagccaagacaggaactaaaacagctgatacggagaccacggaggggtgaggcttactggcttgctcctgatcacctattcagcctgctctcttagagaaccaggaccaccaccccagggctggccccgcccacagtgggcgtggcctccaccatgaaaggctaagaaaatgctccacaggtttgtccccacagcctgatcttacagaggcattctcagttcatggtccctccttttagatgactctagtttgtgtcaagttgactaaatctagtcactcttcatcagcttgacattcaacactatttaacgataaccttttgtttcttggtcatcccaagatctcgtattaatagatatcacaacataaaacacattaccaaacttggaattggtagattttacaaactcaaagattttaaaagttcagtctctaaaaaaaattacaaagtcctgctggggggtggcggcccacgactttaatcccagcactcagggttagacttagggaggcagaggcaagcaagagatttctgagttcaaggccagcctgatctacagagggagttccagaacattaagagctacacagaggccgggcagtggtggcgcttgcctttagtcccagcacttgggaggcagaggcaggcggatatctgagtttgaggccagcctggtctacagagtgagttctaggacagccaaaatacacagagaaaccctgtctcgaaaaaccaaaaaaacaaaaacctacaaaattctttttaaaaactaaagtctcaggggctggcgagatggctcagtagttaagagcgctgactgctcttccaaaggtcccaagttcaaatcccagcaaccacatggtggctcacaaccatccataacgaaatctgatgccctcttctggtgtgtctgaagacagatacagtgtacttacatataataaataaatcaatctttaaaaaaaacccaaaaaacaaacaaaaaaaaccataaagtctctgtaaaactccaaaatttctgtcaaagtctctctactgtgtactcctataaaatcaaaataaatcctcaagaggcaagaaccaggacataggaaaactctgaagaaaagcagaccaaattctagctgtgtagacaactcagtatccagtgtttatgactcgctcttctgagccccctgaagggcctgggttccttctctgactccaccctcttcagcccacatctactctgctcaggccagctccactgggtgggcctgtccttggtgatcattccatggacacttccaaaatgctggggtctcctgaagcaactgggcagcacttccaccaacagcccatgccaggctccctttaggatgccaagcctcaacttctctccatggctccctcaatcctgggctcaactactgaaactgtaccttggctaatagactctactggcctctcatgggaccaagtctcaggtccttcccatgatcctttatgccttcaaaaccagtaccactcttatacataaccaagtttatctgccagcacgagagacaatattagccacctctggaacacagactctaaggagacacttcctcaaagatttcacctcaatagtgaataatgctggtttcttattattattttcgttttgttggtggtggtttttttttttttttttgagacagggtcctggctgtcctggaactcactttgtagaccatgctggccttgaactcagaaatcctcctgtctctgcctcccaagtgctgggattaaaggtgtgcgccaccactgcctggctatttcgtttattttatttttttaatatttatttatttattatatgtaagtacactgtagctgtcttagacactccagaagaggcatctgatttcgttacggatggttatgagccaccatgtggttgctgggatttgaactcaggacctttggaagagcagtcggcgctcttaacccctgagccatctcaccagcccctcgtttatttttgttttgctttttgagtcaggatttttctgtgtagccctggctgtcttggagctcactctttagaccaggctggccttgaactcagagatccacctgcctctgcctcctgagtgccaggacaaaagtcatgcgccaccagcacccaggttctggtttcttcttaatcacttctaattcttcagccccagctgaccagaaccacggcaccttaaatctaaacagccaacgttcacaatagaatctttaaacttccctctgaacttcccaagccaggcgtccattgcctgcactgctctctcagtattatcctccaacagaacagtcctctgagctctcagcagccagtgcctttctagcccaaagttccaaagtcccccccaaacaacatgctcaggtctgccacagcaatacctgactagcctggtaccaattttacttagtcagggttactactgctgtgatgaaacaccatgcatgaccagatagaactggaggaggaaatggctcatccggcttacatatcctgaatatgtccactgagaaaaagccaaggcaagagctcagactgtaagggaacctggaggcaggagctgatgctgaggccatggagggggctgcttactggcttgcttcccctggcttgctcagcctgctttcttatagaaaagaccaccagcccagtgatggcaccacccccaatgggctgtgccctcccccaatcactaactaacaggcttgcctacagcctggtcttatggaggcattttgtcaattgaggcgccctcctcagatgacactagcttgacataaaaactatctaggacacaaactcactcccacacagacccagccctgccacccagggcatcagtcacgttttgcaagcactctaaggtcaagtcaggtaagtcaacccttgatttagttttggtttttattttatttttatatgggtgctttgcttgcaagtatgtatgtgtgcctgatgcccatggagtccagaaggtggtatcagatcctctggaaatgaagttatagacttgtaaactaccatgtaagtgctgggaatggaaccctggtcccttaggggagcagttagtgatcttaaccattaagccatctctctagcctctttggtttttgttgttgatggtggtggtgtttttgttttgttttgttttgtttttggaagagcatcttactatatatagccttggttgcctgaaacacactacgctgactaggctaactttgaactcactatgtagtcaaagaggaccttggcctctctccatcctcctgcctaagcttccagggtagtaggaccacaggcgtgagctagctcattctttacctctggagatgacttaggctacactgggaagctgtgtctaaccctggtgtgtggttagatgtccatcgctgaggccccagttccctgaacacttcccttgaagttcctactacagtgagctgtcagacagccaggccatcaatatgtccccctctactgactgaatgactgagagacaggctagggcgtcccatccctggagctggaagaagaaggggctcacccgttcttcttaggcagataggcttccatgtcgaagaagaggccttggcgctctttcatctggttttccagctcctgtgcagcctccatggactcggatgggagagagggtctgcatctgggagtatggcaggagtcaggcagggcaggtgggagagccccagtcctgcaggaacccctgtgagaaccctttgggacagagaaaaggaacaaaacccagggaggaaggatagaagagccatgccaagggaagcccagcggaaatgcccctccccacgtcaaccacccacccccagcaagccgtcacccccctcactttttcagcaccaaggccagctcctggagccgcttcttctgccgtgtgatggagtttgtacagttggcctggagtttggtcagctcctctagcttgaggcgatacaggcgatgtgtttcctagcatgaggagaaggcggtggcttcactggggagctgccccggcagggaactggctctctcagaggtcgaactttctgtgcttgcccagggacctcccagagactgctccactcctgaagcaagccaggagctaggcttcttcctgtaatctcagaccctccgtggtacatgtcctcaacaacaggtcagttgtccccagctcgggtgggcgtctgaattctaagtggactctagcccagtggttctcgaccttcctaacactgcaaccctttaatacagtcctcatgctgtgctgacccacccaaccacaaaattgttttcattgctatttcctatctgtaattctgctatttaggtgatccctgtgaaaaggtaatccaatctccctgaaggggtggtgacccacaggctgagaactgctgctctcaaaggggctgcctaaactcaccccttcctttctcagatcctcctacctacccagcctgaaagaatggaaatcagggatagccatgctgccttctaccctggcattcctgacgtttcatctcaggttaaaggtcgtcaggcttcccgccctaaggccagtccctcccatccactcccctcctgcaagcacctttggtccaaagcttccccaagtactttgccctggtgggtgagccttgcaagttgcagcctaaacgaagggcaaggggcagtgtggggaaatcaaggcaggggctgaggtcatcgtggtgatggcaaaactgggagacatggagctgtgtaggtctctagggagagttctagtgccagcgttctggggaaacctggacacatgaggctaggcaacagtccaatagaggcaaaggtctaacctagtctcctattggccaggctccactatttaggtctgtttctcatgccaaaataagctgccgcatcctcctcaaactctagcatgtgccacctctgcccagtgacagccttccaggaagcattggtttccttctctctggtatggagacagagtggccacaaacaacaccatcctgggatgggaggttttccagtggtcgctctaccaatccaggaggtcctggtacagtctgccccgcccacctctccctacaagaaagagccacatgtactgggcctcttcttgtccctaggtgggcgctgtccctccgtctcagatggctgagatttccccaaccaggcccgaattttacctaaacttgcttccctgcggcgttcagcagagttagccaagggcggggaaggcgttgtccggctgcaagtttgcagggtaattgacccaaaaggctgggccccgttgggttctgcctcgggtgactgctctttaggaaggggactgggtcccagatcgggtagcagtgcagggggaggggcaacagaagagtcctgatcagttttcaaggcctttgcacaaagtcgagatatcccggcacagagggatcccgcccaggcacgccggggacgcgcgggcaatccgggctcccatcagacatttaagaagaaaagtaggggagagtctcgacccctgacccctccgagctgccttatgtgtgacctagtactgcctgacccttgtccccgagacagagacgtggctcggggcttggatggccgcagggacgctcacctggataccttggaagtcctgctgcagatcctcccagttgcgcaggcagtcgcccagcgggtccgggggcggggactgcatgtctttgtccacgccactggccgcggagagccgcgagtggggaggacggagctgcaaccccggccggccggagaagcctccgccaccgcccccgtccgcttccgggctcgcgccgccgtgactgccaacgggaaaaggcccggcgtaatctgcgcgtgagccccgcccctaggagcagccaatcagagccagggacgagagctgggcggggacatgggcccgcagggcgtctcctcgaattgagaccagagctgggcggccagcatttttacccgagaagtctgcttcctcggaccactcacaaaccaaggagacacgtgcttctaacactttgaaatttttagatagtgtctcactatgtagctcagcctggtctggaaccaagaaatacccctgcctctgactcgccgcgtgcagagattagaagcgtgagccacctcatactcttcatacacttttgtccttgagaagctgcgcctctctagggacagccttcgtctctcagcttttacagatactcctttcctggccctgagtcctccaagctctcctccgtccttaacttttaggctgcctctcctaaacttcctaccgtgtcacttccgaagccttaccagtgcggttcaagttacagactcggtacagaacttgcccagcatgctggaagctcagagggcaattcacccaagcaccacacaaaacatcagatgcagtgcggggcagtagttaaaggcagcgcacgcctttaatcccagtacttggaaggcataggcaggtggatctctgagttcgaggccagcctggtctacagagtgagttccaggacagccaaggctacacatagaaaccctggcgggnnnnnnnnnnnnnnnnnnnnatgcagaggcgcatgccagtgatgcaaacatttggaaggtgcagacggaagaatcagaagttcctggtcaccctcgccaaggacacgcactcactctacctaccacccacatcacaccctacattcttcatcagtccccttgtaagcgcctccacccggacttgttctgagtctgaggaagagcttttgggacttgtggcccatgagggggcgcagcaggtaagagtgcctgtggccaagtctggtgacttcagtttgatcccaggacccacgttgtgaaaatagagaatcggtttcagcaacgtgttctctgacgtcc

SEQ ID NO: 842 - DNA, 2461 bp, Mus musculus
cgcgcggtgtgtgatctggtcggtaccgaggagcgcaggttgtgtcaccaacatgggggactctcacgaagacaccagtgccacagtgcctgaggcagtggctgaagaagtgtctctattcagcacaacggacattgttctgttttctctcatcgtgggggtcctgacctactggttcatctttaaaaagaagaaagaagagataccggagttcagcaagatccagacaacggccccacctgtcaaagagagcagcttcgtggaaaagatgaagaaaacgggaaggaacattattgtattctatggctcccagacgggaaccgcggaggagtttgccaaccggctgtccaaggatgcccaccgctatgggatgcggggcatgtctgcagaccctgaagagtatgacttggccgacctgagcagcctgcctgagatcgacaagtccctggtagtcttctgcatggccacatacggagaaggcgaccccaccgacaacgcgcaggacttctatgattggctgcaggagactgacgtggacctcacgggtgtcaagtttgctgtgtttggtctcgggaacaagacctatgagcacttcaacgccatgggcaagtatgtggaccagcggctggagcagcttggcgcccagcgaatctttgagttgggccttggtgatgacgacgggaacttggaagaggatttcatcacatggagggagcagttctggccagctgtgtgcgagttcttcggggtggaagccactggggaggagtcgaggcaacatccgccagtacgagctcgtggtccacgaagacatggacacagccaaggtgtacacgggtgagatgggccgtctgaagagctacgagaaccagaaaccccccttcgatgccaagaatccattcctggctgctgtcaccacgaaccggaagctgaaccaaggcactgagaggcatctaatgcacctggaattggacatctcagactccaagatcaggtatgaatctggagatcacgtggctgtgtacccagccaacgactccaccctggtcaaccagattggggagatcctgggggctgacctggatgtcatcatgtctctaaacaatctcgatgaggagtcgaataagaagcatccgttcccctgccccaccacctaccgcacggccctcacctactacctggacatcactaacccgccacgaaccaacgtgctctacgagctggcccagtacgcctcagagccctcggagcaggaacacctgcacaagatggcgtcctcctccggcgagggcaaggagctgtacctgagctgggtggtggaggcccggaggcacatcctagccattctccaagactacccgtccctgcggccacccatcgaccacctgtgcgagctcctcccgaggctgcaggcccgctactattccattgcctcgtcgtctaaggtccaccccaactccgtgcacatctgcgccgtggctgtggagtatgaagcgaagtctggacgagtgaacaagggggtggccaccagctggcttcggaccaaggaaccagcaggagagaatggccgccgggccctggtccccatgttcgtccgcaagtcccagttccgcttgcctttcaagcccaccacacctgttatcatggtgggccccggcactggggttgcccctttcatgggcttcatccaggagcgggcttggcttcgagagcaaggcaaggaggtcggagagacgctgctctactacggctgccggcgctcggatgaggactatctgtaccgcgaggagctggcgcgcttccacaaggacggcgccctcacgcagcttaatgtggccttttcccgtgagcaggcccacaaggtctatgttcagcacctgctcaagagggacaaagagcacctgtggaagctgatccacgaaggtggtgcccacatctatgtctgcggggatgctcgaaatatggccaaagatgtgcagaacacattctatgacatcgtggccgagtttgggcccatggagcacacccaggctgtggactatgttaagaagctcatgaccaagggccgctactcgctggatgtatggagctaggagctgccgccccccacccctcgctccctgtaatcacgtccttaacttccttctgccgacctccacctctggtggttcctgccctgcctggacacagggaggcccagggactgactcctggcctgagtgatgccctcctgggcccttaggcagagcctggtccattgtaccaggcagcctagcccagcccagggcacatggcaagagggactggacccacctttgggtgatgggtgccttaggtccccagcagctgtacagaaggggctcttctctccacagagctggggtgcagccccaacatgtgattttgaatgagtgtaaataattttaaataacctggcccttggaataaagttgttttctgt

SEQ ID NO: 843 - protein, 546 aa, Mus musculus
SSAWPHTEKATPPTTRRTSMIGCRRLTWTSRVSSLLCLVSGTRPMSTSTPWASMWTSGWSSLAPSESLSWALVMTTGTWKRISSHGGSSSGQLCASSSGWKPLGRSRGNIRQYELVVHEDMDTAKVYTGEMGRLKSYENQKPPFDAKNPFLAAVTTNRKLNQGTERHLMHLELDISDSKIRYESGDHVAVYPANDSTLVNQIGEILGADLDVIMSLNNLDEESNKKHPFPCPTTYRTALTYYLDITNPPRTNVLYELAQYASEPSEQEHLHKMASSSGEGKELYLSWVVEARRHILAILQDYPSLRPPIDHLCELLPRLQARYYSIASSSKVHPNSVHICAVAVEYEAKSGRVNKGVATSWLRTKEPAGENGRRALVPMFVRKSQFRLPFKPTTPVIMVGPGTGVAPFMGFIQERAWLREQGKEVGETLLYYGCRRSDEDYLYREELARFHKDGALTQLNVAFSREQAHKVYVQHLLKRDKEHLWKLIHEGGAHIYVCGDARNMAKDVQNTFYDIVAEFGPMEHTQAVDYVKKLMTKGRYSLDVWS

SEQ ID NO: 844 - DNA, 91760 bp, Homo sapiens
  misc_feature (1)...(91760): n = A,T,C or G
aagtgactgctcagaggcacaggcaggtgtcctccacagcactgtctgaacagttcgtggaagccaggcaggcttctcttcatcggcccttgcacaatggtgctggttgctttggcaacagccagcagcagccaagcaattttgagcacagaatcctggggcttgtgtcatactggggagacagggcaaaggttctggcccattggcatgtgaacgcgaatggggaggaagagggggagaaagggcgtggcttccgaggccccctctcacccgaacaccctctcatttccccagaagcttgctctggctcccgcatgcaaacccagaagagctgaaactttgattgcgtaacagaggggaacaaaggatggagtgaaactggggcgggtatgcgggcagtaggaaggagaaagaagccatcctgggctctgagaaccgctgggtgcaccaggccatgtcacacacacagcaactcatttaatcctcacgcaactgcctgggtccgtgtgcccaggacccatccatggccacacagctagccggaaacctgatctgctgtagctaaaggccatgtttgctttctcagttcagggccgcctctttgaaatgcctctttggccgtgttaggaagacccaggggtttggggcagcaaggaggcaggaagaaggtctgggggagttatttggacaatgaagagagccaggcgggtcaaccatcctcttggctttgcacttgacagcaaccgcctccctcctgtttctcattttcttttattattaaatgctctaattttcttttattattattgttttttaaacatagagatggggttggccgagcacagtggctcacgcctgtaatcctaacactttgggaggccgaggtgggtggatcacctgaggtcaggagttcgagaccagcctggtcaacatggcgaaacactagctctactcaaaattcaaaaattagccaggcggagtggcgtgcacctgtaatcccagctacttgggaagatgagacaggagaatcaattgaacccaggagatggaggttgcagtgagccgagatcacaccactaaaaaataaataaataaaaaggagagagaaagatgcggtctcactaaaaaaaaaaaaaaagagagagagagagagatggggggggggtctcactatgttctccaggctggtcttgaactctcaggctcaagtgatcctcctgcctcggcctccccgatgctgggattacaggcatgagccaccatgcctggccaccactgacttcttatccaggaaaaataataaagatacttggnnnnnnnnnnnnnnnnnnnnggccatgtcacacacacagcaactcatttaatcctcacgcaactgcctgggtccgtgtgcccaggacccatccatggccacacagctagccggaaacctgatctgctgtagctaaaggccatgtttgctttctcagttcagggccgcctctttgaaatgcctctttggccgtgttaggaagacccaggggtttggggcagcaaggaggcaggaagaaggtctgggggagttatttggacaatgaagagagccaggcgggtcaaccatcctcttggctttgcacttgacagcaaccgcctccctcctgtttctcattttcttttattattaaatgctctaattttcttttattattattgttttttaaacatagagatggggttggccgagcacagtggctcacgcctgtaatcctaacactttgggaggccgaggtgggtggatcacaaggtcaggagttcaagaccagcctggccaacatcgtgaaaccccgtctctactaaaaatacaaaaaaattagccaggcatggtggcacgcacctgtaatcctagctactttggaggctgaggcaggcaggagaatcgcttgaacccaggaggcagaggttgcagtgagccaaggtcgcaccactgtactccagcctgggcaacagagcgagactcggtctcaaagaaaaaaaaaaaaagatacttggccaaggccatgcacttggttccgtctaattggaatttgtcccctgatctccagagagagattctgcgcttctacactttggtgatgttctcatccctgaccctgtagggttatctcaacccaggaaatctgcaaactcacttgccttgcaccctcatggacgcctctcaaggggaataaaccatcctgtccaaaggtcatggtgtgatactggagacacatgagacacggtgtcagaggccgctgtgacatttggagttctgggaaagtgggagcacctcctctaaggatcaaccacacccctctagcatctatggtggaagccaatccagcttctctcagtgccaagctaatctgggatccactttttctttttttcttttcttttttttttttttttcagagacagagtttggctctgttgtgtaacacggttaaactttggccatgttaggaggacctaggggtgtggggcagcaaggagaccggaagaaggtctggggaagttatttggacaatgaagagagccaggtgggtcaacaattctctgtgctttgcacttgacagcaaccgccaccccccctcctgtttctctgctctcattttatcttttatttttatttttttaaaacataaagatggggttggccgagagctctgttgcccaggctggagtgcagtggcacaatcacagttcactgtagcctcagcctccaggctcaagcgatcctcccacctcagcctcctgagtagctgggactacaggcacgcgccaccacacctggctaattttttattttttgtagaggcggggccttgctatgatgcccagtttggtttcaaacttctggcttcaaacaatccccgcctcagtctcccaaagtgctaggattacacgtgtgagccaccatgcccggctccactgcttttattttattttatttattttatgtttgagatggagtctcactctgttgcccaggctggagtgcagtggcgcgatctcagctgactgcaacctccgcctcctggggtgaagcgattctcctgcctcagcctcccaagtagctgggattataggcgcctgccaccacgcctggctaatttttgtatttgtttagtagagacagggttttgccatgttggccaagctggtctcgaactcctgacctcaggtgatatgcccacctctgcctcccaaagtgctgggattacaggcatgaaccaccatgccgagcctggctaattttttttttttttgagacagagtctcgctctgtagcccaggctggagtgcagtggcaatcttggctcactgcaagctctgcctcccgggttcatgccattctcttgcctcagcctcccgagtagctgggactacaagtgcctgacaccaagcccggctaatttttttgtatttttagtagagacagggtttcactgtgttagccaggatggtctcaatctcctgacctcaagtgatcctcccgcctcggcctcccaaagtgctgggattacaggcatgagccaccgtgcctggcccagcctggctaatttttaaaaaaattttttgtagagatagggtcttgctgtgttgcccaggctggtcttgaactcctggcctcaagccatcctcccacctcggtctcccaaagtgttgggagccaccttacctggccagaaaacatatttagaatatagatgttatcaagctcaataatgaaaatgtagaggttcagacggctaaagttttagagggacagagcaaagggaaagggaagcttcatcgtacaatattaagagatactgttcatggatcaaaaaacaaaggccccaggctactacttaaattataaaagtgattaacagaggaattaaattaggtgtataaataatattggaagggtgtgggcagcagaggtgagctgtggtttaaatggcctaactcacatcagtgggactccagaggtaacatctaaaatatcaggcagagggctggacatggtggctcatgcctgtaatcccagtgctatgggaggctgaggcaggaggattgcttgagcccaggagtttgagaccagcctgggcatcatagtgagaacctgtctctttatttatttatttatttatttatttgagatggattctctctatatatcccaggctggagtgcagtggcgtgatctcggctcactgcaacctccgcctcctgggttcaagggattctcctgcctcagcctcccaagtagctgggattacaggcacccaccaccacacccagctaatttttatatttttagtagagaccgagtttcaccatgttggccaggctggtcttgaactgctgacctcaagtgatccgcccgccttggcctcccaaagtgttgggattacaggcgtcagccaccgcacctggcctgtctctatatttaaaaaagaaaagaaaagaaaagaaaagaagaacaaggaggaggaggagaaagaagaaagagaagaagaggaagaggaaggaagaagaagaggaggaagaggaagaagaggaagagggagaggagggagaggtgggagaggaaagagaggaaggagaggaaggaaaagaggaaggagaggagaagaggaaggaggagaagaaggagaaaagaaaagaagaagaaagaagaagaaaagaagaaggaagaggaggaagaggaagagaagaagaaggaggaggaagaagaagaagagagaagaagaaagaagaagaagaaaagaaagtcacaggtcaaaatcagccagaaaaacatgtatgtaccagcatggctgtaatgaccagaagaaaatgctaaaaaagagaagaatttatcctttcagccagatgcattggctcatgcctataatcccagcgctttgggaggtcgaggcaggtggatcacttgaggtcaggagttcgagaccagcctggccaaagtggtgaaaccccatctctactaaaaatataaaaaattagctgggcgtggtggagcgcacctgcagtcccagctactctggaggctgaggcaggagaatcgcttgaacccagaaggaggaggttgcagtgagtcaagatcacaccactgcactcaagcctaggcgacagaacaatactccaccttaaaaaaaaagaaaatcaagtctatagtcactattctttagatttggggagcaagtaaaagtttgttctttggccagcagcaagattatctgggtatttaaaaagtatttatgagctgggtgtagaggctgacacctggaatcccagcgctttgagaggccgaggtgggaggatcacttgagcccaggagttcaagaccagccacatagcgagaccctctctcaacaacaaataaaaaataaattagccaggtgtggtggtgctcacctgtagttccagctactcggaggctgaggtgggaggattgcctgagcccaggaggcagaggttgtagtgagccatgatcatgccactgtactccatcctgggcgacagagcaaaacccagtctctaatttaaaacaaaaaaaggtatttatgtatttgacttagaataagtaatacattcataaggtacaaaatttgaatgatacagagtagtatatagtgaaatatattcctttgcccctggtctccctcctcccagttctccagagacaaccaaccttacctccctcccttttttttttttttgtttttgtttttgtttcaggaggtatttcatgcacatacaggcaaatatgtatacctagtatctatgttcttccctcatttcccaccacaattgtttgagaacatacaaacggtaacattctatacctactgttctgtaccttgcatatttatcaatttgtctcagagatttttctgtttaagcaatgagcttccttccttgtttgtttgtttgtttgagacaagagtctcactctgtcaccccggctggagtgcagtggtgcacccttggctcactgcaaactccgcctcccaggttcaagcgattctcctgcctcagcctcccgactagctgggattacaggcgcccaccacgcccagctaatgttttgtatttttaagagacgaggtttcaccatgttggccaggctggtctcaaactcctgacctcaagtaatctgcctgcctcggcctctcaaagtgttgggattacaggtgtgagccaccgtgccctgccggccccttgtttgtttgtttttgtttttttgagacggagtctcagtctgttacccaggctggagtgcagtggcgcaatctcagctcactgcaacctctgcctcccgggttcaagccattctcctgtctcagccacccctgggactacaggcatgtgccaccatgctcagctaatttttgtatttttagtagagacggggtttcgtcatgttggccaggctgatctcgaactcctgggctctagcgatcctcccacctcagcctcccaaagtgctgggatgacaggcgtgagccactgtacccagcccagattatttctcaatgttttcatttatggcttctggagtttatgtcataatttcataatttagaaatgcctcttggggattattaacaccaattctcccatggacttttgggggctttttttttccttctcccttaaaaaatcatttaaatattttatctatctggaatttatattagtgtaatatgtgagatgtggatgcaacctactttttttccccccagctggccagcgagagtgttttttcggggtgggggtggggagggaaggagaggaaggtaggacaatgaggaggacagtaactgaagaagagaagctttcagctcggtgtggtggctcacgcctgtaatcccagcactttgggagtctgaggaggatggatcacctgaggtcaggagttcgagaccagcttggccaacatggcaaaaccccgtctctactaaaaatacaaaaattagccaggtgtggtggtgcacacctgtgatcccagctactcaggaggctgaggcaggagaatcgcttgaacccaggaggtggaggttgcagtgagcctagatctcaccactacacttcagcctgggtgtcagagtgagaccctgtctcaaaaaaaaaaaaaaaaaaaaaaaaaaaaaaaagaggcttccttgccagtgggtgtagcagaaacgagaagtgacataaacagtcaggaagccggctaggtgcggtggctcacacctgtaatcccagcactttgggaggccaaggcagatggatcacctgaggtcaggagttcgagagcagcctggccaatatggtgaaaccccatctctactagaaatacaaaaattagccgggtgtggtggcacaagtctgtaatcccagctactcaggcagctgaggcaggagaatcgcttgaactcaggaggcagaggttgcagtgagctgagatggtgcccctgcactgcagcctgggtgacacagtgagactccatcccccccaaaaaagtcaggaagctgctgagatcatccaggtgaacggtgaacccacgtggccccaactggaacagggacagcagaaaagatgacaagaggaggttctggagatagaatccataggacccagttattggttcaatgggaaaaggccaaagaggtaaaatgcctgtttcctgatgtttccttagtgatgctatattattagcagacagagaagactcagtgttttaggagttctggtttcaaaaaaagcagggggcatggagtcaaagtccaaatttgaagcctcactgggacatcctggggagatgtccaacagggtgttgaaaagatggcacagagtatcagatatctgggtgaatttctccacagctctctctctgggtgagtgtggagttcagtcccttctttggacaggtattgtgccccaccctgagggctactgcattcatccaacctgttggagggactggttcctggacataggaaacctggcacctgggccatggtaataatctctttatataggattttgctattttcacaatattttaaagatgaagagtggatgggaatggtggctcacatctgtaattcctgcactttgggaggccgaggcaagggatcccttgaggccaggagttcaagaccaggttgggcaacatagcgagactctgtctctacaaaaaatttaaaaattaggctaggtgcagtgctcacacctgtaatctcagcactttgggaggccaaggtgggaggactgcttgaggtctggagtttgagaccagcctgggaaacatggcaaaacaccatctctacaaaaaaatttcaatcaactttctttaaaatgaaaaataaaaatacaaaaattagccagttgtggtggcgcatgcctgtaattccagctactagggaggctgaggcaggaggatcacctgagcccaggaggtcgaggctgcatcccagcctcagcgacaaagggagaccctgtttcaaaaaataagtaacatatatgttattatataatatatattatttatataatatataaatataacaaatataacatttatataatatataaatgttatatttatgtattattttataaattaacttttttttttttgtgagacggagtgtcactctgtcggccacactggagtgcagtggtgtgaactgggctcactgcaacctctgcctccggggttcaagtgggtctcctgcctcagtctccccagtaggtgggattacaggcacccgccaccatgcccagctaatttttgtatttttagtagagacggggttttgccatgttggtcaggctggtctcgaactcctgacctcaggtgatccgcccacctcagcctaccaaagttctgggattacaggcgtgagccaccgtgcctgggctatttttaaaagatggagaaggggctctgagagaagtgagttgcacagtgttgcaaaaggaattcacagcacagctagtaataatagtagtagtagtaataataacaatggcgatgagaacacttagtaatgccgtgctctaaatcctttaggaacaaaggttataccacttaatcttcatgaccctgtaaagtagaaaccatagcaggaggcagaggtgggcttcactccccaaccaaggctgccagacttttcaaaccccagaagctctctgtatccccccactcctcttccatccagggcttgcctcctgcttggtcacttcccacccccaacaggccggccttcaaaagcgagctctaggcagcgtgtgggacctcacgcctgtaatcgcagcgctttgagaggccgaggagggaggatcacttgagaccagttcgagaccaacctgggcatcatagcgagaccgcatctctgcaaataaaataaaataaaattagctaggtgtggtggcgcgcctgtagtcccagctactgggaggctgaagtgggagaatcgcctgagcacaggagttgaaggctgcagtgagctgtgactgcaccactgcaatccagcctgggcgacagaacgagaccctgtctctaaaaacaaacgcgcgccctccgccgtcaggctggatggagggaacccagggagacgacttgggcctgaagcctcgccaatttcaggtgaggaaacagggccgtggaggagacaatgtggcgatcacaagcaagcggcggcccgaaggaggaggctagaccggcgggcgcacagccacagttctgcagtgatccccgggaaggtgggcagccggcccggtgacctgcagggtccgagctgtagaagccgcagccgccgtctccaggcgactccgccacccccgggaaccacgcactttcatttctctgccgggcgacccagccgagccgcgagggggcgtggccgggccgggccgtaccaagagcgcaaatttgcagggggaagcgcggggctccgggaatgcacgcgcggctcgagtgggcggggcggcggcccaatggccacgcccccacccccgcggccggcgaaggcggtggtagcgcctcagtggtgtgggcctgagccctgcccaggtgcccgcagagagcagccgggctgccagcggtgagtgctatctttcgcggcgacggcggggtgggtgaggtcgggccccaagactcggggtttgccgggcgcctcagttcaccgcggccgcctggctctctgcgtcggggtgggccctcgggcctgggcactgcgcgtctggcccgacgctcgggcggaaggcatggctcccaccccggccctcctccgcgtcgcccttcccctagagctgatctcccgcggcggcctgagggtcgacttttccacagcttgggccgagagagcccggcaggccctcggctgagggttagggctcggtatctcagggctcggggtccagtccccgcgccgccgccccccacgggctaagccactttaactctccgagcctcagtttccccatctgtacgatgaatgggcctcgggaggcagcgaattctgggggtacctaacgtgagaggcgctcgatgcatgctcatgggacccgaatctaaccctgcagcatcaggtgggctgagtcgatggatcacgggagccccccagcccggcctgcatccctgagggcagtgcccctcgcagtcaggtgtctcggcggcccccacaacacaggtacccggatctcctgggggagccgggacacccttagatcgggggagcaattgggtaagagttcaaggtctcttgggcgccagggggaggagagtagaggtttcagtgagcttgattgacttcgactttctgcgtattgtttttcaaaacgagttacccttgtgtaaactggtgaccactaataaggagtttggggctgtttcaatgaaagtggctgtctcctctcttaaacccttaaagctgcagccttgccttgccttgcctctgagcttggccaagctggagaatgatgccagcacaaaaggagacaggactggactgggtggccctggtttgattcttggcaagcaagatacctcctggagcctccgttttctgatcagtgggtctggtagtaagacagccaccctgctctccccacagggttgagattctgaggatcaagacagggtcccagagagtggcatcgagaactttaatcctccttgtaagcagaacgtttatggaaccctctgggggatccagtatccccaccgttgttcactgctgtaattccttgggtcttgctttatggagaaggcattgattcattaaccatttgcaagttctacctacggaaatcccttttgagtggttatggggttggcttggtcaggagaacagctccaaaggcccagttagtaaaccagggaacccagaaaggtccacttccttttttttgggaggagggctgttttaggagttcttattttccttttaagagagtggtttttgagctacttatgaccttcatgccatctaatgttggaaactttcgctgagcagatagcttattataaaaagtatttgtacaacatccgcatttcagagaatgggatgctagctgccagttgcgtggtggtgtggaaacttaggagtgatcttaattttccaaaattcttcaggtctagcacttgaagaaataataggtagatttgaaatgaaacaacccagggatattcctgaaaacagcagcattgaccgcagccaatgtaaatcaggtgtggatcgtcctgggtagtaggagtttataaatgccacagaggatgtttgctgccagacatacctgaattttaggacctgctgttggttaactctgggttgatccacccttaaccccttgaaaatcagaatctgtgttaggtaagtctgtgtatgattaggagacaggccaattgaaatcaaaactgcttggcaaatccagaacatttactcgtgaagtccatggaacatttcaagttaaaaataatttagcttttaagtaacttttttttttttgtgagacaggtctcactctgtcgtgcaggctggagtgcagtggcgcaatcatagctcactgcagcctcaacctccaggattcaagcaatcctccctcctcagcctcccaagtagttgggagtacaggcacgcaccaccacacccagctaattttttaaatgttttttagagatttggtttgccatgttgcccaggctggtctcgaattctggggttcaagtggtcctcctgctttgacctcctaaagtgctgagattacaggtgtgagccaccgttcctggctttcttatttcttcttcttttttttttttttttttctgatggaagctcttgaagttataggacctttcatggttccagagaggctggccgcccctacaagagcttcgatgtccttgtgctttagggaggagccagagaaacagaggtcaagctctggcactagcaccgtgtgtggcctcaattgagcatgttgggatttaactttctgttatatgtcagactcacttaaaaattaaagttagaaaaaggtgaaatggagaaatgacaattttcttttcttttcttttctttttttgagatggagtctcgctctgtcgcccaggctggagcgcagtgggctcagtgcagcctccacctcccccaggttcaagcaattttccttgcttgaattctgcctcagcctcctgagtagctggaatttcgagtacccaccacctggccaaagattctgtgctcattagcacacagcctcccaggtggctacagccttaaaagactttcaaatgccaattctaggctgggaacagtggctcacgcctgtaattccggcactttgggagaccaaggtgggtgaattgcttgagtccaggagtttgagaccagcctgggcaacacggcgaatccctgtctctataaaaaaaatacaaatacaaaaattgactgggcatggtggctcacgcctgtaatcccagcactttgggaggccgaggcaggcagatcacttgaggtcaggagttcgagaccagcctggccaacgtggtgaaaccccgtctctactaaaaatacaaaaattagccggtgtggtggtgtgcacctgtaatcccaactactcaggaggctgaggcagaagaatcacttgaacctgggaagcggaggttgcagtgagccgagatcgtgctgctgcactccagcctgggtgacagagtgagactctgtctcagaaaaaaaaacccaaaaaacaacaacttgttttgctgtgcagttttgtcatctggcattgggcagaaatttggacccgccgggcaggtgggagaagcatctgagtcagaggtcacttacctgcttgcataggccgctgacctataccaagccttagtttcttcatcactaaagtcagagaaagaacccactccacctgcctctgggacagctcagaacatgttaaccctttcagcagtgggtccttcttcatcttcttggcgctgtttggatccctgtagcgtgacacataaaaaagcacacatccggccttaggatatgtgtaggctctggtttgggcacttgagaactctcacagggagggaagcaagcatacaattcaacaagaatggcacggtgtgttgcattcattctcaagatgatggggtgaggcttttattagtgctgagcctgctgtttgtttccacagcagggctccaggggagaggtgatgtttgagttgggtcttggaggattgctaggagttctctgagcccacccaggcacaccagctctggggggcatgtagggtgtagattgcatgaggctgaggtcgcgtggtggcacttgtctgaaatggtcctaggaaccatgggaagagatggggaggtgttttaaaaggtcagggctatgtgactagctcagatcagtgttgtgtgttttttttttttttagacagagtctcactctgtcacccaggctggagtgcagtggtgtgatcttggctcactgcaacctctgtctcctgggttcaagcaattcttgtgcctcagcctcccgagtagctaggattacaggcaccggccaccatgtctggctcaggacagtgttttcttgtactgaatattctcttactgcctaatatcctctctgggtgaatgaacaaccatttgggaaatttttactgtgtctaaatttgtaatcatactgttttagagctctacatcttaaaagtttttcctccccaagcgagatgtttacatcagttgtgttcttgttgggattagtgtgcacacgcctgtctgcatctgtgcgtgcgtgtgtgtgtgtgtgtgtgtgtgtgtatgcatataagagggagagaagatggaggaattccatgggggcagaccatggttctttgcagattggtggctccagttggttgggttcactggagccacgttcatcagtttgtttctttctttccttttctctctctgtatgtttatttatttatttattatttgtagaagtggggtctggctatgttgcccaggctagtttcaaactcctggcctcaagtgagcctcctatctcagcctcccaaaacgctgggattacaggcatgagccaccgcgcccagcccagtaactgttactcctgacgctggtcggtgtggcaactcagttgatgcttggacgtgttgtgaacaaagccccggggaacctgatccttctggtggcttgtgcagcaaactgttgatgtgggaagcttatttatttcacttgttaaagaggtgacttggatagggggatatctaagaattgtcctttcattggagtgctggagggtgtggcattcggatctcctttgtgcagcatctgtacctagctgagagaattgtacacataatttcccgaaatgcgtcagtttcaaggctaacttagaatatgttggtggccagactgtggtgctgtcagctgtggactgttctccaagagttgaatttctttttttttttttttttttttttttttgagacagagtctgactctctcgcctaggctggagtgcagtggtgtgatcttggctcactgcaacctctgccttccaggttcaagcaattcttctgcctcagcctcccaagtagctgggattacaggcgcgtgccatcacgcccggctaatttttttttgtatttttagtagagatgaggtttcactgtgttggccaggctggtttcaaactcctgacctcaagtgatccacccgcctcagcctcccaaagtgctaggattaccaggcgtgagccaccatgtccagcttataagaattgaattctttaggagacatttggtaggagaatagaagggggaaagttgccttttgtctacttggatgtagtaatgaggaggaagatggggcattgtggggcgtgtcctctaacttggaacagatgtaatttatttctaggtgaaagttaagaacagtgcttactcattctatttatctgccctccttttatcttcggcactttttcctacagccctgtttctgagctcacgtcacatcacctctgcggtggtgatgccggtgttcttagagcactgtgtcctagtgatactttgatcttcgtgggcatgcatcatcagtgcattgggtaagccgggcctgtacaaaggtttgcaggtttggttaggaacacgtgaactacggtcacctttctgaactttctgaactcatatgtagtgaccataggtcacctgggttgagttttcaacactgcaaacagggatggcagttcttgaatacacaggagagtgcattagccagtggtgcccggcatcattcagagtgcagtttggcatcaggaatgttccgtcaggtatttgtggtcttgtggagaaaagccactgttggttttggtgaagggcttcagaccctttgactgctcatgaaaccacacagtcttaacatggacacgttggacgcgttccttacgtaacgtgatttgcaaactcaggagtcattcagcgtcacagcagtgatcaaaagctcccagcccatctacccgaaacctccacaacaagagctctatctgtcagtggcctcaccgacttcctgggccctgaagctccaaggacaaaagactcctgtcccttttcccttcctctccattctgggtctcccaccaccaccaagtcctgtaagtttttagtcttttttttttttttttttgagacagattcttgctctgttgttcagagtgcagtgacacaatctcagctcactgcaacctctgcctcccaggttcaagtgattctcctgcctcagcttcccgagtagctgggattataggtgcgcggcaccgcgcccagctaatttttgtatttttagtagagacagggtttcactgtgttggccaggctggtctcgaactcctgacctcaggcgatctgcctgcctcggcctcccaaagtgctgggattacagcaggcgtgagccaccacgcccggccctttaaatctctttccactgctgtggtcttactgtagccccttgtcacttcctgctgcgctgacccgtaattgacccataattctccctctcttcccctccctaccacgttccaagatctgtccatggtaccattgctggttgatcttggaaccctgcttcggtcacccctcctttctcttcgcccagactggagtgcagtggcacgatttggctcactgcaacctccacctgtcaggttcaagtgattctcctgcctcagcctcccgagtagctggcactacaggcacgtgcctccacacctagctaatttttgtatttctagtagagacagggtttcaccatgttggccaggccagtctcgaactcctggccttaagtggtccacccagctcagcctcccaaagtgctgggataataggcaggagccactgtgcccggtcactgtcactgtcttattgcatgttttcttcttcatctgctttcataaaggataaacagtgacttaataaaaggtgtctaattctcccctccctagtggcaatacggttggactagaaggtgaattcagttgagaacagggaacctatcatttctgcgagtgtaagctggggcatagaacaatgccaggcataaggtaggcacttggatgaatggatgaatgaataaatatggcttctgtcccccaagtttactgctgagctttctcctgcatattgactgagctcagatgtcaaaattgggtctgatctgtagttttttttttttttttttttgagacagagcctgtcactctgtcgcccaggctggagtgcagtggcgcaatcttggctcactgcaacctctgcctcctgggttcaagcaattctcgtgcctcaacctcctgagtagctggaattataggtgtgtgccatcatgcctggctaattttttgtaattttagtacagatggggtttcaccatgttgcccagctggtctcgaatgcctgacctgaagcagtctgcccgcctcggccttccgaagtgctgggattacaggcgtgagccactgcgcctggcctggtctgtacttctgaagattattccaaagtacagtaggaacttttggtaggactttagttttccatccaggtataaaattttgtgtcagtggtggggttgcgcatgttcagtagctgcaacactagaaagatggcaaagcaggagcaaagaaaaatccctttggctccagaaaatctcctgaaagcagaaggcttatcaaggcctcaaagccacccagtcaaagtaggcacttttggcaaaggaggagcagagggaaggaaaagagctcaggtttaaacgactggaatcattcctacatgattcctggcagcagaaacatgacaaggtgtgtctcagacgactagaagtaaaacctcacaccttggaatcgccagataaacattccttggcctttgttgtacgcgtcgaaaggattgatggtgtgagtttactggtgcggagagccattgcaagacttaaacctaaaaatgcagcgtatagtatgtaaccttatgtgacctggggatttccaaatctgaagtctgtccagaaactcattttgaaacgtagacaagccaaggtcaagaataagaccatccctctgacaacacagtgattgaggagcacctgggaaagcttggtgtcttttgcttggaagacctcattcatgaaattgccttcccaaggaagcatttccaggagatctcatggttcttgtcccctttccacctctcagtggactgtcatgctaccaaaaatagtggactttctgaaggagattggcacacctccatcttcttgggggtgtgtgcatcaatcagctcatccgccagctgaactagagccaggtgccaaactacagtaaatttttatcaatgaactggaagcttgtgttatttttgggggcggggtggaatttttatcaagtatcttcagagaagattatttcctgctttatcttcaaaaactgtaaaggaagggtcaaaggaaagacagtggctggccgggcccggtggctcacgcctataatcctagcactttgggaggctgaggcgggcagatcacctgaggtcgggagttcgaaaccagcctgaccaacatggagaaaccccgtctctactaaaaatacaaaaattagctgagcgtggtggcacacgcctgtaatcccagctactggggaggctgaggcaggagaatcgcttgaacccgggaggcggaggttgtggtgagccaagatcagacctttgtcctccagcctgggcaacaagagcgaaactccatctcaaaaaaaaaaaaaaagaaaagaaaagacagtagcttacgttcatggcggcacctctcatcacagtccagttccaaggaaaaattccagcgttttctacgttggctgctgccttgtctgaaatcacattttgtggagaaaggagtcttgctttgttgcatcttctatcctagggtttaatgttggtgaatgagtaactctagcatttgtacaaggctccctaagagtcctgcagcagtcgaccaagcccggggacataattgaatccggagattcctggggccttgaaaaaggcttgaaatatacataggaagaaaggcacaaaaataaatgctcacttgtctctgcaaaaaaaaagaaaagaaaaattgtgtctcaagttccttctgtagttgataatttattcagtaatcattttataattgaagaagaatattctgactctaaatctttctagatcagttacctggatgctgaagacatgaataaatttgtttattttaaaaatcctagggcctggcacagtggctcatgcttataatcttagcactgtgggaggccgaggtggacggatcactagagcccaggaattcaagaccatcctgggccacatggcaaaacaccatctctatttaaaaattagtgtttttaaacatcagtgtttaaaaattagctgggtgtggtggtgtgtacctgtcatcccaactacttgggaggctgaggtgggaggatcacctgagcccagggaggttgaggctgcagtgagccatgatcagaccactgcacaccaacctgggtgatagagtgagacccccatctcaaaatatacagtaataaatgaaaaatagaaaattccccaaataaataaataatagaaaattctaatgaaaataaaaggagttgagtgtaaccgttgagtgtctgcgctgggtgtttatgtctcatgtaaccaacgtagcactgtgagcatggtcatcccggagacggactgtgataaatcgtgtgcccaggatcccagagtgcataggtggcatatctaggttttgaaccaaggtctgttggtcttttatagctcaactgggttgtgagtttgttgaatttcactttccatgctttccccaaccaaaccaaaaaccagagggggaactgaaagctgagagcctagtaattgagaaaaggactctgggaggtgatggtgtcaaaaagcagtccagggaagctcttgtggttgagcacacagctctgcccagagcttcctagatgccaaggcaaagaaggatggggttacatagcagttattggaaaaaggaagctgaccagtttctcattagtatttttcagctgggcgcgatggctcatgtctgtagtcccagcactctgggaggctgaggcaggaggatcacttgtggccaggagtttgagaccagcctgggcaagagagagagagagagaccctgtcccttcaacaagaaaatacacatttaaaatattagccaggcatggtggtgtgcacctgtagtcccagctactcaagaggctgaagcaggacgatcgcttgagcctgagagttcaaggctgtagtaagctatgattgcaccacgacactgcagcctgggtgatggagcaagaccccatctcttaaattttttttaaaaagtgcttttccctgggcctttacacgaggatcattgaataaagcagtggtcagcagcccatgtactcagcaagtatttgtagagcaccacgtatgtgccaagctctcttcgaggtgctgggactacttttgtgtgtggaaaagaccaacaagatgaaagatgatgttggcctaggccagggtggaggcactgttttcaagaacaggagtgttcccacaggtgaccctttctgggtcccatctaggtaagaggctgagaggttcaggctcggttgtaaattctgtaagggcagttctttgggaggtgtgagcaagagaatggaatcagagcgattattttagcaggcaggagtgaagcttgagaatctggcagagtgaggagcgatcttgtgccagagtgagaggcagccagtccaaagtgaaggttctgaagctcttagtacctcccacgtacagtgtcctgcttttttttctttctcttttctctctctttttttttttttttttttttaaggcaggacacttgctctgtcacccaggatcattgctcactgcagtctcaaactccttaagcccttccaagtagctgggactacaggcacacaccaccatgcttggcgagtttttctttctttttgcagagatggggtcttgctatgttgcccaggccgatctcaaactcctgggctcaaacgatcctcctgttgacctcccaaagtgctggaattacaggcatgagccactgtacctggacccctgctatttttcctgtgatatttgaaaagcttggcttggtttcttgccctttagtaggtgattgcaggcagagccacgaggtcttagaaagcagcacggctctgttccgatactcctggctgaagggccagtgtgctgtgccattgagggagaagcattgactctggtctgggagattctgttcatttagtcattcagcaaacaaatattgagtgctggccaggtgtggtggctcacacctgtaatcccagcactttgggaggccgaggcgggcagatcacctgaggtcgcgagttcgagaccggcctgaccaacatggagaaacctgtctctactaaaaatacaaaattagccgggcgtggtggtgcatgcctgtaatcccagctacttgggaggctgaggcaggagaatcgcttgaacccggggggcagaggttgcagtgagctgaggttgcgccattgcattccatccagcctgggcaacaagagcgaaactctgtctcaaaaaaacaaaaacaaatattgagcactcatgttatgcaaagtctgatgagcaccagggttacagaggtgcaggatagctccacccagacacgagaccaatcctgtgtccttctgcagggattatttcatcttgggtaatgctgtcatctgatgatgtggccaggatgtcagctgcaaaatgaaccccaggtcattcagtgaggctgcgtctacctgtaactttgccatgtcctaaaaaggtcttgaagggcagacagatggttgatagaatagctctggagacagttggtctgggtttgaatcctggttccaccatttatcgattccctgatgttggacaaggtcctttaacctttgtgataattacagctcctgtatgtcagagcagtgttaaaacactgttcattagttaaaaacaaatcagggccgggcttggtggctcacacctgtaatcccagcactttgggagattgaggtgggctaatggcttgagcccaggagtttgagaccaacctgggcaacatggcgaaaccccgtatcttaacaaaaaattaatggggcttggtggtgggtgcctgtagtcccagcaacgcaggaggctgggctgtcatcacgccactgtacagcagcctggctgacagagtgagaccctgtctcaaaaaaaaaacaacaacaaaaaaaaccccaaaaaacaaaaaccaggtcaggagtggggagtgactgctgatgagtgtgggatttccttttgagggtatgaagatgctctggaatctggtagtggtgatgcttgcacaatgggtgaatatagtgaaaaccactgaattttatactttaaaatgatgaattttatggtgtgtgaattctgtctcaattttttttttttttttttgagactgactctcgctctgtggtccaggctggagtgcagtggcccaatctcagcccactgcaacctctgcctcccgggttccagtgattctcttgcctcagcctcctgagtagctgggattacaggtgcccaccaccacgcccagctaatttttgtatttttagtagagacggggtttcaccatgttggctagactggtctcgaactcctgacctcaagtgatcttgccctcctcggcctgaggcatgagccactgctcccagtctctatctcaggtttctttttttttttttttttttttgagacggagtcttgctgtgttgcccaggctggagtacagtggaacaatcttcacttaccacaacctccacctcctgggttcaagtgattctcctgcctcagcctcccaagtagctgggattacaggcacacactgccataccagctaatttttgtatttttagtagagatagggtttcactatgttggccaggctggtctcgaactcctgaccttgtgatccacccgcctcggcctctcaaagtactgggattacaggtgtgagccaccacacccggcttctatctcagtttttaaaaatcaggtttataggtcatgagttcttgagcaactagactcccaccagttgtgcctccagttccctgtcatcttgagctagtcgtggacacctgcagcagacgtatgttcactgcgtgtttctgggctcccacacatttctaagccctcttgaagttaacttcgggtaatggcctgtgagaggaagtcacgtatgtcacttctggatggaagcatttaagagccagggccaggccctccagcaatcttcttcccatcaggacggcccggaagttgaacattgagatggtggaatgacaagagaaaaagctgcttgaaccactgagtcaccttatggaggccaagggcctagcggagtcaccctgcccacactagacgttgcttagagttcagcttgaagccatgtgatgtgggtcactgcccaggaggacttttttctagtgctgtggcctggaggactttccctctagcctctcatgcaggtgtactgtgtgatgtggtgggtctcttttctaacaggaagccccagtgggtgcagcagagctgtggctctcccaactcaagcacatctccacagctagctgccggcaagtacgcagctctcttggtggtgtctgagaaatggagcattaagccctcagtctaaaggagcatcttgggtaacctagtgtacctgtctcgagcagcaggcatagtacaatgtcaggccagcaccaaaggattttgtcttccttgtaagacaacatggggcaatagaaagctctgtatgggcaatcttgtaaatggtataataattatgatgcttttatagacaccgcatgaccgtccttagtcaccatagcgatgggatctaattattactgacttgttcatgttgtgggtttttagtaaccctactgcccacattctagaatttaaacacatgctgtgaatatccaagcacaggtcacagagatgacctagagttggtgctcagtacactttttttgtttttttgagaccgagtctggctctatcgcccaggctggagtgcagtggtgcgatctcagctcagcgcaacctccgcctcctgggttcaagtgattttcctgcctcagcctcctgagtagctgggattacagagcatgcaccaccatgcccagctactttttgtatttttagtttcaccatgttggccaggctggtcttgaactcctgacctcaggtcatcttcccactttggcctcccaaagtgctgggataacaggtgtgagccaccgcgcccggcctcaatacacatgtgattgccttgaatgcatagcaatgaccgaacatcaaggtgaaacgcaagcaacgctggggaaggaatgaccaatacggtgccctctgaggcctcagcccaggggccatctggcttgtctgtctcattagtaccattgttccctgtcagcttgtggaagagctgatttgaaaccacctgttggaccgaaggaagccactgaccaatacctgttctgtgggtgaagctgtcgcccagagcaccccctgtgactccgtggtcctctatgcactagtagaaactctgtttttgctgaatggcacagcccactactagctgaatgtggggtgacagtagccagcatgagaaccatcaagaccattatgggccaggagttgggtcaccccttccttgtctagggttgcaacaagaagtgacagagagggtcccacaaggtctttaaatctccctctgtaagttgtgggaatttcagtaacttgcttggtccttagggctttgaatctgagtctgtaaaatgggtgaaataatatttctctaaacaggtttatcatatgaatcaaaagaaattgtagaaggtgcctagccagggtgcttggcacgtagtaggtgttgagtgaacgttggttgcattgcttggctcctccttagtgagcctgtagtaaacacagtgctgtgtagactaggcaggcctttctctcttctgcaattctgagtgctttttcttaagaaccaaggggtactaacccttgttttagagacattcagaaactagccaggcgtagtggtgtgcacctgtagtcccagctcctcgggaggctgaggtgggaggatcacttgatcctgggaggtagaggttgtggtgacctatgattgcaccactgcactccagcctggacaacagagcaagaccctgtctaaaaataaataaaataaaataaataaataaatgtaaacaaggaaatagaaaacgtttatactgatggagtctcgctgtgtcgcccaggctggagtgcagtggcacgatcttggctcactgcagcctccacctcccgggttcaagtgattctcctgcctcagcctcccaagtagctggaattacaggcatgtgccaccacgcccgtctaattttgtatttttagtaaagacagggtttctccatgttggttaggctggtctccaactcctgacctcaggtgatccgcccacctcgacctcccagagtgctgggattacaggcatgagccaccttgcccggcccttatgtatttattttttaaagacagggtcttgctctgtcacccaggctggagtgcagtgttgggatcatatctcactgtaacccccaattcctgggctcaagtgatcctctaacctcagcctcctgagtagcggggactacaggtgtgcaccaccacacctcactaattttttaattttctgtagagatggcgtttcactatgttacccaggctggtctcaaactcctggcctcaatccatcctcccgcctcagcctctcaatgtgctgggattacaggcatgagccactgtgcctgtccagcaacaatatttataacagcccccaaaaggaaacaatccaagtatccatcacccattgaatggataaacaaaatgtggtatatccatacgatgaaatgttactcaggcatgaagaggaatgaagggcttttatgcatgccacaacgtggatggaccttgaagacattattctaagtgaaagaaaccagttacaaagggccacttattgtgtgattttatttatttatttatttatttatttatttatttatttatttatttgagacacagtctccctctctcacgcaggctataatgcagtggtgcagtcttggctcactgcaacctccacctcccaggttcaagcgattctcctgccttagcctcccgagtagctgggattacaggcgcctgtcatcacacccgactaatttttttgtatttttagtagagacggggtttcaccacgttggacaggttggtctcgaactcctgtcctcaagtgatcctcccgccttggtctcccaaagtgctgggattacaggtgtgagcctccgcacctggcctgtttttccttttaaagccgtgactctattttcccttctggccttggtgtgtgctcttccccactctgtctccttcccttttgagtcctttccatcaggaagccctccttaaccactaccagactcacccacacatgaaccggctcccaccatctgttctgtttattttggcaaggaaataaagatgtgtcttccaccagaaaagctgaggccactactcgattcagtttgccctccctgctggggcacaggtgtcatggcctcccttaagtgcttattaattcctgtgtttcagctttcatccttccacctgctgctaggcctctgtgcacacagtgctttgtggaattgctcccgtctcttcagcttagcagcgtgccttgaagaggaagagctgcagagaaattttgaaaataaattgctttttgaaaaataatttgacagtaagtcagggaccttgaaaatatttgttccctttgattcagaaatatttctaagacaaattcagaaattctttttttttttttttgagacaaattctgtctctgtctgcccaggctggagtgcagtggtgcagtcttggctcactgcaacctctgcctcccaggttcaagtgattctcatgcctcagccccccgagtagctagaactgcaggtgtgcaccaacacgcccagctaattgttgtattgttttatagaaacagggatttgttgtgttgcccaggctagtcttgaactcctgagcttaagcaatctgcctgcctcggcctcccaaagtgctgggactacaggcatgtaccactgcgcctggccagaatttctattttaaggaacttatcagtggcttacaaagacttatgttgaaaatatatcaatcctgtttttcatgacttttttaaaaacagttttaatttttttttctgtactagaaaatgcactgtaacttgacattgtaatagtgaaaatataatgacatttgagaatttataacaagaaaatgttcacaatttaatatatgaaaagtagaacaaaattatatgtagtataagaccgatcatgttaaaaacatgggcgggcacggtggctcacacctgtaatcccagcactttgggaggccgaggtgggtggatcacgaggtcaggagtttgagaccagcctggccaacatagtgaaaccccatctctactacaaatacaaagattagccgagcatggtggcaggcacctgtaatcccagctactccagaggccgaggcaggaaaatcccttgaactcgggaggtggaggttgcagtgagctgagcgagatggcaccactgcattccagcctgggcaacaacagagcgagactccatctgaaaaaaaaaaaaaaaggaaaagtatgtcctgtaatatgcatgtaaaaaactggtagaatgaaaccaaataagagtttggattatgttttccttaattttatgttttaaaatatagcacattttcttcactaaacatgcttttaaattttttaattgacaaagttgtatatatttatagtgtatggcatattgttttgaagtctggtagaatggctaaattgagttaattaacatatgcattacctcacacctttttttgtggtgagaacacttaaaatctactcttagcagtcttcaagagtacaacacattgctactaactatagtcaccatgttatacaataggtctttgttttttttttttttgagcggagtttcactcttgttgcccaggctggagtgcaatggcgcgatctcggctcactgcaacctctgcctcccaggttcaagcgattctcctgcctcagcctctggagcagccaggattacaggcacctgccaccacgcctggctaattttttgtatttttagtagagatgggggtttcaccatgttgcccaggctggtttctaactcctgacctcaggtgatccacctgcctgggcctcccaaagtgttgggattacaggcgtgagccaccgcacccagcctcagtaggtctcttgaactgtatttaattttaactttttgttttgaaatagtttcagatttgcaaaaaagttgcaacagcagtgctaacaattcttgagcgccctttacccagatttccccattgttaatattttaccatatttgctttatcaatgtgtgtgtgtgtgtgtgtagatatattttttcttgaactatttgagaatgagttgcagatatgaccaagatacttggttacccctaagtacttcagtgtgtattttcttcaaggcaaggacagtttttttttttttggtaagcaaaatacagtgatcaatagcaggaaattaacattgatatcctgtgttgtctaatcatagagtttctttacattttgccgttaatatcttttacatcagaaaaaatatgtttttttcctggtccaagacctcagagtgtgtgtgtgtgtgtgtgtgtgtgtgtgtgtgtgtgtgtgtgtcttagatcactcagtctttgtttatctttcatggccttaacatttttgaaaatgtgaggccgtgtctttgtcaacgtctcacagtttggtttgggtttgtataattcccttataacaagatccagcttccacccgaggcaacagagtgaacaacaacaacaaaaaaagaggtgacctgggtgcttttactaccctacattcagatgtgggagcaaagaaatgacttaaagttggagtttatatttaaaagggaagcggaatgtaagtttggaaaatttgcaggctggccatgtgacagaaagaaaaaactttttcaagagaattcaagcaggctgtggagcaaccgcttgctagagcgatttgtagatttaaaaaggagccaagtgctgatagccaagactgtggggaaaaaaaggccttgaaggcatttcagagaccttcccggcagcccctcccattacagttgtggaggcctcagagggaagaatgctttgtggttcaggcccagtgccagggacagcctcaggacactgctcctcacatccctggccattcagcttccagccttggctcaaaggggcccagatacagctcaggctgccacactagagggtgaaagccatgagccttggccgcttcaatgtggtggtgagcctgtgggtggacagaatgcaagagtgagggaggcttggcagcctccacctagatttcagaggatgtatgggaaagcctgggaaaggggcagaccccttaccgagaacctctggtaggagaggaatgtgggactggaggccccatacagagttctcactggggcactgcctagtggagctgtgggaagggggccactgtcctccagaccccggaatggtagatccaccagcatcttacaacctgtccctggaaaagccacaggctgtgagagcagcctcggattgaaccctgcaaagccaccaggacagagctgcccaggaccttgggagcccacccttcgcaccagcacgccctggatgtgagacatggagtcaaaaggagattatttgggagctttaagatttaatgactgtctgccaggtgcggtggctcacacctgtaatcccagcactatgggaggccgaggtgggagtgcattggcgctatctcagttcactgcaacctccacttcctgggttcaagcgattctcctgccttagcctcccaagtaactgggactacaggcacccaccaccatgcccaggtaatttttgtatttttagtagggacagggtttcatcatgttggccaggttggtctcgaatcctgacctcaggtgatctgcccccgtcggcctcccaaagtgctgggattataggcttgagccactgcgcctggctggagggaccggttttttaattgagagggttggtacttctcccttcctgcctttttccaagggctgctcggggcttgtgtgtgtgtgtgtgtgtgtgtgtgtgtgtgtgtgtgtgtgtgtgtgtttcaaagacagagatctgtatttattaactcaggtcagacacttgggatttttcaccaggcatcatcaccaatcagccagctcagattaattaatattaatttggttggtctgttcccaggcccttggtgtgcaggcactttctgtcattaagtccttgtgacccagcctcgtgtgacacatctcccatgatggggagccactcccccaatagcgcattctatgttcagactcctttattagaacgtctttgcttggaggggttgtaaacctctctcctctatgaccactcctatttctgaatgccaggcctctccctttggcagttttctgaccacctaaagaagggatcaagtacctctgaatcttcttttcttaggattaacttttccagtgtctttactgtttctttctttctttttttttttttttttttttttgagagatggtctcgctctgtcacccaggctagagtgcaatgacacaatcatcatggctcactgcagcctctgcagcctctaactcccgggcttaagtaatccttctgcctcagcctcctgagtagttgggactacaggtgcatgctgcgacacctggataatttttttttttttttgagatggagggggtggtctcactttgttgcccaggctggtctcgaacctctggcctcagcacttctccagcctcggcctcccaaagtgctgagattataggcgtgagccactatgcctgtttctcttgtgacaggtattggggactactgtgccctagagccactttctgagtgttgcagtttgtctttgatgttcaatgtggagctcatttggaattctattaaagaatccttagtgtgccttcccttttggggaagccatgttgacttcggcccatcctattctcatttcggtaaaggaggagggagtagcactgcccatgctgtgggcttgctgccgtggacttgctgtaggaattgtaacacatgcgtgtgtgggcagggggttggggggcaggtggcattctgattgcctccaggtgatctctccagactgttgcccctgcgctggaggcagaagccgacttcagaactgatctgcccagatttgagaaaagtaaagcaagacccctggctctgtttctcttattattattaatttttttttttttttttttttgagaccgagtcctgctctgtcacccaggctggagtgcagtggcgcgatcttggctcactgcaaactccacctcccgggttcatgccattctcctgcctcagcctcccaagtagctgggattacaggcgcccgccaccacacccggctaatttttttgtatttttagtagagacggggtttcaccgtgctagccaggatggtctcgatatcctgacttcgtgatccgcctgcctcggactcccaaagtgctgggattacaggcgtgagccaccgcatccggccgctgtttctgttttctatatttttattcaaaattaattgaggcaatcagctaggcttggtggctcatgcctgcaatcccagcacttgggaggccaaggcaggtggatcagttgagatcgggagtttgacatcagcctggacaacgtggtgaaaccccatctctacaaaaaaaaaaaaaaaacaaaaaaaccaaaaattagccaggcatgttggcgggtgcctgtaattccagctacctgggaggctgaggcaggagaattgcttgaacctgggaggcggaggttgcagtgagcctagattgtgccactgtactccagcctggggacaagagccagaccctgtctcaaaaaaaaaaaaaaaaaaaaaaaaaagaaggccgtgtttggtggctcacgtctgtaatcccagcactttggaaggctgagggggtggatcacctgaggtcaggagtttgagaccagcctggccagcatggcgaaaccccatctctactaaaaatacaaaaattagccaggcgtggtggcaggcacctgtaatcccagctactcgggaggctgaggcaggagaatcgcttgaacctgggaggcagaggttgcagtgagccgagatcgtgccattgcactccagcctgggcgacaagagcaaaactccatctaaaaaaaaaaacaattgaggcaaaagtggggatggtcaggaggatgaaccagcgtgaactcctgtggagagttttgtgcctgtaaatcaccttgtgccaccttttaatgttgacgctggattatatccatgcaatgccctggagcttaggggagctgtggtctcgtccccttggcattcaagccaaggagccaaggccgcagagatgctgctagaagcaggcacggggagctgcagctgcagcatcagcccctgtgggcctggtcagttcgatttgtgctgagtcatgcccactgttcgcctgctgtccctcctgtccccccagtcacgcttgcacagatctgactcagcagctgccttcctcctttcacgtcattgcatcgggcacatgctggtcatgtgtttctaaattaagtcctgttgtgtggggaaaaggccatcagctgggagcgtttggccatggccatcttcagtggagaatgttctccaggataccttggtgaaagccccgtgactgcattgatattaggggtgcaggcatcgttgtacagtagtaccttcctgtagcagcattctgatcacagcacccccttgccctgtcctcaccagcttccccagggccaaacaccttagactggcatacaggcccctaggcccttacgcactcatctgggtgtctcttaaaagtttatctcggccgagtgtggtggctcttacctgttatcccagcactttgggaggccaagatgggaggattgcttgagcctaggagtttgagaccagcctgggcaacttagtgagaccccatctctacaaaaaaatttaaaaaatcagctggtatggtggtgcatgcctatggtctcagctatgcaggaggctgagggaggaggattgcttgagcccaggagttagaggctgcagtgagctgtgatcacaccactgcactgcagccttggtgactccagcctgttccgtgaatgaatgaatgcttatctcttattcgccatctatgcatccccacataaaaacacatcccattgcaccacacttgagttaccccagaccccgagtttctcgtgttctaggctctggtacacgcttcctctatcggtagcttcgctcatccccctaatctgactggtggaccctgatcattcttcacaatccagcccagatgttggcctctgggagccccttccttgactgtttcagactgtcatgcctgctttttccttccagctctatttcccctgcacctggcctccccatgcagccgtgactgttgggataggtctgccctttctcatagcaggaggacaccttggggcaaggttggcatgtctgctcctgcctgaacccacacagttcctggagtgcagcaggtgctcctcagctgtttgctgcacgcatggacgtaagagtgacagaagcatgtccttcgacatgacgtttttgtacctgaacattgtctagaggctttccagactgtaagctctgtgggattaggagcctgcctgcctcgcactccctggcatccttagtgctttgggcctcacaggccagcggagccctcgtgcgggttccaggcctgctttggtgggagtgctcagtacttttagccacacagagccgtggcctgcaaggctttcggagtacatctctagcacatctgagaatccggaagcaactcagagtttctggaatggatttcacaaagtctgtgaataagaaggccccacaggccctactcaacagcttttttttttttttttttttttaaatacagaagatgctagtcttcaaagaacctctttactcttttactctttttctttttttttcgagacagagtctcattctatcgcccaggctggagtgcagtggcatgatcttggctcactgcaaccttcacctcctaggtgcaagtgattctcctgcctcagcagcctccagagtagctggaattacaggggtgcgccaccatacttggctaatttttgtatttttagtagagactgggtttcccaatgttggccaggctggtctcgagctcctgacctcaagtgatccacccgcctcagcctcccaaagtgttgggattacaggcgtgagccaccgcacctggccctctttactcttattatatagtgatggggtcttgctttgttgcccaggctggagtgcagggatactcactgcagcctcaacctgcagggctcaagtgatctcctgccttacctcccaaatagctgggactacagacctgagccaacgctccccacctctttactcttattttattttatatttatttatttattgagacggagtctcactgtgttgcccaggctggagtgcaatggtgtcatcttggctcactgcagcctccgcctcctgggttcaagtgattctcctgcctcagcctcccaagtacctgggattacaggcacgcaccaccacgcctggctagttatttttgtatttttagtagagatggggtttcgccatgttggccaggctggtctcaaactcctgacctcaggtgatccacctgcctcagcctcccaaagtgctgggattccaggcgtgagccgctgtgcctggcttactcttatcttagatatcacgctaacaagcagctgatttcccaatttacgcagattcaaagcagccaattagaaatgggtgagagacttttgaaaaaaaacgtaggcactctcgtggccgggtgcagtggctcacacctgtaataccagcactttgggaggctgaggcaggtggatcacgaagtcaggagatcgagaccatcctggctaatatggtgaaaccccatctctactaaaaacacaaaaaattagccgggtgtggtggcaggcgcctgtagtcccagctactcaggaggctaaggaaggagaatggcgtgaacccaggaggcggagcttgctgtcagctgagattgcgccactgtactccagcctggacgacagagcaagactccatctcaaaaaagaaaaaagaaaaaacgtaggcactctcataatggtgagggtcatcctgcctcaagaaaagacaaacactatcaacaacaaagatgcaggggccgggtgtgctggcttacacctggaatcccaggactttgggaggccaaggtgcgaggatcgcttgagcccaggagtttgagaccagcctgggcaaccaagcgagaccccatctctacagaaataaaagtttttaaaaaattagctcggtgaggtggtgcatacctatagtctcagctacttgggaggctaaggtgggaggatggcttgaggccaggagtatgagggtgcagtgaactatgctactgctttccaccctgggtaacagagtgagactgtgtctctcaaaacaagcaaacagaccaaaaagatgcaggaacctgagatcccacagcctgggttccctctgtgtgcaagcaacctctcctgcctctttaggccctaagtatgttgtacaatgacacgatggccgagtagtctacaaaaggaaccgtgcgtggactcgagacagcatggacatggttcacgtattccggaagtatttctctagctgtgtagaattttagagctgaggatgatccttggtgaccagctccatattgctttgtggagaagaaacctgagtcctgggaggtcaagtaacccgttcagactcccacaaccagagcctgcggcatctgtactgcccagtcagtacagagctccggtaactaggtgcacttcagttatctagagtaggcgctaataacttatttcttgtcagaggccaggtaataaatattttttaggctttgcatgccaagaagtaaaatctaggatgttatatataatgagaggcaacaagtttccatgttttttgttgatgaaattcaaataaggctggttgcggtggttcacacctgtaatcccagcactttgggaggccaaggcgggagaattgcttgagcccaggtgtttgagaccagcctgggcaacttagccagaccctgtctctataatttgaaatatatatttttaaaagaaattcgagtaataactaataacagttgagtgcaagtttttaatacaggtttgttaataagaagaatggaatgatttttgtagggataacaattttgggccaggtgccatgactcacgcctctaatcccagcactcttggaggctgaggtgggaggatcgcttgagtccaggagtttgagaccagcctgggcaacatggctaacccctgtctctacaaaaaaatatttaaaaagttagctgggcatggtgggtagtatacacctgtagtcccaactactgtggagactgaggtgggaggatcacttgagcccagaaggctgaggctggagtgagctgcgattgtgccactgcactgcagtctgggtgacaaagcaagacccagtctcaaaaaaacaaaaaacagaaaacaattttgtttcattggggttctgaattagtgttcccaaacatcaaaatctgttgcaaatatccccgtgtcagtgctcatctgtaatgagattgtataggtgacatctttgaaaatatcttttcacacaaataggtactgccaagttatattggtcagggagcataaattttgatggggcattttaatcattggaagacagcatttatagatttttttttttagattcccctcttgatatttgcctttttgcattattgcattgcagatcagccacttccaattgaaggttagatgagagctgctcaattgtacagttaaatggattttaaaatatgggaatttccttcatacttagatcaagatctgaaaaacgctgctagggctagaactagcagctcaaagtttttgttttttttgagctcaaggtttgagctcaaaaaaatgtgcaaaggtttttcacttgttctaaccttgacagtctaggaattgtatggcgcaggttgacattacttgtgattcatacaatgttaatttcattgaaatgactttaccgcaatataagttttgcatataactgctgttttgccttataattttagattggcctcattaagaaacatcaagtctgcagcaaaagctaatttccaaagcgatttagtatttggtaatagtggttgagggcagttctttcttttttctttttctttttttttttttattgagatggagtcttgctctgtcacccaggctggagtgcagtggcatgatctcggctcattacaacctccacctcccaggttcaagtgtttcttctgcctcagcctcctgagtagctgggactacaggcacgtggcaccacacccagctaattttttgtatttttagtagagatggggtttcaccgtgttagccaggatggtctcgatctcctcaccttgtgatccgcctgcctcggcttcccaaaatgctgggtttacaggcatgagccaccgtgcccggccctctctttttttattttttatttttatttttagactaagagggcagtacttttcagttattcttgttcagaaaagatttaatattcactctgagctcaaaatagtcacaccagactttaccactgctaagctgctgaactgctgtatggtaggccagttaggatattcagcttctatttttgacaaaaatccttaagaccaacttaggttaagtccatgagagcagatactgttgacattcccttgttcgatcacatataatagattcaaattttttgcataatatctgctggtgaataatatagtgaacaaccataggctccaactaagcctttttctgccccccacattcattataacacatcttagtggattccatttcagattgtactaaacttttctcaacttctttgaaaatgctcttatttgtagttgtttcatgctaattcttcaaacttggtattgactccccaagtaaacaacaactgaaaagtattggtaacgtctttagattcatcaagagccaaggaattgcattcttaaaccctcttggtggcttccctgtaaatgcttccaagatatgagcgaatgctatagaaattgcaggaaagtccaaagggctgcgcgtctcctgtggctcagtcttatttcatacctgcaacatcttttaagggaaatttgcaaaagggagaattatcaacttaaaaaaaaaatagccaaggaaacctcgactcttcaaggaagcaaggaaacgtgctctccttgggagtgacattagaggaggcccagtgtgagtcaggacttcatcaccacctggcggaaccagggagccccaccccatgtgtcagtggagatcatgtgctgtcttccctctccaagctagggtttgtcagcagaggcccaggagggagactgaatctcgcctgacagcaatgaactgataccttccttccctataagcaggtgacagacaatatttaataaaatcaaaagaggctgggtgcaatggcttacacctgtaatcccaacactttgggaggccaaggtgggtggatcacttgaggccaggagtttgagaccagccccagcaacatggtgagaccctgtctttactaaaaatacaaaaaaataaattagccaggcgtggtggcacacgcctgtaatcacagctactctggtggctgaggcatgagaatcagttgaacctgggaggcagagattgcagtgcactgagatcacacaattgcactccagcctgggcaatagagacagactctgtctcaaaaataaaataggcttaaataagattcaggatcttaaagtacccagaatgcccagaatacaataaaaatcaatcactataccaagaaccacaaaactctcgaatgagaaaagagagtcaacagacaccagcatcaggatgacacagatgttggaattaagatatagagaagaatgaaacagatgtcttagaaccgaaatatacaatagtcaaaataggaaactgaatggatgactccacagcaaaatggaggagacagaagagagaatccatgaacttgaagttagagcagtagaaatcacctaacctaaacaacagaaaatagactgaaaaccaaaacaaaacaaatgaacagagcctcaggattttgtgggactaataacaaaagatctgactttcatgtcacccaagtcccaggagaagaagagaaagagagtgaggctgaaaagttatttaaaaaataatggcggccgggcacggtggctcactcctataatcccagcactttgggagacagaggtgggcagaatctcaggagttcattaccagactgggcaatgtggcaaaaccctgtctctactaaaaatacaaaaattagccaggtgtggtgaggcacacctgtagtcccacctactcaggaggcctgaggcaggaggatcccttgagcccggaggatccctcaagcccagaaagttgaggcttcagtgaacagtgattgcaccactatgcctccagcctgggtgatagagcaagaccttgtctcctaaaacaaaaaagaaaagaaaagaaaagttgctatattttgcaaaagacataaatctacagattcaagaaactgagtgaaccccacagaaggtaaacacaaagaaatctgcaccaacatctcagtacagataataaacttcctgggtactctggctattgtggctgtggagcgatctgtctgagtcactcttggacactgctttttaacaggtcaccttggagagtgtagtgttccccgagtacctctcagtccctgtgggttgcgctgtcaggcaacagtagggtatggttccatgagggttttccctcatcttgaagccactaaaccttggcagaggggcttgtgaacctgaatgaccccgctccccctgcagccagaaggtgcagcccctggtgccagagccttgtctaggtggccctgacatgacagtgacagctaaagggttgactaaattacaagttttattctttcctttcttgttactgctttgattggggtgtctgactcaccccaatatcagtgctgagttggttgctcaatcttttttacggaccagaagttgcaaacagtaaatgcaaaactgcaaatacttcctggaagataacctgttccagtgttgcaaatggttggcctcagagagcccttgtgttcttgcgtcattctccctttcagaagctggtgaggctcctgccagtgccccccagcctgtgtgctccctgatttatttgtccatcttgctcagtggtgtgtgggagggactggagctgttgcccttgattgctaccttggtgggaaccagccagctaccgaaattgacagggaatcgtggtcaagctatacatgcatagtttttacccttctctgtatgttgtattttataataatgaaaacatgtagagacctaatttataataaaagtcaggtctgctctatttagagttggggagatctagttggctggtattctgacatgtgcctttttctgtgcctaattttttcttgagacaggacctcactctgttgcctagactacagtgtagtggtgtgattatggctcaccgcaacctcaacctcctgggctcaggtgatcctcctacctcagcctgccacatagctgggactacaggtgcgcaccgtcacacctggctaacttttgtattttgtggtagaagtggggttttgccatgttacccaggttggtctcaaactcctgagctcaagtaatctgcccgccttggcctcccaaagtgctgagattaaaggcatgagccactgcacccagctctgtacctaattttacagatgagaacatgaaagccttctgttggtaaggggtgtgtctggggtcccagccagctggtgtggcggggctgtggcaagagcctggtctagttcttgtttgctgtttggattgatactgtgtttggccccatgagctctgccttgtctcttgttccttttgctgaaggtataaagaagaaactcagagattaaagactctttcagggcagaaggctcacacaggcttccagaacctcctcggagcgattgtagggactgcctgacccggaagagagttgtcagtcaagaccgccagagttttcccatcagagtatttggcatagcagaggtggctcccaaactgtgccagggcactgcagcaaactcacaagtgatcattctcaatgcggcggacgctcaagtctgttgaactccatgcgaagtgctagcttgggacagttcacggttccaacgtgagatccttgctgcattccttcttaggattttacatctttgcgaagctgggtttgcagtggttgttcagacctaactatacgtggaactgttaggcatttttttttggcctacggataccattaaaaatttgctgagataccagggactccacaaacgaaggacatttgggatctgtccagacaggtacactggaagcccaatgtgtgttttatttgttaattgattgattgattgagacagtcttgctctgttgcccaggctggagtgcaagtggcacgatcttggctcactgcaacctccgcctcccgggttcaagcgattctcctgcctcagcctcccaaatagctgggattacaggtgtctgccaccatgacctgctcgcagcaccacgcccagctaatttttgtatttttagtagagacggggtttcaccatgttggccaggctggcctcaaactcctgacctcaagtgatatgcctgcctcagcctcccaaagtgctgtgattacaggcgttagccaccacggccggccccaatgtgtgttttaaatctttgcacttaaatgtttttgatttctgcacattttgtgttgcacgtgtcataatgcattcaccgattcccttcattcccttgagtagttattgcgccctggattctgcgccaaggaagtgtgtgctggggaggggatggtggagctgaggtctgaagaatgagtacgaagcttcgagaggaggagcatctcagacacctgtcaggctctggggcaggaccgcagaggtgcaagctggagagtggctcagggtggggctggagagatgggtgtgtgtctgtgtgcgcgtcaaggggaaaacggttaagtttcttaacccaggggctcatttgtggcctcagcccccaggcacactgcttggatcctgggattcctccaagcttaacctccttgagaggccttcctttcgcaccgcatgccagacacagaggtgcctgagatgctgttcttccctcaaggagctcacaccgagtgagagagagacccatgtcctaagtagagggcggtgagcacagcccggtgggaagctgggcctgtttctcgttttgcccgagtgaggtgcttaccccgtgtggcctcatctgtagctcagggccttggataaagtgatggctgggtccttcccaccgcacctgtcttctctcagaagtagtttgatatttcagagtcaaagctgctgggaacattcttgttctgtggagcctccaggctgagcgctgggagtgcccagtgtgctggtcggggctggggggcactcagggccaagccccacccctgttggctgcaggaagtcagtcacagcctcaaggagcagctcctgttcgtttccttcgttttgcgtgttagtttccttacaggcgtgagactgtgtggtcctgactgtgaactccgggaagaggctgaaagaagctgtgagtgcaggtgttagagacaggcagcatgaagaggagggaatagagtcagcctcacagactgtcctgatggagttgcagtgtggttttcagattataaaggcattccatagtctgtatgccaagcactgccaatccaggtacccgaaaatcggaaggttcttgccttctattcacatgtttatttattcaacaaatcgacataaatgctcattatatgccagtctgtgaactaagccaagtccctgcccttgtggggtgaccctctagtcagggagagagccagtggtggggtaatgtataatataatgtgaggtggggataagctcagttgtgaggggtcagagggtggggattgtggccagggggcagttgtagattctgttctcaggcaaagtttctctgagatggtgacatctgagcagaaacttaaatgagggagtgaattttgcaaataatgagatggccatgtgcaaagtccctgaaacagaaggaggccagcgtgacctgcaaggtgtgaggaaggggagcgtagtaagaaatgtgggtggtgggagtgggttctgagggccggatcgtatgggccttatgagctgtgtaaggacttcagggctttgttgttgttgttgttgttgttgttgttgtttttgagacggagtctcactctgtcacccaggctggagtgcagtggcgtgatctcagctcactacaacctctgcctcccaggttcaagcgattctcctgcctcagcctccccaagtagctgggactacaggcacgcgtcaccatgcctggctaatttctgtatttttagtagagatggagtttcgctgtgttggccaggctggtcttgaactcctgacctcgtgatccacccgcctcggcctcccaaagtgatgggattacaggcgtgagccactgtgcctggccactttaggtttttgtacgaagtatgatgtgaagacatctcagggtttgttgttgttgttgttgttgtttgagatggagtctcactctgttctccagcactccaggctggagtctggagtgcagtggtgtgatctcagctcactgcaacctccgcttcctgggttcaaatgattctccagcctcagcctcctgagtagctgggattacaggcatgcgccactgcatccggctgatttttgtatttttagtagagacagggtttcaccatgttggccaggctggtctcaaacgcctgacctcaggtgatccacctgcctcggcctcccaaagtgctgggattacaggtgtgagccaccgtgcccagcccatctcagggttttgatcagggaggggacatgacctgacttacttttttttttttttgagatggaatctcgctctgtcgcccaggctggagtgcagtggcacaatgtcagctcactgcaagctctgccttccgggttcacaccattctcccacctcacctccctcctcctgtttctgggactacaggtgcctgccaccacgcctggctaatttcttgtattttttttttttaagtagagacggggtttcactgtgttagccaggatggtctcgatctcctgacctcgtgatccacccgccttggcctcccaaagtgctgggattacaggcatgggccaccgtgcccggacgacctgacttactttttaaagcatccccctgtctgctgtgtggggaatggcccgtccatcagaattctcttgcggtgattacgtaggtgcagatgtaccgctaacctcactcccagcgtcgtcgatttattaatagaaactgccatgagttatgcaatcagcttgagtctgcgttgagaaggacttcacatcatgggcattagatctcttctggaaaatgaggggaccggtcacttggggagttagaagggaggagggtgagggacagggagcgcgagtttcttggctgctgccttgtgatggataacagctagacagctaggggagctcctgtgtcaccatggcactcctgactggttccagtggggccctgactgtctgctgcctcatgactctgtgggacaagtccttccagaatctgtcagagcagatcctaaatgcctctctgtctggttctatgaaaatgtgacaggtggctcataagcttgacagagatcctgatatgactagcattaagtaaatattaaatgtgtttataagattaaatataaatagttttctctggggacaacagaattcactttgtcctttaatgtcatatcaaaaaagctggccaggtgcagtggctcacgcctgtcatcccagcactttgggaggccgaggcaggatcacgaggtcaggagtttgagaccagcctgaccaacatggtgaaactccatctctactaaaaatacagaaaattagccgggtgtggtggcacatgcctgtaatcccagctgctcaggagactgaggcaggagaattgcttgaatccgggaggcagaggttgcagtgagccgagatcgcaccactgcactccagcctgggtgacagagcgaggctctgtcccccggcccccccccccccccgaaaaaaaaaaagtcatatcaaaaaagccaagttgaggccaggcacagtggctcacgcctgtaatcccagcactttgggaagccgaagcaggcagatcacctgaggtcaggagttcgagaccagcctggctgacatggtgaaaccccgtctctactaaaaatacaaaattagccaggtgtcgtggcgggcacccgtagtcccaggtaccctggaggctgaggcaagagaatcgcttgaacccaggaggcggaggttgcagtgagtcgagatggtgccattgcactctagccagggtgacagagagagactctatctcaaaaaaataaaataaaaaagaaagaaaaaagctaaattgagatgaactcaagccattggaaaagcagctcagattagtgagaaagcaaagacccaagcttgcgggcctgttctgaatggcctgttcccagcaggttgtgtagcagtagaccgatgcccacaaccctcggatgccctggcttcccagaccagccccatggtttcctggtgacagtgacagccatcagcagtcagctagaacatagtctctcattgcctaattgctgacacatgactaaggctttcctgattgagtctgggtgctctggttgtggtgaaaaacccagtcggtcatatccatgattgcaaaatggaatagtgtgaatttcagggctgagcccagcctccttggtaagcagcagaagctgctgtttcagggactctcacttggacctttgttgactcatgtcacgtctgcctaccaggtgtcgttggtggaaggaccagttgagcatcttatgagggaactaggctggtgacatgggggttcccccacctccctcccggacggggcggctggccgggcggggggctgacccccccacctccctcccggacggggcggctggcggggcagaggggctcctcactgcccagtaggggcggccgggcagaggtgcccctcacctcccggatggggtggctggccgggcggggggctgacccccccacctccctcccggacggggcagctggccgggcggggggctgacccccccacctccctcccggacggggcagctggccgggcggggggctgacccccccacctccctcccggacggggcggctggccgggcggggggctgacccccccacctccctcccggacggggcggctggccgggcggggggctgacccccccacctccctcccggatggggcggctggccgggcaaaggggctcctcacttcccagtaggggcggctgggcagaggcgcccctcacctcccggacggggcagctggccgggcggggggctgacccccccacctccctcccggacggagcggctggccgggcgggggctgacccccacctccctcccggacggggtggctgccgggcggagacgctcctcacttcccagatggggtggctgccgggcggaggggctcctcacttctcagacggggcggttgccaggcagagggtctcctcacttctcagacggggcggccgggcagagacgctcctcacctcccagacggggtcgcggccgggcagaggcgctcctcacatcccagatggggcggcggggcagaggcgctccccacatctcagacgatgggcggccgggcagagacgctcctcacttcctagatgggatggcggtggggaagaggcgctcctcacttcctagatgggatggcggccgggcagagacgctcctcactttccagactgggcagccaggcagaggggctcctaacatcccagacgatgggcagccaggcagagacgctcctcacttcccagacggggtggcggccgggcagaggctgcaatctcggctctttgggaggccaaggcaggcggctgggaggtggttgtagcgagccgagatcaagccactgcactccagcctgggcaccattgagcactgagggaacgagactccgtctgcaatcccggcacctcgggaggccgaggctggaggatcactcgcggttaggagctggagaccagcccggccaacacagcgaaaccccgtttccaccaaaaaaatacgagaaccagtcaggcgtggcggcgcgcgcctgcaatcgcaggcactcggcaggctgaggcaggagaatcaggcagggaggttgcagtgagccgagatggcagcagtacagtccagcttcggctgggcatcagagggagaccgtggaaagagggagggggagggggagggggagggaccagactttgtctcttaaaaaaaaaaaaaaaagactcccaggcataggaaagcaggcattcaccataaatctcattgttaacaggaactaccttcatagcccaaggttttaggaatacagagacactcttgccagtcaggatagtccaaggctcgtgaatatcaggagccactcaagggccaggcctggagacttggaacatgcagggtttagggcaacccccgccagccacacagctggggaaagggtttgctgcgaaatggtccactcttgcgtgcacttcctcccgcctgccccccgtgcggtgtccttgtgggattagaggatgttccagcacactgagagtcagtggctgtcattttctctgtcttccagggacccagtcccagctgctgccttagcttgcaccccaggaccaccctgggctggtgctgacaccactgggggctgtctgttatgtcagccccagtccaagactgtggctgtcttggcaggaacctggctgagtgagccccttctcctaccccgtgcagtgaccatttcctgcagccccaggggcaaggcccagcatttaggtgggcaccccagccagcctcaggggcaccctgctaccctctgctgacatctgctgtttctgtctcctaacagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgtaagtgccgcctctcagcctcctctctctgtccctcttctgtcaccactccaagcagtgtcctgcatgcgggcctcaggctgaaagaagcaaggctccttgtagcattttggggtgactcttgggttttgccttcttgctagattgtgcttgagctctcccttaatcatctcttatgtggggtttataaggcccttttctatctgctgtttatatgaccttcacaggaagcactgcgaaaatgacaccagtttacagattaagaaccgggggctcaagaatgttaacgggcctgccagggtcattagccagcaatagcagcgctagagctggaacccttttttccatttatttatttatttatttatttggagacatggtctcactgtattgcccaggctggagtgcaatggcggtggcacgatcaaggttcactgtaatctccacctcccaggctcaggcagtcttcccacctcagcctcccgagtagctgggactaaaggtgtgcaccactatgcccagctaatttttttttttttttttttgaagcagaatcttgttctttcaaccagtctggagtacagcggtgcgatctcggctcactgcaacctctgcctcccaggctcaagcaattcttctgcctcagcctcctgagtagcttggattacaggtgcccgccaccacgcctggctattttttgtatttttagtagagacagggtctcaccatgttggccaggctggtctcaaactcctgacctcaagtgatccgcccacctcggcctcccaaagtgctgggattacaggtgtgagccgttgcgcccagtcaatttttgtatttttttatagagacagggatttgccatgtcccgggctggtctcgaacacctggactcaagcaatccgcacaccttggtctcccagagtgtcgggattacaggcgtgagccactgtacccagcctagaattggcattttaaagtctttttaaggctgtagccacctggaaggctatgtgctaatgagcacaaaatctttggacaggccttattttgttgctcttttaaacttttcatgaagcttccttttaagaataagtgaaaaagatggattagttaaaagaaaaacgttaaggaaataatagtatagatggtatgtagacagaaaaaaatgataccgaaggtctgcctaagtgactgcatccctgtctctccaagattgatttccataagccacacggaaaagtcattctccagattttagggtcctgcggccagaattacttcctgcggttacgcttggctgtgtttaacaccagtctcagactccaggggcccgcagccaggtttgagtggggacctgccaggtcaggtctgagccgagggaactccaggggcacgggcctgctgccttcagggactccctggatttggcaaggggcaggtctcaggggcaggattgggagccattctcagaccagaacccctttcattctgtctgtcttcaggggacccagtcccagctgcagccttagcttgcaccccagggccaccctgggctggtgctgacaccagtgggggccatctgtcatgtcagttccagtccaaggctgtggctgtcttggcaggaacaagccacacagaaaagtcattctccaaggctgggcatggtgaagcatgccgctcacatcaaatcccgattccctattccaatctgggtatcagccttccccgccagaacacttacagccttcacaccgtaaagcagatattcacacaacacagttcttataccatggacagggaattagttttacatttttaaaaactgggttcagggccaggcacagcggctcacgtctgtaattccaccactttgggaggccgaggcgggagaaatcacttgaggtcaggagttcgagaccagcctggccaacatggcgaaaccccgtctctaccgaaaatacaaaaactagctgggcgtggtggtgcatgcctgtaatttcagctactagggaagctgaggcagaagaatcgcttgaacccaggaggcagaggttgcagtgagccaagaatgcgccactgcattccagcctgggagacagagtccgtctcaaaaacaaaacaaaacaaaacaaaactgggttcaatcttatctccatcattgactcactgagcaaacatttcctgaggccctacctacagtgtcccagacactatgctaaggtgtgtggctgcagcagtgaagaaaatagatgaatgctgtcttcatcaagcttacgctctagtggtgagtgaaccctgggcgagaccttaacctcattctgcctcagtttcctcacctgctaaatggaggcagtattcccaatcttgtggggcttttgtcttaaatgaggaagagtctataaactcacctagcactgcccctgagggataggagctgtgtagtgtttgcgttgatcgtatttcgtgccaggcactatgacgggcacgatcaggaccacagagccagcatttatgttaagctggaaaatgagggtgttgcaacatagtttttttttttttgagacagacttttgctcttgtcactcaggctggagtgcagtggtgcaatctcggctcactgcaacctccgcctcccgggttcaggcgattctcgtgcctcagtctcccgagtgcctgggactacaggcacatgctaccacgcctggctaatttttgtatttttagtagagacggggtttcaccatgttggccaggctggtctcaaactcccgacctcaggtgagctgcctgcctctgcctcccatagtgctgggattataggcgtgagccaccacacccggccacagcgtactttttagaaatgctttgtgaactgctttaacctacattgtctaatcagggcctccttgcaacagcgccgtgcgttaggtagcgtgggttgcctcatttctgctctcagagaggttatgggatgtgcccagggcacaggctggagagacaggctccgccagctctaagagagaaggaattggtgcggggatcagaccaagtcctgcaggaggggtgttgggcaggttcttaaaggtagagccacaccctgaagctgaaaggactttagagcagagggcccgatataggaagggcagatcagctggaatccagcccatcctgtccagggctggtacacggggcattgctggtgtggaatagtacttttgataaaaaagcgtagtagtactcaagataaagagaccagggtccaggacccagctcctgaactggcccttgttccctcatctgtaaaatggaagttccgccccaccgccgtgagtgaggacgtgggttggccctgggagcctgcggagctgccaccaagggaggcagcattcctctcatagctcatctgttctcgctgtcacctccctggccttacaagaggaagttgacataaaacctgtagactgtgggagctgtagggtcccaaagcacttgtatttttttgttgattctcactgttcctctttgccaggatgctgaaattctgttccctccacctaatcatgatcttctaaccttatgtgtgtggagatatgcagtttccagagtcttgtctcttccctcattaaatcacactggatgcctgctgcagccagggcttttacctgtacgctgtacaagacaaatatttctagtaccatggctacattctggaccctgaagttgggtgctcaaggttgagtactgactctcccacattagccatctgacatcagccaggtgacttgatctttccaagtctgtgtccccaactgtaagctggaggtagtagtagtacttacctcataaggctgtgaaaactgagttaatccatcatagagctctttgctcagttcctggtgcatagtaggctctcaggtgttatggattgttactatttatttatttattttgaggcagggtctcactctgtcgttcaggctggaatacgctggcacgatctcggctcactgcaacctccgcctcccaggctcaagagatcctcccactttggcctcccaagtagctgggactacaggcgtgcaccaccacccttggctaatttttatattttttgtacaaatggacatctaacaatgttgcccaggctggtctgaaactcctgggctcaagcagtctgcctgcctcggcctcccaaagtgctgggattacaggcgtgagccaccatgcctggagtgtgttattatttttatcctttttattaataccatctccagtcttacaagagcccttccacgaagacatgagcagcccattttgcggatgaagaaaccgaggtgccagggattgcagagtttgcccaaggccacctaacttctaaatagcagcagagttggcttttgaatgaagtctgcaagctccacaagccatgttttctctactttgccatgctgctcctaatttagtgttaataggcctcctacgatagtgttagtctcctaagatagtgttaataggcctggcatggtggctcacgcctgtaatcccagtgcttagggaggctgaggcacaaagattgcttgagccaggagttcaagaccagcctgagcaacatagggagacccccacccccccgccatctctacaataaacaaaaaagagtggtgttaatttgttaatttaccgacaaggagagtattccttatctgaagtgcttgccagaagtgtttcagatcttggactttggaatgtttgcattatactcaccagatgagcatttcttatctgaaaatctgaaatgctccaatgattcttccctttgaggatcatgttgacgctcaaaaagtttcagatttcagattttagattagggacattcagcctgtagatgttattttacagagcaggaagttgggtgtagtggttcacacttgtgatcccagctctttgggaggccaaggcaggaggattgcttaagcccaggagttggagaccagcctgggcaacgtagcaaggccctgtctctataaaaaataggagaaaactgaggctcagaaaggtcacctagctgatacaaccaggcctcaagcctagatctcctattctaaatcccacatcagtgtccctggctaccggtatttcagtgagcacaggtgatttctgttatagccacagagcagtagggagtaatagggcttagtgtgaggaaggtatgtggcccagggctatatcaggaactctcaccatgatttctggtggcttctagaattggcatttatttattttgttttagagacacggtctcgccctgtcacccaggctggagtgctatggcgcgatatcagttcactgcaacctctgcctctggggctcaagcgattctcttgcttcagcctcccaagttgctgggattacaggcacccaccatgatgcccggctaatttttgtatttttagtagagatggagtttcaccacgttggccaggctggtcttaaactcctgaccccaagtgatccatccgcctgggcgtcccaaaatactgggattacaggtgtgagccactgtacggggccaaacacatttttaaaacaaaaaacccagtgggatttttgttggaattggattgaatctgtatattaatatgggaagagttgacatcctacaatattgagctttctattccatgaacattgttttatccctcccggggaggtcttttggactgtttgtaatagcaattaatgacttgttagagaggagtggtaatgagcaacaagttctttttcataataatagtagcagtaatgataataaatggctcttcctgccaggtgtggtggctcacgcctggaatcccacacttcaggaggccgaggcaggtggattgctttgagcccaggagttcaagatcagcctggcaacatgacgaaaccctgtctctacggaaaaaatacaaaaattagccaggcacggtagcatacgcttgtagtcccagctactcaggaggctgaggtgagaggatcacctgagcctgggatgccaaggctgccgagcgccgagctcacaccgctgcactccagcctgggcgacagagcaagaccccctctcaaaataataataataataataataataatatataataatgactctttcacgtccactcccactcactcaggttgcacctctgaacagagcatttcgcactggggcagctcatgccctaagggagccccagggaatgctcagcctcttgagtagctggggtgacgggcacatgccaccatgcctggcttatttatttttttttaaagacatggtctcgctctgttgcccaggctgggtcttaacctcctggcctcaagcagtctccctgcctcagccttgcaaagttctgagatcactcactgtgtaggatccaaagtcccacaggatccagggctcctgtgggctctctctcctgtgggcctggcagctttgctcacccttatggaacaacaccgcatggcgtgccctcttggtgatggaatttgtatttttgcctcccatggtgcagagagcgtcccatttccatctgggtccctaccttagtgcggggccgcctgtcggagggaagcttctcagagaatggccgttgaattaaccaaggctaaatctgtatgtgtggctgcctctagggaaacctgtggcctccaggctgggtttggcttacacagtatttttttaaaaaatattttaattagaacattaaaaagtgtggcagtatcaggcccagcgtggtggctgacacctgtaatcccagcactctgggaggccaaagcaggtggatcacatgaggccaggagttcaagaccagcctggccaacatggcaaaaccctgtctctacaaaaagtacaaaaattagctgggcatggtggtgcgtgcctgtaatcccagctactcgggaggctgaggcaggagaattgcttgaatccaggaggtggaagttgcagtgagctgagatcacgctactgcattccagcctgggcgatgaagtgagaccaaaaaaaaaaaggcagtatcaaataaaaacttagacttacagcttctttaaaaaaaaaaaaaaaatagaggatctggtcatactggacccacagtgatgcccaccagctgtggagcagctgagcagcggccccattctgcacgaggcctgtgcgctgcattcactctgaccctccagcccgctcaggctgctgtgctcatgttgcctctactggccctgagaagctctgcagtgccccctgcacctgtgctttgctcctggaatgctagagtgctttaaagaaaaataaagcttcttatggaacatttcaaacaccagagtgtagggcacaggagagtggaccccatacgcctccagcccccagttttcataactactcactcctcgccggtcttatttctttccgctgccccccaccgccgcaccagtcctggattattttaatgcaatccccagatgtcatatttcatcaggaaatgtttcagtcctctaaaattcaaggactcgccaggcatggcggctcatgcctgtaatcccagcacttcgggaggctgaggcaggagaatcacttgaagccaagtgttcgagatcagcctgggtagcatagcaagaccccgtctctacaaaaaacacaaacattagtcaagtgtggtggcacatgcctgtggtcccagttactcagaaggctgaggtgggaggatcacttgagcccaggaggttgaggctgcagtgagccatggttgtgccactgcactccaacctgggtgacagaacgagaccctgtctcaaaaaaaaaaaaaagtaaacttcaagtattctcctttctgaacataacacaacgccatcttcacaccttggaagtcaacagtaattcttcagcatcgttagatacccagacaacatttattcatagttccctgattgactgatgtttgattttgtttaacagtttttgtttgtttaattcaggatctaaacaagacccatacactgcagttgattaataaatctttcgtttgggagaggtcaggtatattcaggtataatttgcatacagtaaaatgcccccctcctcccttttttttgagacagggtcttgctctgtcacccaggctggagtgcaggggtgtgatcagggctcactacagcctctacctcccaggcttaaggggatcgtcccatctcagccccctgagtagctggggctacgggcatgtgccaccatactcggctaatttttatttttaattttagtagagacaaagtctcactatgttgcccaggctggtcttgttcgaacgtctgagttcaagtgatcctcttgcctcagcctcccaaagtgctaggattaggattacaggcatgagccactgcactgggccaacattttcctctttaagtgcaccagttcatgagtcttgacagatgtatgtgattctgtaatcagtatcataatcgaaatctagaacatttcatcactccgaaacagtcctgtcctacctctttgcaatcatcctcctccatcgggtaatcagcctctggcaactgccaatcttatttctgtccctgtagtttaacattttccaaagcgtcacataaatggaatgatagcaccgtgggctgctgtgccagcggtttttccttagcgacacgtcagctccctttccattcctaagcttcccttccatcccgtttcttccttgaaacatcatttgtatcacagtttcccacagtctggattttcctgattacgtccccctggagattgcttttgaaaagccacaaaagatctcattttcctgagtgaccttccttttggggcctgttcttgacagaaagcccgggaggccaggggtcagggctgccagcatcacgtgtctgttttttatctcctgagtgccaacagatgggaagtggatctgggggtcttgccacatccagttcagggtcactttctctgtagtgaggtccttggctccatcgagcatgaaaagagaaatacaaatgagactgacaaagaggaaagcattaggggaagcctgtggccacgagagtagacggtgcagggggcccactgcctcccgctgctgtgggaacggcgaggacatgggccagggtgtttctgccacttctgcaagcacagctctgggttttctgctgccatctgacctccaaagggacctcgcctcctctccttcctttcctggtccctgatgagatgggggaggtttctgtcactctgacaagtgcttgaaactccagacatgggctgtcgggaactgtcgggtactgccgtgcagagcgcatgttgtctgacctcctgacttcactgggccctgtcgggtgcaggagagggagctgtggatggcacagtgggacacgtgctctactggcctgggggtggtgggaatgcagaggaggggtatcccccattgggggtgtgtcagggatgagatgcccccacaggagcctaggaggccaagtgtggaggctgggaggtgaggacacgcggggctgttccaagggagccacatgctggtagagcccaggcacaggtcaccaagggagtcaggggtcgtggggggtcagaggtcataaaaggagttggggtcaccaaggaagtcaggtcatggagggagctgacacaggagagcatcttagagggccttgggaccttccaaggggtatggatttttttccccagctttattgaggtataaatgacaaaaattatatatatttatcagagcatctaagtttttttctttttctttctttcttttttttttttgagatggagtcttactctgtggcccaggctggagttcagtggcacaatcttggctcactgcaacctctgcctcctgggtccaagtgattctcctgcctcagcttcctgagtagctgggactacaggtgcctgccaccacgcccagctaatttttgtattttgagtagagatggggtttcaccatgttgaccgggctggtcttgaactcctgacctcaagtgatccacccacctcagcctcccaaagtgttgggattacaggcgtgagccaccatgcccagcctaagcatttttctttttttctttttgagactaagtctcgctcctgtcccccaggctgaagtgcaatggcgcaatctcggctcactgccacctccgcctcccggcttcaggcgattctcctgcttcagcctcccgagtagctgggattacaggcgcctgccaccacacccggctaatttttgtatttttagtagagacggggtttcaccatattggccaggctgatctcgaactgctgacctcaggtgatccgcctgcctcagccttccaaagtgttgggattacaggtgtgagccaccgcaccaggccagcatttttctttctttgtaaattttatttttcccagctttaaaatgacataattgacaaataaaaattttatacatatatttaaaattatgtaagttcaaagtatacagtgtgatgttctgatatacgtatcttagctgagcatggtggcttacacctgtaataccagctacttgggaggctgaggcgagaggatcacttgaagccaggaggtcaaggccagcttgggcaacatagcaagacatcgactctacaaaaacttaaaaataaattcaaaaattagctgggcatggtggtgtggacctgtcatcgcagcactttgggaggctgaggcaggagttggaggctgcagtgagctgtggtcacgccactgcactccagcctgggcaacggagcgaaccccgtctctagaaaaactaaaaaatcaatttaaaaaaatgacatatgtggatgacgctaacagggagctggggaagcctgtgtaggatggcggtgtctggagagcggtggccccatgaagcgccatttggagctggagtggagggagctgacttggaagcaggaagatgggccaggaggctgctggcctcagcctagcagaaattgaccagggccgctcggcacagatggagagccgagtgcaaatgcaggtgtcagtggatcagagaaagggctccaagccagtgcttttgaaaacataattctgggaccctcatcacccaccagaggtgatgttcttatctccattttacaaatggcagtgctgatcccaggagagggtgagtgacctggtcaaggctgacgttagcacatgagagctgggattccagcctggggcttcctgcaccacgcttttgctccctcggacccctagctcttgtcatggccaccccagcccacccctcctttccatcccctttgattgcacacaatagcagagccactttgtgccagatcagatgatcttactgtctgagggtatggccttttctttctgtcaccgatgggctgaataaccctgagtttctcttctctgtctccggaaaattagccctagtcctggccaccccctggctcagggtcactgctgaggtcgtcagaagagcatcaaggcttttgcgtgtgtggaacagcacagcaggctttctgagcttcacagacttgctcacggagtcctgatgtgaacacgtgctggaggacatggtcggggggaatgagggagcggcagcccaccagagccttagagcatcctgaggacacggccccaggatccttgggaagggctgtgagatgtgctgcctgaacgtgcccggggcgcactgcagacagggtaaagccgggggaggtgcaccttgcttggggagcagacaggaaccccgggtgctgggccactgggccctggagctttcacaggcctggagttgaattaccgcttcacccaccctgagcctcactgccttgtcaaggtggatagaaacccttgcgcactgcacagggtggtgaggattaaacaaaataaaatagaaagcttcttgaatgctagccagcatgcagtaggcactcagtaagaagtcattcccttcgcctgttttgtctctgacctgtggccactcacacctgctttcacctccccctgcctgtagccagctgtctccagcagctgccctccccacgtgttcatcagagtccctgtccgcagagacagctgctggcttctgtctaagctccagcaaaccactttctgttttcaccaaaggctggcgtttccaaccattagccccatgccacaaggctctgaaggtcaagaaatctgggtccgcctagcagagcccactctccgtcctgccagagcaggctgcccccagctctgctgccatcgtgcctctgtgcctcagccgccaccccttctctcgccgtgggcacccatgaccctggagcctggagaacttggcagtagacgctaggttctgaaagggagctggtccaaagcagcttccccatgtgttgctaagggcaggggacagtctcaggagaaatcgagtccgctgcagaaaatccaaccggatttgcagtttccagaaatgttcctcagcgtcgcctgtgacgggaacaaaatgaaccgcacatctcggttcatctcggtccaagtgactcagtgcttttcccgccctccctcatcttccccacgcagtggactacagctgacttctgatcctgaacccagaaagactcctgctcccaatttaggcgtggagagccttaattggaacctttcatgctccgttctggagccacgtggtctgtgtgctccaggcctgggacagctgccacctctgtacggctggagccttgggctttctggttttgtttgttttttcttgagacagggtctcactctgtcaaccaggttggagtgcagtggcacaatcttggctcactgcaaccttcacctcagccttcaggctcaagtgatcctcctacctcagcctcccaagtagctgggatcacagacgcacacctctacacccggctaatttttgtatttttggtagagacaggctgtttcgccatgttgcccaggctggcctcaaactcctgagctatggcgtccacccacctcggcctcccaaagtgctgtactggtgtgagccactgcactccgccgagccttgggctttcggatgggctgtttgcactcgggaacctcagaagggtgctccccaagacagaacatcaccactgcaaacggagcccaccttgccaggcatttccccaactgccctgatgggaggggaaggtgtgtctttcatggcacacaggatgctccccgctgacatggacccagtgtcttaagctctgtttgcccgcaattcttttgtgtgggggaagacagggaccagacttaatttaatgtgattgtgtggcgccctggcagtgggatcagtgtggcttcctttatggagtgcagccctgccatagcaacctgcaggctgtcttctagagcctagaagagctttgttccgcagacatgacttcctttttttttttaatgggaaacggggagggcgtggggagaagggctctgatataaacagttaccaaggagacccgagtcggggttggaaaggttttctccttccctcggtccatacagagggaggaggggtgtgtgcccggtgcagggactcatgggaggcttcactctggaatcctgagtcctgcctgctggggctccagatgttgcagagttcttgggctcatgggggcagacgcaggcaggagctcagggaaattccgagaggactttggggtgtccaggagcactttgaggccacgggcccaggcaacttcctcaccagtacggaacaggggatgcacagggccgaactttccatctgctggcccctgctggtgtccaggagagagctgtgaccctcctttttccttaagtcctggagctgagagtgagaagccatggggtgcacgtactcgtctccacctgaggagcccgctctgagaaggtcagttcctgacactgtccctggcggcagactgccctcatgccccttggccaggggacgcctgcaccctcactcgagtgtgggagacttcctcctggtggggacctgctggaggcctgaagatgcggctgcctggagttaacagcaaggtcagccattcccagggttgctgcccctgtctctggcgagggactcagccaggcctaggcactggtggcccctctggtccaggacttgcacgctgcatttccctgcttccaaaggaaggaatttggactggagaccaggaaggcctcatgcaccctcttctctgcctataaataatcaggtcccccatgcaaatccaggtctgaggtcctccgatggaatggagcccattcagagcagtccagtgtgggccctctcaggctaagcccgtgaactttgcttcttggagcccccagcagggccttgggttgggaagggagtttcctggcaccctccccggcaggatgggtttaaccagcaggaacttgaaggaattgttctgtgttgcgccggtgacctagaggcacaggtccgcctccagctccttgggttcccttttcccccctggaccactcacacttcctgggtgaaccctagccttggggcagagcaggctggcacaccttgtccactctgacgttccagcccagaggctcccctgtccactcccagggccagccagcctggcattctgctttgtccaactgcgtcaggaggtcacatggaagccctcctcccccgccacttgccgggcttctgggatgggagccgagcttggaagttgccatcccttggcaccccgcttcccgtggggctgtctctccagggggccgttttctattcctgagaagacagcccagctcgtccaagaggcctttcccggtttcttcagccataagcgtctgctccctttgaagccctgtggcgtgaacctgtcctgtcccatccgtccctgtggcgtgaactgtgccatccatctatgtggtcttagcacatgccaccttgtgccatggatgtctttgaaatcacaggctgaccgccttccagggaatgcccttttttctactgggtgttaaccaagttccccagtcaggcactggggaggctgcaataaccagatgcagctctttaataatagtgtgggcacgagaggggcggggcctgtgcagtcccgtgcctgtctagtgtcagagccaggatttaaagccaggtccgccctgccacgtggctcttcccatcttgctgggatcctcctcggaggctgtcttcccctggctggaggattgggcctgtgaagtcacaggttgtctcgttctagtctcatgccctcggtgcctggcgcagtgcctcccgtgcccccacctggctggcctgtgttacccgccaggcactcacggggcactggagtttgctcttgtccttttcttcagcaaatcttcagatccactttgttggagatggaacttccctggaagcatctgtcctttgagtagagataggggttggcttttcagctgatgccaggtcagacctcagaggtggctagggagtgagaagtgccctcaacagcctcttagtccgcccctgccagcctcgtgctggacagagaactcagggctggccaccctaggaggagacacggcgtcctgtgccgtgtgctaggcgtcgcgctcatggcagggatacacagacagcccccaaggttattcaacccaggcttccagttaagccacaggaatgtgcagagtaaagtgccttggccgaccagtgtgtgtgccacagcgaagacggcgacagtagcgttgctgcgtgaggggcagggacggcctctgggagaggaaagttaagttctgtggtaaaggatgagtagaaggtgggaaggggtcacaggaagggccttgtaggcccagggagccgcgtggaaatgtgagtagcttagcgtagcccagagaggtgggaaatggggccgggccactgcgggaggggtgttcagaatcggccacttttctcttgtttaaaatatctgctctgctggggtccccttactcagggtgtagctattctaattatccttattgttggaggcttcaaaatcaatcagtcgggccccacatgtaccacttctgtttatttatatcggttggttggttgatttacagggtctccctctgtctcccgggctggaacccgggtgtttgaagctgcagtgagctatgatcgcaccgcacggtcatgtgatcgcacagtggtgagatcatcgcccactgcagcttcaaacacccaggttcaagggatcctcccacctcagcctcctgagtagctgggaccacaggcacagaccaccacaccgggctaattaaaaaaaatttttttttttagaggtagagtattgctgttttacccaggctggtctcaaactggcctcaagtgatcctcccaccttggtttcccaaagtgctggcattacaagtgtcggccactgagctaggttcttggatactctctttaagaaaatgcctcttcttggaagttgcagtgagccaagatcgtgccactgcactccagcctgggcgacaaagcgagactccatctcaaaaaaaaaaaagaaaaagaaaatgcctcttcaagtcttttgatagtttttctgatggaggatttgtctttttcctgttgatttgtagggctttcttacattctcgatcaaagtcttttgcccacatataagtacattacaaatatcctctcccacactgcagcttgcctttccttcctttaatggcgttttttattttattttattttattttattttattttattttttgagacagattctcactctgttgcccaggctggagtacagtggcgtgatctcggctcactgcaacctccgcctccctagttcaagtgattctcctgcctcagcctcccgagtaggtgagattacaggtgcgcgtcaccaggcccggctaatttttgtatttttagtagagacggggttttgccatgttggtcaggctgggctcaaactcctgactcaagtgatcctcccgcctcaacctcccaaagtgctggaattacgtgcatgagccactatgcccgaccaaaaatgtcattttaaatacaaaaatgtattttcatcttcaggtttgtcacttgattcagaatggccatatttcaaatctccaccacccagaggaaggtgtttcccaccttgctgtattcagccagcgtttttcacctccttcagcttgaaagtcctgggcaaggggcactgggcttgttcctctggccctgcaggcttggggcaagggtcagaaggaaacagaagaacggaaaatggggcggggtgaggggtggtgcgggggtagaaggccagaagtggacagtggacagaagattgtgtcaccccagcctgatcctgaggctggcgggcaccaggctgccctctggaggggatggaccaaggtgagggctgtagtcccaggaacgcagagaagggaaaaatgaaatgtggcccagtgcaggggaagcagagggggtctttgaatcccaggggagctgacccttgcgcaggaccttgagggcagagcgggggtcagccaggtgaggggactgtggcaggaaggctctgggtggaagcgatggcgtgcacaggattctgaggccaccatgcagggagggggtgtgaattaggcatcaagcttggtttgtggaggggagtggcaggtgacgctggagacagactctgaggggactcatgtgcccggatcccatgggtcgtgggagctgttgaagagcggagcagggaagtggcagatgtgagaggcaggggctggagaaggaagaggtgaagaggtggaaggtcaggctgaggtcaggccgtggggacctgggctgtgggtggggaggaagagggaagtggaaaccttggctcttccttgagggaaacaagcccatatctatctgggtgcaggagaggtcttggctttgcaaagcactggtgtcgcaagaggctttactgtaggggaaatgggaagggtgagctggtgcgggaggcctgggagccctggtgttggattagaggccagctgctggcttagcccctggggagtggcacgggacaaagctggaatgtcccctccctgtgctgccacagcatcccatgaaacctgcatctaaggacacccacgtcccgtgacacctgtgtcccatgacacctgcctcccacgctcattgcacacttttgtcttgcaggacctcctctgtcagagagagcagctttgtggaaaagatgaagaaaacggtgagtttcctgcatgtctttactcttctcaggaagcctcggccccgatgggcatgtaatcaagtctagcagacggctggcgtcaccgcatagaggatgtcccggtggccaggagagggaacgcagcccggctcgcttgggagtcattcttgcctaaccaaagccctgaagcagctctgctgttgctgggacagtttgtttccttgaatctttactttttgaacaaaccaaagtctaagaacagaccctccctctaactcacgaagcttctcccgtctggccctggcctgtccaggagcagaggtaaatctcacagagctgcggtcgtggcaccactgccattttctctccgctttgtttttgttacttttttttttttgagatggaatctcgctctgtcacccaggctggagtgcagtggcgcaatctcggttcactgcaagctccacctcccgggttcaagccattctcgtgcctcagcctcccgagtagctgggattacaggtgcgtgccaccacgcccagctaatttttgtatttttaatagagatgggatttcaccatgttggccagactggtcttgaactcctgacctcaggtgatccgcccgcctcagcctcccaaagtgctgggattacaggcgtgaaccaccgcacccagccaatttaactatttaattgtaggcatcagtactacatttacatagttaaaataaaaacatccactattcagtggaaagctcccctctgccacccactcatccccactgttcttattatttatggatccttctagagttcctgtatgaacatacaagtaaaacaaacagagactcttatttttaatttaaaaaaacctttattttattttagagacagggtctcactgtgttgcccaggctggagtgcagcggcgccatcatagctcactgcagcctcaaactcctagactcaagccatcctcctaccacagcctcccaagtagctgggactacaggtgcacaccaccacgcctggctaattttttaatttattcttcataggaacaggttctcgctatgttgcccaggctggtcttgaactcctggcctcaagcaatccttctgcctccgcctcccaaagtgctgggactgtaggtgcgagccattgcatccagcctacacttttcttaaaacacaaaacgtggcatactatgtgcactgttccagaccttgctttttttttttttttttttttttttttgagacagagtctcgctctgtcgcccaggctggagtgcaatggcacggtcttggctcactgcaaccttcacctcctcggttcaagtgattctcccgcatcagcctccggagtagttggggttagacgcctgccaccgtgcctggctaatttttgtatttttagtagagacggggtttcaccatgttgaccaggctggtctcaaactgctgacctcgtgatccatctgcctcggtctcccaaagtgctgggattacaggcgtgagccactgcgcccggctgaccttgctttaaaaaaaaaagaacacaaaacaacttgatatgtctcaaagatccttccatatcaatacaaagatactgccatcatcttagctgtaccatgattccattatatggccatctggattcactgtaacgcacttaaccctgtcctattaaagatgggcactggggctgttgctactctttggctcttaccaacaatgtcactgtgaatatgtagctcggtttgcacatttcaaatacaaagcagtcccagaagtggaattgctggattggaaggtagatgtgtttgcaatcatgatagaagctacaaatcgtccccgtaggagtcacaccgtggcacgcgctcaagaatagcgacgtgtgagaaaactgttccccacagccttgccaacagtttgttattaaagtttagatttttgtcagttttctaggcttaaaaaaaaaactcagtatagttgtaatttacatttttatgaatgagattcagtagattttcacccacctaggtctagatggcttcgtttctttttcttttttcttttcttttttttttttttttttttgagacagggtctcgctttgttgcccaggctggagtgcagtggtgtgatctcagctcactgcaatctccacctcccgggttcaagcaattctcatgcctcattctcctgagtagctgggattacaggtgcgtgctaccatgcctggctaacttttgtattttcagtagagacagggttttgccatgttggccaggctggtctcgaactcctgacctcaggtcatccactcaacttggcctcccaaagttctggaattacaggcctgaaccaccgcacccagcctcttttttctttttttaatagattctctcttcacatcttttgcctgcttttctgttgggattgatctttctccttgaaattattagggagatgaatctcttgtctgtgatataagttgaaaatatcttgcccgttaaagagtttgtcttttagtgagattccatctcttaaaaaaaagtttgtctttcaacctagctgatcgcatttttatttgttttgctgtgtaaaagttacagagtcacctatatgattctttcttttcgtgacttctggtcttagagtcataatttgaaggtcttccccatgctaaagagataaagatattcctgtattttttttttctagtacttttagggttttgtttttcatattcaaaatttaaaatctgatctattgggaatttatcctgatgtaagatgtgaggtatgaatccaactctacattttacatagctgtctaaacaccatgtattagagtccatctttcccccactggtttgaaatgccacctttatcatatacttaattcctgggctgggcgcagtggctcatgcctgtaatcccaacactttgggaggccgagatgggcaggtcgcttgagcccaggagtttgagaccagcctgggcaacatggcgaaaccccatctccacaaaaaatagaaaaattagtgggacacagtggtgcgcacctatagtccccgctacctgagaggctgaagtgggaggatagcttgagcttgggaggcacagattgcagtgaccactggactcaaacctgggcaacagctacaccctgtgtcaaataataataataatagctgggtctctgggttcttttcactgggcgcaacgtgttcaaggttcacccacactgtagcatatgttagtacttcctttttattgccaaataatgttttaatatatggattcttacttatttttccgtgacttttaggatcaatttgttgaggaaaaaaaagctgttcagatttttttttttttttttttttttggtagagactgggtctcactctgttgcccaggctgttctcaaactcctgggcttaagcagtcctcctggtgtggcctcccagggtactgggattacaggtgtgagccactgcacccagctggttcagatttctattacatcatgccacatttctctagtgacataaatagagctgccatttttgtgggtcgagactccctgtccataatcggggtgcttttccattggcgtgagtcctttgtgtgtagttcagtagcttctgacacatctcttacaaagtttatttctaggtattttatatattttgatgctcctgtaaatatttagctgctatcttaggtcatcttttgttctcttaacctgataatcatgagcactttctcttctattaagtatttttacggtgattattttaaaatatccttttgggcgaaaaccctgtctctactaaaaatacaaaaattagccgggcgtggtggcatgcacctgtagtcccaggtactcgggaggctgatgcaggagaatcacttgaacccgggaggcggaggttgcattgagccaagatcgcaccactgcactccagcctggccaacagagcaagattccatctaaaaaaaaaaaatccttttggccgggtgcagtggctcatgtctgtaatcccagcactttgggaggctgagacgggcggatcacctgaggtcaggagctttgagaccagctggaccaacatggtgaaaccctgtctctactaaaaacacaaaaaattagccaggcatggtgacggacacctgtaatcccagctattcaggaggctgaggcaggaaaatcgcttgaacccaggaggcagaggtttcagtgagccgagatcgcaccactgcactccagcctaggcgacaagagcaaaactctgtctcaagaaaaaaaaaaaacaatttttaatgatttaacaatgatttgtagaaaattcaggaactttaaaaagtataagaacatttattgtaatccctaagttttttttggtggtggttttgttttgagactcagtctcactcctgtcacccaggctggagtgcagtggctcaatcacagctcacttcagcctcaacctcccaggctcaagtgatcctcccacctcagcctcccaagtagctagaaccataggcatgcgccaccacacccagataaattttttgtatttttagtagagacagggttttgccatgttgcccaggctggtctcaaactcctgggctcaagtcatcctcttacctcggcctcccaaagtactaggattacagaagtgagccacggcacccggccgcgtaagttttattttgtatgaggtgggattcagtgtgaaaactagagactactttaggcattttaatctggaagggatttcacacagggaagggggtacttccaggttactggaggggctgaaggagcaggttggtctctaagatatcacagaagcaacctgcaaggtagctgctctgttcgaatgcagcctgaaactgttgagttcaggacacaccacgtgtagctgtgatccaggataagaagctacttctacagctgcctctgaacatcacataagccagtagccaggactaggaacttgcagtctggctaccaaaactattagaaatacctcaggtggctgggcgcggtggctcacgcccgtaatcccagcactttgggaggccaaggtgggcagatcacctgaggtcaggagttcgagaccagcctggccaacgtgttgaaacccagtctctactaaaaattcaaaaaaattagcctagcatagtggtgggtgcctgtaatcccagctactcaggaggctgaggcacgagaattgcttgaacccaggaggcagaggttgcagtgaactgagatcgtgccattacactccaatctgggcgtcagagcgagactccgtctcacacacaaaaataaaaaaaagaaaagaaaaaaagaaaaatgccttaggcactgaagaccaggcactgcagagaacctcacatgtgcatgaggggccaggaagccttggcctcccttccacccttcagatcttgcaaagcacgttcaattggctgaaccgaattggctgcaactccagccccaacgggctctggggaataggatttcaggcttttcaacagctgctggaggaggagggtggactgacgagtatgtgagccagcccctaggacctttccctgttgtaaaattttataatgaatatgtatttaaccagcaaaacacatccagaatgccccatttagggaccctcggtatatttcttgccagtctgttttctttgtgcctgtgggtatagaaagaaaatacatatgtatgttttgatatacatatctattatttatataacacaattggattgtatagccagccctgcatatccgtgagttcggagttcaagaattcaactgcagactgaaaatatttggagaaaaaatggattgttgtgtctgtcctgaacacatactgtcatcttactgttccctaaacaatacagcatagcaactatttacagagaatttacattacattaagtattacattaataagtaatctagagatgatttaaagtatgttggaggatgtgtgtaggctacacacaaataccacatcattttatagcagggacttgagcatccttggatttttgttttttgggtttttttgtgatggagttttgctcttgtagcccagggtggagtgcaatggcgcgatctcggctcaccacaacctctgcctcccaggtccaagcgattctcctgcctcagcctcccaagtagctgggattacaggcatgtgccaccatgcccggctaattttgtatttttagtagagacagggttttctccatattggtcaggctggtcttgaactctcgacctcaagtcatccacccgccttggcctcccaaagtgctgggattataggcgtgagccactggaggtggagtcttgctctgtcacccaggctggagtgcagtggcgtgttctcagttcactgcaacctccacctcctgggttcaagctgttttcctgcctcagcctccctagtaactgggattacaggtgcacgccaccatgcccggctaatttttgtagttttagtagagatggagtttcaccatgttggtcaggctggtcttgaactcctgacctcaggtaatctgccagcctcagcctcccaaagtgctgggatcacaggtgtgagccaccacgcccggctgcatccttggatgtaagtatctatgggaggtcctggaaccattcccccacggataggggctatacatttggttactttttttaactttgttttttccccgtgtcatgaaaatgtcagaagtgtgatcttgagcagccgcgtgtgtgagattgccttggtgacctttgccctcctttgccacagtggctgtgacagtgagaagcaagtcccagaggaacttagaagggactcaaagccaggaaggaaagggggcggcctgtagggcccccgcctgccaggcctgcccagtgggtgttcaccggagccgtggctgaggtctgtggccctcaccaaccctgtgtctgccttccttaggggaggaacatcatcgtgttctacggctcccagacggggactgcagaggagtttgccaaccgcctgtccaaggacgcccaccgctacgggatgcgaggcatgtcagcggaccctgaggagtatgacctggtaagctgccaccgcgtgctggccccagatggaggcagtgggtaggacagggagcaggtctgtagggcgcccctcagcagggggaggctggcagggagtggggtcctgggaagacgtcctcggaagttgccttcccgtgagggtcattgccatccctgcccgggctgactgacggaagggccattcctgcagttgcagccacgtgccaggcatcgtttccccaggactggccctcccctgagtgccggctgccctcctggcggccgccacatctcccaaaccaaacccaccctccccagctgctccactcccctctccttcgaggtcttggtgacgggcaccaccccacagccctctccaggctgcatttgcagttgatgaacagtttagttagatatcagtgtgcaccggggctgtgcggtgcctgggagctttggaatgaggttcccagggtggccccagacctgcatcagctcaggaggctgcattctgatggctcttttgtgccaagcttcactttcctctagaaacacatcctctccgctccagcctaacacgggtgaccttgtcctgcccacctggcacaaatgcccatgccccagcccctccgtgttgttacttctctctgatcccacgacactcagacatccctggcctggtgccaccctgggcaggacctggccttccccatctggtgcgggttgaaccttgaacaggctcagtcatggccggggcgcggtcctgtccctgtttctgcaggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgagtcacccagagactgctatgggctcccggtggcctgcggtgcctccctggggactccagatccatgtatctgaaaggcagccctccagacccccaccctgtcctcagcagccagggcaggccacttgtgagaccctctcctctgccccagaccccagcactacgagaatgtcccctccctgtccccagccccagtcggctccagggggcattgggtgctggagactaaaggcaagaaaggtctggctggacgactgagacctgcctggcctcggagagctggagccccagcccggtggggagggtgggctggccccgcttccctgtgggttgaggctggcagtggacggggcaggctgtgggctgcaggtcaaccagatgaagcctcttcagtggcccagtgttccttgcagtgcgaggcgcctggtggaacggaggcctgcaggtgttgccagcagctcagccagtgctgtggggcctcccgccctgcccccatggcccctcccactggtcaggtcgagggccaggcctcagagcggcccctgtgtccacgcaggtgtttggtcttgggaacaagacctacgagcacttcaatgccatgggcaagtacgtggacaagcggctggagcagctcggcgcccagcgcatctttgagctggggttgggcgacgacgatgggaagtgagtgcccaccctgccaccatgatcagcgcggcgggcttaggcaggggccgtggaacgtgaggggcgcgcacaccattgtgtcagctgagactcagcgacacgcacctccaacacagagggaaggggctctcctgcctctgccctgcccctgccagttttgcttttcggcttgcccaactccctggagccttcctgatgctctgggtttatgtcgctgggtgccccagggtgcacagtcctgagctttggggatggggtggggtcggggcgtgcctggcaccaggtaccgttgccacatgggcctcccctgagccgctccccctctcctctcctcggcccagcttggaggaggacttcatcacctggcgagagcagttctggccggccgtgtgtgaacactttggggtggaagccactggcgaggagtccaggtgagcaagtgcccgcaggtgcggtgggtggcctgggcgggtcctgtgccgagggcagccaccctggaacaagggctggcagtgggtcgcagcaaggttagaagacactccgtcatagggtcgaggagggaccttggtcccagccaaggactcactctgccacgttgctctgcactgccctggggcagcggggtgcatcccacctctcgacaaggacacatcgcatcgggctctgtggctaggttcaactttggcaaaagggctcatttccttaaaatctgcctccacagacttggccaaaaacataacgttcctctctgtgcccttgatggcccctgggtgctgcccgggcttccttaccttctcccagatggaagcctgcccagccctgccccggcttctgggcgtctggcccccggcagctccacgctgcctccctccttgctccctcgcctgccctccttgtgcatctgcagcaggggctcccctgcttcttgtcgtatgtacctgggacctcaccccaaaggccatgcacggtctcccctgtagtccaacccctccctctcgggactgacccctgccgcttcccggcctcacccttggtctcccctttccagcattcgccagtacgagcttgtggtccacaccgacatagatgcggccaaggtgtacatgggggagatgggccggctgaagagctacgagaaccagaagccgtgagtggagggagcgtggcttggggcagacggctctatggccactggtgcaccccaggctcagtctgccgtgtatccccatatccccacagggcccttctcaccagaccccgtgccccgagtgggtgtgagtgtccacgacctgtccacggcccggccccaggagactggcactcgcccagtttgtactgagctcacttagccaccttactctgcactgcccagggcagcggggcacatcccacttctcgactaggacagtgcattggcctctgtggctaggatcctctttggcagaagggctcattttcttagaatctatctccatagatagacttgggggagaaacctggcgttcctctctgtgcccttgatggcccctggttgctgcccagattcctgcccgagccacccagggaagtcctcgtgccactgcatccaagaccagctgccctgctttctgtaggcctgccccagcctggctggagcgagaagccctgcatgtcggtggctttccggagtgcaagtttctctcttgtccacggtgtagtccaggacgtgtgggggtgggggagctgtgctcctcatttggggaccagccaccttccagcctgtggcaccgtcagcttgggcctcacagttcttttaggggccagcctcagtttccacatctgtaaacagacactgatgacccagctctgcccatgtggtgggactatagagagaactgcattagggctgggcgaggtggctcacagctctaatcccagcactctgggaggccgaggtgggtgaatcacctgaggtcaggagttcaagaccagcctggccaacatggtgaaaccccgtctctagtaaaaatataaaagttaaccaggcatggtggcgaatgcctgtaattccagctgctcaggaggctgaggcaggagaattgcttgaacctgggaggcagaggttgcagtgagccgagatcgcgccgctgcactccagcctgggtggcagagcgaaactctgtctcaaaaaaaaaaagagaactgcattggaccaggctgggagagcccttgatgtaaccggtgagatttcctcatggagatctctgagattccctgtgctttgtgcaaccagaagggtccttggagacagagactcagatcaaagccccggccgctcactgtgcttctctcctccccacccagcccctttgatgccaagaatccgttcctggctgcagtcaccaccaaccggaagctgaaccagggaaccgagcgccacctcatgcacctggaattggacatctcggactccaaaatcaggtaccagctgccactgtcaccccctgaaccctcactctgggcctcctgacctggggcagggccagccttccgcccctcccgagcctcacatctccctccaggtatgaatctggggaccacgtggctgtgtacccagccaacgactctgctctcgtcaaccagctgggcaaaatcctgggtgccgacctggacgtcgtcatgtccctgaacaacctggatggtgagtgccacagtcagggcgccctgccgggctcaggcagccgcgggattgggcctgtaggaaggccctgggttgagcttctgcttaggcctgaagccccggtgcctgggaggcccttgcaccgagactccacggttacaggatcccaagcaaacgggaggcggggtggccctaggggtctagccctctctgtcggggttccccctaccccgtcactgtcatagtcctttaagggagtgaggtgctgaggcctggtggcagaggcagccctggctcccccatggccactgtgtcctgctgggaaggagggcctggctccacgacccacctctgccggcctggggctgcccccacctcctcactgaagtcaggagtcagcagccctcccaggcccccaagggtgcacagtggtgccgagtggcagtagccattacgcggggctgcctgggcctggtggggctgcccagcctgagcctcccgctgtgaagccctcggaccccactggtcaccaacctgggccgagcccacctcgccccacccctgcttgccggtcctcagctgccatgccagggctgcccttactgtcggcttccacagcccgcctgtagggaagcctgggcggggctgtgtcagaccgtgtagtgtgcggtgaaagcacagcgggtgcgttagtgtgcaggggctcccccgcacctcccctagcagggtcctgcctctgatgaggacttcctgtctggttggaggccccagacttggccccagggccagggaggcatcagagagcataggccttgtttccagcaccagctggggcacctgttgctgcagagctggcccaaggtgtcaccccctcccgccgcagccacccatccccaggaggcggccgcctaccccaagtcctgcctgtgtcttccctgcagaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggtgcgccccctcagcccccgcaacctccgccccgtcaccccgccgttttccgagctccgtgggccccaatcagccccatctcacccccgtgtctcttaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtgagggccggcactgccctgccagccacacgctggaggcccagccctgctcacagcaggcagagtgcaaggcggcacaggagctccgagatctgagccctgagctccagttccagccccagcgcagctccaaatgcctccccaggctgtggactcagtcgggctggcttgtgagattctcagcatctgtccagccccagtccccagaaccagtccgggaagccgctggggagggggcctctgaggtttgggtgccaggtgggctggaagaggccctgggtgagtggggctggcctgcagaacgggacttggggccggggctgggcaagggcctcggcttggcggtggagctcacacggccctccccacaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggtgagtggggtcccatgggggagagggggtgacgactgggagccccgcgctcaccccggcccctgccacgcaggcaaggaggtgggggagacgctgctgtactacggctgccgccgctcagatgaggactacctgtaccgggaggagctggcgcagttccacagggacggtgcgctcacccagctcaacgtggccttctcccgggagcagtcccacaaggtgagacgggcgggcacccacgaaggtgggcatgaggctggcagggccacagccacagtgcccccctcacagcaccacccttggccccaggtctacgtccagcacctgctaaagcaagaccgagagcacctgtggaagttgatcgaaggcggtgcccacatctacgtctgtgggtgagtgagtggggtcactggaatagggggcagggaggacaaggccctgcctgccacagttggcccagcccccagcaccccctcttcctgcccagggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgtatttgcctggtattgtgtgagtagatctgggacctccacctgcatcaacttaactaactcagaccccaggaacccatgtggtggggccacccagccctcccctcccccaggagaacacacacgctcaggccacctctgggcctctctttattgagggcactgggcccaggtcttccttcagggcccacagcgcccataaaacccaagggagaatagaagagaccccctgatacacgcacactcgaggggcgcctcccatcccctcccacaacacacaggacagaagcccctctgggccggcaggggaaggcccagcctcaatccttcttgctcccgtgccgctgactgtgaaacttgtggtgcacaaccctcagggtggtgaagaaattgccgaggaaaaggaggaggaagggaaagccgcacataagcacctgccggaggaatagggtgagggctggacatgggcctggccccccatccatcctgtccagggaccccggctcacctgccactccttgcactgagggtcctgggccaggttgaacaacgtcagcgcgttaaaaagctgccagaactaagcagggaggaggcattttactcagaagtaccagtccctgctggagcccgaaaccggcgcagaggacggacagacaggcagggacacagaggcacgacttacgtgtccaaagaaaagaaaaggcagcaggaaggtgaggccccgccacatccaggactggaagccctctgcggggaggaaggtcagggcacaggacggccagggacagaggggacgctaccactcagacccgggatgggaggaaaggggaatgtccagatgccagggccactcccgactcacccacagtgaggtccatggtgtgccgctcgcccagcgcccgcaggcggtagaggcagccgctctggtagtagtactggagaaactgcacgaagcctgggccgggcggaggacagaggagcagggctgagccccgggaggggttccctgcccctgccccccaccacgggtgcctccagggctcagcacagacatctgggacactcactctggtacatggaaaaggagaggaattggttccggaatttctggtacatgagaccgtcgggcctaaggtaaaaagtggagggcagtgtggggacccttggggatgccgtgtatcccctccttgtcccagctcctgcccctgccggggcccagccactcaccacgtcagcatgactcccgacaggaaggtggacacgtagtgatggaacacccaccagcctttgatcctggagcagagagccaccatcacccccagcgcctgttcctgcttcccggagggtcctggcaccccattccatgctcccctccctcagggcccgccctgcccaccgggagccgttgttgatgaggatgctctcccggatggtcagggtgcagtagtaccagaccagcaggaagttgaaggcagcatctgtcaccctgcggagggaggggaccgagggttggtactgcagcgactggggatggggtgggtcctcggccggggtgggacgcccacctggagttgagcaggaagcggcaagtgaaggagatgaggatgaggatgatggtgaggtagagcttgaacttctcatactcgtccttgtaggcaaacctggggggcgcaggccggtgagacgggtggggtgctggtggggcccatgtgtgcccccaccccgggagggcagctgagccaagggtagtcggatggaggagaaggccgggttggggggtggaggggaaggccaggtggggtggggggtggaggggaaaaccaggttggggggaaagccgggtggaggggtggaggggaaggccgggtggggggctggaggggaaggccaggtggggggctggaggggaagaaggccgggtggggggctggaggggaaggccgggtgggggggtggaggggaaggcggggagggggtgtggaggggaaggcggggagggggtgtggaggggaaggccgggtgggtgtgtggaggggaaggccgggtgggtgtgtggaggggaaggccgggtgggtgtgtggaggggaaggccgggtgggggggtggaggggaaggccgggtggggtggggggtggaggggaaggccgggtggggtggggggtggaggggaaggccgggttggggggtggaggggaaggccgggttccgggggaaggctgggtggaggggtggaggttgagggggggaggggggtagggggctaggggtggaggggtggaggttggggggtggaggctcggcctgattacttagcctgcttgctcaggagcgtgacgttgacgttccccagaaccaggctcaggtacaatctagggaagggggtggcggggtgaggagaagcccgagtgacagacaagccaccggtactcagccaagcctgccaggccagagcctgggccaccaccccaccccctcacccgctgctttccgcagggccttggcatcgggttctgaccttggaggctgcagacccactccctgccatgcccagccttcctggccgcctgctccggaatcctgacccccggaggaaacagtgttcccccccatctccagagtcttgcctgaaactcccccacctcagggcacaagagaacccggctctccctccctgctgagggccgtccccctgtccccgattgctcccctgtgcgatggccaccacctaccccccagctccctgccacctcccctccagaacctgcagtactaggttccacttcagagacccacacgcctggccacatctaggacgacctcccaaaccagaacagaaactcagagctctgactgtgggctgaccccaagtactcagcctcccggggcgtttcttcccaccacgaccccccttgtccctcaccgaggcccccacgctctccagtcccagatctcatcagagctggctgagtccccaggccacccgccaattacaccacttttttgccaatccccttcatgtccagcctccacacccaccaactgagatcatcttgcccttctctgccagagatactccaagaggtgacagcaaagtcacggtcactttctcagcacctgccccagacacatgggctcttgttcacactcaagccaaacagacagaggctcagcatggttaggcaatttgccccaaggccacaaagaacttctgggacagccatgcttctccctctacagaatgctcccggcacagtgctccccaagcaggccagcttcagcctccactgccaacccaccaggctgcggatgtgtccccactcagctcgccatctggttcccagcactcgcctctccacatcctctccccgaaaccctctaccctgtctcctcccacctcgggccccacctgcaacactgcagagaagacagcctgactcctgctctatggggagcactatgccaggagcactgtgccaggagcactcctcactctcatctctgcaccctccatcccccactagcccttctcgctctccccaggcttccctccatcacctcctgcccttctcctgggtctttcccctctcggcccctcttctcagcaggtggatgtgctcgagtcttcccagaggcaaagtaaccccacaaacaggcagtagctgcccctcaacccagtgctaatttccagttcctagttgctaattctctccctccactcacagccaagctctaaaaagtctcccagagggctgggtgcggtggctcacacctgtaatcccagcactttgggaggccgaggcgggtggatcatgaggtcagaagatcgagaccagcctgaccaacatggtgaaaccccatctctactaaaaatacaaaatacaaaaatacaaaaattagccgggtgtggtggcgggcacctgtaatcccagctactccggaggctgaggcaggagaatcgcttgaaccacggagacagaggttgcagtgagccgagatcaagtgactgcactccagcctagcgacagagtgagactctgtctcaaaaaaaaaaaaaaaaaaaaaaagtctcctagacttggctgtctcccttccttggctcttctgtcatccccaagatcgacatccatccccttccaccaaatggttctgccaagatgacccaacttccaggaagcgcatccccttccttatcacaggactgaccccaggctacggacactcctttcttctccctgccttctgggccacgccctctcccagctatctccctgcctgcagcctctgctgggattttttgctcagcagggggttttgcactgccccatccgtcctcctgggtgacagctgctggcctttccaggtgcacattccaccgcccccgcccgcctactgggctcaaggcaagagctgcagcccagcaaagcctctgatctcttggctgcctctcacctcccgccccgacctctagccactacaagttctcatggcccgtccacctgctgctacctctcgccctcagcccatgtgtctgcctcattttttttatttatttacttatttattttttaagacagagtctcactctgttgcccaggctacagtccggtggtgcgatctcagctcactgcagcctccgcctcccgggttcaagtgattctcctgtctcagcctcccaagtagctgggattacaggtgcatgccacaatgcccggctaatttttgtatttttagtagagatgggttttaccatgttgcccaggcgggtcttgaactcccgacctcaagcgatctgccttggcttcccaaaaaagtgctgggattacaggcatgagccaccgcgcccagcctatttgttctttttaaataaatagagacatagggtctcagtatgtcacccaggctggtcttgaactcctgagttcaagtgatcctcccacctccatctcccagagtgctgagattacaggtgaaagccaccacgcccggcccactctttattctgtaagactcagcccacccatcccctaatccaggaagccttctgcgacctcctggactgggtcaggtgtccctcactgtgccacctcattccccatgctacaaagcacctatcacagtgaaatgtcactctcagccaggtgtctcccctgaagtcagcactgtgcctcattgctcagcctgtactgggcccagggaacatttgctgactataatgaccaagaggaggcagcacccggcttcaggagtggctgtgaactgagctgggggtggcggtgggggccctcacccattcttcttaggcaaataggcctccatgtcaaagaagaggccttggcgctctttcatctggttctccagctcctgtgcggccccctcggcctctgctgggagggagggtttgcatctgcgggtaaggccagaaacagtcagggcaagaggactcccaagtgtcctccctgactcccacaggggcagaagggcaaacacggcccagagaggggaggggcggtgcccagggtctcacagcgccagccctcccaccccacactctgcccatggcgggtggggtaggggatcctaacttcttcagggcgagggccagctcctggagccgcttcttctgccgcgtgatggagctggtgcaattgttctgaagtttggtcagctcctccagcttcaggcggtagagccgatgggtctcctgggggccggaggggagaggctcaggccagttggggagctactgagccagagcctgcaggcaggacgtggcgctcaggctcccccagggctgctgggagggtctcgctcagcgggaaaggaggtagaactgtgcctgcccagggatgaggtggctgtctccccaaggcaggcaaggacctgggtgtcctcctgtgagcccagagacccccacagcacccctcctccaaaaacagactaggtgtttttgtttttgtttttgttttgagacagtctcgttctgttgcccaggctgaagtgcaatggcaggatctcagctcactccaacctccgcctcccgggttcaaaccattcttctgcctcagcctcccaagtagctaggattacaggcacctgccatcatgcccggctaatttttgtatttttgtagagacagggtttcaccatgttggccaggctggtcttgaactcctgacctcaggtgatccgcctgcctcggcctcccaaagtgctgggattacaggcataagccaccgcacccagccaaggttttcttagtctcagcccatctgctagttgtccccaccctacaaggacagactctttctcctaccttgagtctggagcttaggcccccagggccacctcctggaccaagcaggcagcccagagccacccctctatcctctcagctcctcctgcctatctagccttccagtacaggaggagctcaggttctcaggaatccctgacatcttcttcccaggttaaaggtcatcaggtttcaaccctagagcctcctgctctaaggccagccccactcccttcccctagcacctttggcccaaggattccccaagcactttgccctggtaggtgagtctcaagaaggcgcagcctagagatggggcaaggggcagtgtgaggagagccaagcaggggctgtggccaggacagcggcggccaggcggggagactgggtctgctcagtctctggggagaagcaccaatggcaggggccttggcagggccaggggcagctgggtttcaatgcccacaggaagcagttggaaccagtccaggagaggccaagggctaaccaagccatcagctggccagggctctactctgtctggatcttgtttctcatgcccaggaggggtcaccacgccccctcggaccccagcacgtgccacttctgcccacccacagccaccgccctcttccctgcctggatgaggccaacagcctcctcctccctggcctctggacagaacagccacggtggccctggggagctcagtccagacaattcctcccgtagctttccactggcctcggagggactctgatctctgccaggccagagcgtccctgcagggcctagccccgcccacccctcccacccgtcccacccctcccctggttctccttgatgcagccacatgggcctgtcaagtcccctctttccttccaaaggcctcggcggcgcgcggtatccctctgcctggggcgtcccccatccaggccgaggacacccccctaaacgctgctcccccgacctgggctgcctctcgggcgctgcccgctgcgcgtttgctgagtggctgacccaaggctgggcccgcccgtgtgtgactcaggcggccgctctcttctgggaagggacggggtcggggtctgggcccctttccaaggccctcattggaagccgaggtcgcccagcgcgatggggtcccgccggggttcccggacactggaggtggtggcagtggacaccaggaccaggggcctcgccccccttggcagtgacgccagggccccgacccctgacccttagctccccactgcctgacccagggctgcccgacccttgaccctgagccagcgagacgcggctcgggggcgacccggcgtccgcagcggcgctaacctggatgttctggaagtcctgctgtagatcctcccagtcccgcaggcagtcgcccagcgggcccgggggcgggggctgcatggctgcagcgccagtagccagtagtggaggacggcgcagcaaccccggcccacccgaggctcctccgccaccgcccccgtccgcttccgggctcgcgccgccacgggcaccaatggggaaaggccacgccccccgccccagccaatccgggacaggggcggggtatgggcggggccgtatgcaagggcggttgctagccccgggactcgcggcctggaccgggactgggacggctgcagcccccgggcctggactgcactgactgtgccagccgcgtggtgcagccagcagggctctggcccgtcatgctgagagcaaaccaaggtccagggaggtgacacctgcttgcaacattttcgtccttgggaagctgagcctctttggggaagggagttagagctgcttctctcgcttggatttttacagcggcctcctttctccctgcctcacctccactgtcccttctcgcggccaccggactgcccttcccaaaacacaaggctgattccccatcatgttcatgcttaaaactttccagcggctgtgtcctgcctaccaggaggtccctaatcggagctctgcagccatcccgggctctgtcccaactcacaccctgaggaaagccagggctgtgtgtaaagccgttccccctctggcaaaaccccactcctccttgaaggcctgcccttctgttgaggggaatcccccaccccctcccacccccatccctccacagagcgcgctaagtggtgggacggcattcatctctctgttcccagccccacccacgcggtggcagggaatggttgccgaatggacttggggaaggtcctgcatggatggacatcctaatcccctaccagtcccctagtctgtgccgtctcctgatgcccagtttgttctgtgggtgctgccagctttggagaagtgcatttggaaaacaacttccaactgggtgccgtggcccacacctgtaatcccagcattttggggaggccgaggctggaggatcacttgagcccagaagttcgagaccagcctaggcaacagagcaagaccctgtttctacaaaaataaaaataaattagccaggtgtgatggtgcatgcctgcattcccagctactcactcaggaggttgaggtgggaggatcgcttgagcccagggaagttgaggctgcagtgagccatgattgcgccactgcactccagcctgagagacacagcaagaccgtgcctccaaaaaaaaggaaagggggtaaaaaaaaggaaaacttttaagaccttaggaatttctagaaacgtggatagggagatgggggagggggtgagaatctctccttggtgaacacagccaggcagaaatgagtggggagcagggaaagaaaatctgtttcaaggggtggatggcaggaagcgctggggatgaggcaagggtgtgatcccattctaggagcctgggggctagacaaggctgggcttggtatctctgggactaggggactgcctattggtggctattgtgacatcctctgtgaaccaacacaggcaacctctgggtacccccaggcagcctccaaagggtctaagtcaccagggggatgcagggcagctgctctagcagccagatgctcttccagaggcagcctcaggggtgcagttgggatggcccgcgacacctcagggatgcgggttcttggtgaacctgagcagggcgcatcagctaggtggcgtgaacaggcacttgggaagaatcagtacaggaggctaacatgagactttcaggcagcaaaggccttctccttccagacaagcctgggtatacacactctggccctccacccacaaaatgcccccaggtgaggctcttcagtacccttcggtgggcctcggagaagatcagtagagcggatccatgatgtttgtgatggaatctccaaggatagtcttctcccattccagcagctggctcaccaatccccgatttggacacatgttgtttttgcacttcttgacataggcccaggacctctatgaatacaaagagagaaagtgaacttcacgattggtcctgggccctttccacttggatcagaggcagctttcagagacaggaggcacttgcacagtgccagcaacacggcttaagggctggatgcagaaacagggcagcctggcatgaatgcatcagtgctgggagtcatgggagctgactctgccttgggcaagcccctctgcttctaaatctggtgacagaaataattcctatttcaaacagcttctgggaagattaa

SEQ ID NO: 845 - DNA, 2209 bp, Homo sapiens
atggccacgcccccacccccgcggccggcgaaggcggtggtagcgcctcagtggtgtgggcctgagccctgcccaggtgcccgcagagagcagccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcagatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgcccctccacgtgatttccagtgagtgtaaataattttaaataacctctggcccttggaataaagttctgttttctgtatt

SEQ ID NO: 846 - protein, 713 aa, Homo sapiens [sequence omitted]

SEQ ID NO: 847 - DNA, 23064 bp, Mus musculus
  misc_feature (1)...(23064): n = A,T,C or G
ttcttttgtttttgttctgtattgactccaggctgcatgccagcccagcactccaccaagtgagctagaattttgattaaaatacaactttccgtggtttagcatctcaatactcagtgttgcttcatgtggcctggttaactatgccagtgttccactagtgccggctgctttaacaggagcaatgtcccattttccagccaaatctatcactgtttgaaaatcaaaatatatgtatgtatttgtatcacctgttgttgttgtgtgtgcaagcacatgtgtaagtcaaaggacaatcttgggtgttatccacctgttgttacttttatggctttttttcccctctgagacaaggtctctcattggcatggaacttgctgactaggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggtcctgagcttaagatcctcctgcatcagccttctgagtgctagggttacaagccggtgccaggaccccccaccttgaacattcctttttaaaagacagtctctaggcaacagatgagttcctatgtgcccttttcacttcaccatgcctgatggtctcccagcaccttctcccttctcgtgggcgtctcttccattgctaaagttcatgttgttgatttgtgttaggtgttttgtgttgccttttcctgtgcccaaggttgagctgcctgggttcctcctcttggcgcctgttcttccatgctcttcacagaatgaatggcaacagagacagcaacctccctgaagcctgcttccagagcccatttggcctgggcatccaatgtagtttcccagattacgtatggtagtgcagagaattgaaccaccaaggtatctaggaagcatctaagttggtcatcagggtttccccagaggacagttcagaaccagggtgatacaatcccagcaaccacctcccccagcaaatggaaaagaggccagaggggaagaagacaagaggaggcttctatggacctcaggtagccaccacagccagaggcttcagggccagtagagggctacattcaaggtcaagagagagcaaagagctgcagagctgtagccccatgaatggccatggcccagattggctatgtggcctgagcaggtggccctgggccagctctggcacagcacactctgtccctctttgcctagtccaaagaatagctcaatctgctcccaggcagggggtgagagtgggtgcagagcctatgctcaacaaaccaagacaagtgggggtggattctggagtggccagttaagctgtgcacacggtggaccctatcaggtatctgctgtcatcttgcccagcttggagctaagagctctgtgtgtgtttgtatgaacagtgaacagtatggaacatgtaggaggagtggacaggaaggaccggagagatgtttgtggaatggagccctgtgcaggagtgtgaggaagccaaccggtacagattttctcctattggatgtagaggcaggagctgtctgctttgggcagggctagtgtaacctcagtgacaggttgaatctaacacctcactacctcctccaccagccaggccactgctatccaggactccactgcctggaatcagccttctctacacacatggagcccctggggataggtctcaccttgctggtaatgatgcagacccaggcccaaggcccaagaaggcatgaagggcttcctcaagccctgctgcccaacataccttttcacaagatctgtcttctgcccagccttgggaaggagatagtaactatgaaccctggccaggcaggcccagttcccatgggtagaaacaagaaacggggagctcagcccaatggcatcccggcgcagacttcacattccccggtggccctcaagaccgtccaggtggggacaacattctctgtctatgtggtgaatctgaggctttgaaagtcattaggtctctgccagatgcaagagatgtggcttggggccacatctggggtgggagagggccgggcctgtctgtcactagtcctacagttccaaggagagtagtccatctttggcttgatgggccacacctttagggtaggatatggggtcccgttctaaatgtggacgacagcccatttgccactgcatctgctccactcaggtgagaccaagttctcatggccgctgccacataagagaacggtgggtagctggtagtggaaaatccagcatcgacaggcaagtgagagacccccccacacacacacacacacaacagtaggaactgtctgccttgaatgagctcatggacaacttccaaatacatgcacctgcttgtcctggaacctgcggtttggaggagaaatcagcagggcagcaagcagggtcaggcacagtgaaaggttgaatccaggaagatgctcaagcctaagacaggcacaaaagtcaggaccaggtaacacagtgagtgacttcagctcagggaccagtgggagctctgggaaatccaggctgccatgaggcatgacctgtcttggaagcatgagaagcagggcccttctagaagaccccaaattctcctcctcctattgcatcccatattcccctcaaagaccaattcaaccaaaggctccctcctctcggctttcttctattctccccaggaccctggcatatgaacactgggtcagctgagccaggacctcctcagagactgggaaggtgagttcttcctgtctgaaaccccaaggaaggccagaagcagccctgagtcagagagcattctggttccacactcagagtggctgtgaccatcagtccccttcccagcctgctcctccaagaattagtgtcagaaagttacaaggtggacttggcacagaactacaagagtgttcctctggtcctccacgtaaggactaaggaccagggaggataccaggccgtgctgctgggtaagatgctgggtgaaagatgggtcagcagggatagaggggggtcatcctgggtgaggcatcagtcccttagtggaaagagggatccttcccaagaccccccccaaggaaggaattgaatcagagggttctccctaaggctcatctctcatcctgacacagcagggaaggacctggactcttatcagagaagaggcttattaagcttgctgagacactgggtatcctccaggactgggtcaccttcttgttcaaaactggtccaggggcccaggagttgtgggagggggtgctgggttgcacagatgtctgtgaggtggccttgatccctgaggatgactgtgcatcagagctggggactctgacaaactaagagaatcacacactcggccctgatccttgaaggctagagggcagaagattaggagaaggtcctccagttacacatagggcaggtactgggactcaagaggaatgtctgaggcagagcctggggggaaaagcctacagccaagcagtaggtcctgggcacaggaggaaggcccacaagtgagtgagatacaatacttctatctcagtatgaaggcaggatacactcagggctcgatgattcaggtctcagcaggtacaaaccctagcaggaggcaccagatagagagtcttgtgcaaagtgagagtggggtctactgtacagatccacctccaggcctgacactgacaacttgggctacacactgtgaaggaattggaaatgagacatgaagttaggttcataaggggcattatggttggtaaggttggagccaaagttttggcttcatagttataccagaatcaagtatgcatgaaaattgggggcaggggaggaaggcaggtcatgccagaaatgtgcctcctgtcaagtctctgggtaccctggtctgggtcatccttcctgttccacttgaaggtgctaaaccaggcctgggttgagtagggaaggggctttggaggcgagatcatgcaagtgtgtctttagaatgctgggctccctaacattgcccccctagaggaggatgatccagtcataagttatctgtgagtctgtctggtaaagatggaaggccatgcgggaggggaggcatcagctaagaccctatcctttgctcccatgaccttcctatgtctagttcctctcgctctccctgcaccaggctagctcctgttaggcccctcctgctgggttgtgtctctgctcaggtccttctggctctaggttctctctcatttcccttcttctccttcttccctttctttcctaggctagaaggctgtcagagttgactgactatggaaggctcggctctcatcgcatcccaactagacccacaatgtccctgctcactcagccccaacacaataaatgcctgtgacagaggaatgggctggctgtccttgctgtcacggggagagtgagctgggtgggtgggggctcccagcccttccaacatggtgagccagacctaggcagaagctcgagtatctgatttgggggctgcaatgtcctctggggcacttgcctttgttcattctcctttgttgacctgactccttccttcagctcagaagcagagagacacatgcacttgaacaggacctggcttcaggctagggagcagagagcctgatgttaccccagggatctcctgaagcccagatcctaggtggggctgaaaaggaagtgtccaaacacagtgcttcagagtgtggtgcccagctaccacaccctgctaggcactgtacgggctttctcagagctgggggccagtttccctgagtcctcttagacctcatagtgaaagtcagggctctgtctcagggctggacttacattaagatccagatacacctttagttctagtactcagaaggtggacatttgtgagttcaaggtcagccttctctatatagggagtttcaggccagctagggctacacagtgagaccctgccttaaaacaaacaaaagcaaaaataaacacatagatagataggtagatggatagatgaatagatacatagatagatagatagatagatagatacatacatacatacatacatacatacatatatacatacatacatacatatatacatacatacatacatacatagaaagatagatagatagataggtagatagatagatagatagatagatagatagatagatagatagataataaaaatccagaccctgtggctattgtgaacccacatatgggagccaggggacactaaaggccttgccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactacatagctgagaaagggcgtaggcagcctggaagtttgtcagggagagacagccatgtccaaatcaccaaaggtgagcccagcagcgacagaacacagctgctagaggagcaggctgtggacttgaatggagactcagagacagcccagagtgtggccttcacagcttggtcagtgggcacagcctggaacctccacacagtccctagttttctcatgctaaagaccagggtaccacactaaggtcaactttcagagtccaaaatattccactcagctgcttctctgtgacctagggcaatgacactcttctacttacagccctttgaggaacatttctgggaagggctctgagacgacagcaggcctgagaaggtgggggcctaggtgcactcacacactcatgcccttttaatacagagggcctatgctctggcagctggtgggctgagggactcggggacttactctgcccctgctgtcactcagccagcagtcactatcgtagctcaggtcccaccaggtcttgaggataagttatgtctggagatgtcacagagatggcctcccactgagggtcctgaatatccccagagcagaatctgcttccctataggacaaggctgggactgtttttctggaagctcagaccttgagatcctttcaaggctaagtccaagagttccctggtgctcagagtagccaggtcttaccccagccaaacagtagtgtgtggcccatgtgctgactcaggctcattccactggggacagcctggagaaaggcgaggcaggcctgagactaggtggggtagggcttctaggtcagtctgccctcagtttctgagaatcctcaggcagcttgatttttatgctaccggtaaggctgagagggaaggcctgaccagaaccaggctgaggggaggaagacagtccgaggcctcatctcagcccaacagaggcccctacttaccgtgaacaagtccccatgacttggtaggcccacatttaacaaacttccaagagctcctgcagggaaggaatagctccactccttttgcacacataaggaaactgaggtgcataaaggcattggcctgagtgacactggcccgagtaacattggcttgagtgacattggcctgagtgacattggcctgagtgacattggcctgagtgacattggcctgagtgacattagcttgagtgacattggcctgagtgacattggcctgagtgacattggcctgagtgacattggcttgagtgacattggcctgagtgacattggcttgagtgacattggcctgagtgacattggcctgagggacattgtcctctgctgacccagaatggcacctctgtcctgctcagatcatctcctcctggttctgagccaccagaggaggcaggaggggatttggggagaagctatgctttaacacacagctgtcctatggttcatgggaagtagataccctcaacctcataagaacttaggagaaaagacctcagtggcagaggtggcacccaggagcatgcagaggctcagcctgggggacctagggacttgcttcacagcgccggctgagttctggcatgctgtgcgttcatctgtgtgagcctgtttccctcacaggacactagtgaaaatggacaccaggatcctcaaaatgggatggtaagagcaggggaggagggacccccagtacagtcagaaccccactaaacttcctggaaggcttcctgcaggtgctcaggcttctctaggagggaggtacagggggcaggtgctgataaagacacacttgggagatgaaaccagcaaccctctcagacaggagacagggccagaggaggatttgaaaggactataggtacctcactccttatgactatggcttgggccattgagtagattgggacaggacacttcgggggcaaaaatctaggtggggagaagccttctactgtggtgggggttggcaagcctacggacctcagaagcttgtcccctccagaggcagcctaggaccaagggtgctgtcccttctcagtgacctttacccaaggtcccaccaggatcggcaccattccttctccggtggagcagtccagcctgagcagcattgtggatgggtgcggagtaaggtggggtcctggggctggtccagaaggggtacacaggagtgcatggtcagcaaaaggcccataatggcttggaaacaaggcagcccctacctcaccaggcagggttgactttggaagtagaaccaccaagagtcagtctgagtgccatggtccttccaagaggactggattacttcattgtcattaaaaaccacagtattccttgcaacagctggaattgtcaggctgtccctgactctgttgcctgcctgtggatcctgttcccctaagtgggctgccttgtctggcctcagtgggagagaatctgcctagccctgcagagacttgatgtaccttggaggagagagatgggagggggagctactaccttctcagaggagaaggggtgggggtgagggagaggctgtgggagggaggactaggaagaggggcagcaatcgagctgtaaataaataaataaataaataaataatgggggaaaaatcaaaccacggtatctgggcagaaataactttagagaagaaagatttattttgaggcatggaaccaggaacaatggagaagagaaagcagcaggaacagaggccaaaaatcaccttcaaaggcccttctccagcgacctacttctcccagcgagaccacacctcctaaaggttccacagatccccagagaactgtcatccatcagaggacgtttaagcagagtgctggggacatgtcagatctaaaccacaagaggcttccacacttggaagtacttcccattactctgcttcagtcatctacaggaccccacacacaggttgatgctcccaggtttcgccatgttgctcttctgtttgtttgtttgtttgtttgtttgttttttttctgagacagggtttctctgtgtagccctggctgtcctggaactcactctgtagaccaggctggcctcaaactcagaaatctgcctgcctctgcctcccaagtgctgggattaaaggcgtgcggcaccaccacctggcatgttgttcttcttgcccccatcctcagcccctctggagaaaactcccagatcagccgctgggcctggctggggtcgggctctgtagtcagcttccctctgacagatcctctctccttaggttctgggcatggatggagctgagtgttctgggcagggaggggctgaggtgggctgagtaaaggggttctggaatctacccacttccggtagccccaacattagtgagaaagcaagagaccttcctcacaaagaccactcagatgttcatgttaaatgagcctgtgccccagaacccaggataaataaatgttcctgggccccagggacgggatgaagggcagtgtgggctggctctctctctcttctgtggtcattggtgtcccatccagagacagattttggaagccaggaggaagccacagactctgtcctcacctatagtagcttgaagcccaccgcttcacccttcccacccatcacctctatgggagcccaaagggccaccatgtgaaccccagaagctgaccacgggggaggctgtactcaacatgccggttcttggatttgcttcagggtagagtgcgtgagcttctttatcttggtgagggttcctcatggcctcatgactgctagcctttcaggaccaaatgttcaaggcacaaatggtgctttgtgttccctgctggggtcatgggacttggagagggatgataggtagggcttgtgagaagcaggtcttagccctaggtgggaagtgactagattttccagcagcagggaagcgccagagtacacacccggcaccatccccactgtgaggtatgtgggctttgccggcaggagtgggcaaggtctgagccagttctgcctctggagctggggatgggggcaggcagaggtttcttcttctcagaggtgtggggctcagctggaacctcttacataattagcagatgaggctgcagctgggacagccaccctccctcacaccaacatcacgagccttcagtgggcagtccttgggctttgggtggaggccaagcctgactcataaatagggggtctccacagtgccctctgctccttctgcccagttttccttgctttgtccacattgctggcatcaggcccaggcacctgctctgctctgagcaaatggctgctcttcgcatgctgtggatgggtttggtcctcctgggtctcttgggattcccacagaccccagcccagggccatgacacagtgcagcccaactttcaacaagacaaggtgagaaggccccctaccccacacccaaagaagcagagccctcaggccagagccaggctttctcttaccaaagagggtgttctgggcactgtcagcctgtgtgcttgtgcatgggagctagctggaaccaccctggcacacagcctggttggtccacctgactctgtcaggaatgtggtatgctctgatatagtggactaggatgagggctgtgacaaagacaaggagttcaacaccctggggaaagaggggggtctctgctacccactcctccatggggcgatgagccagcctgctagaaagggaggggagtggagagagaggcatgctgctaggacctgtgtggggaggagtcagaggagggaagaccagcccaccagggtctgcccatgaggggctcatggagcagacccaggcatccactggtcgcagttcctggggcgctggtacagcgcgggcctcgcctccaactcaagctggttccgggagaagaaagctgtattgtatatgtgcaagacagtggtagccccctccacagaaggcggcctcaatctcacctctaccttcctcaggtgagacaaggggttatggcaaattctgggagacatcctggggcttggtcccttacttcaagggcaatctacccacaggaaaaaccagtgtgagaccaagatcatggtactgcagcctgcgggggctcctggacactacacctacagcagcccccgtgagtgagccacttccttatctgggtacaaccctctgtcccaaaattgtggggataatggtcacagcacatccaaggccaggtctgattgtgagtctgcctcaggcacacggggccacctctctctggggactttagtcctctctgaggcccacccacattcttcaaggtccctttcctgcccaaatggaattttccagtactctgctgctcaagtgggtcacatacaggcattccccaaatcctacccacatttcatagcttctatccaaggacctctttccacccctcacctgagctctggctccccaccagaaccctattccctttgctttccggctatattgtaacccagcctgctgatgtcttgggtctaagtgctttctactctctccccaagacttatggtttggagacagtgttcccaggctgttcaggcaggaagctagaaactgtctggtggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggacggagatgtgggagccacatgttccaatcagtgtcatttcttgggttcccagactcgggcagcatccactccgtgtcagtggtggaggccaactatgacgagtacgctctgctattcagcagaggcaccaagggcccaggccaggacttccgcatggccaccctctacagtaggtatcccagcccacaggtccacgcacaggggagatgcctggggttggaaacagaccaagacctgaccctagagaacagtaacaaaggtgtgtgggagcagggcgggggctttttgcttcctgacaccagaccgttctttatctaccaggcagaacccagactctgaaggacgagctgaaggagaaattcaccacctttagcaaggcccagggcctcacagaggaggacattgttttcctgccccaaccgggtgaggggggctaagctgctggggagggaattatagtcagattagtgcagcctctggttgcagcaagtgagggcaactagggcgagcttagccttgccctactacctgctagtccagggggcttcaaggaaataaatggaggtgtcagtctgtccgacattattacatctacctacagccccctttattgggaatcctgttcctggtggacacctagctcccctgtctgccagccccctagctaggggtgcaggggtgatactggaacaaacagatggagaaagacaccttttatgttttaaaggacagattggggcagaggtgggtggagtctgaagtttgggggctcagccaaagctagttctccatggccttggggaggcttcttagagtccaggaagaagcatggagtcctggtgaatatgtgtctaagcctggtgctcactacttccctgggcttctttcttggcagataagtgcattcaagagtaaacgcaggtgagagaagtcagtcagagggctggtcacatggtaagcgctacttggccatttactcatcaataggtggccactgagtggtcacgtgaccggagtggtggggatacagctcccaagcacacgcatccaagtgaggcagtccaaaagaaggtatagtttcaataccaatggctaaaatagggtatcaatggcccagggctcgtgaggagaaggataacagtccaggcgatggggagagaccgccgtcccgtgaagcctatcccgcagcaggggtctccaaggagccaggatgggcaagatcaggaaggggaatggccagggatagagatggcaagtcagagggctccacactagtgccattgactgtgcctttgggaccataggctctggaggaatattctaggaggccctggccagaagtgctgtttgggccccactggggctaagggtgctgctgtgtcactgacgcctcttgttcttctgtccaggtgacctggcctcaggactcctttgctctgtcactctcaagatcccagccctggctccccaaagtacctctacaccctccagctttgccttgacaaagaaataaaagtccaaagcaagtcagatctttgcttttgtctgtctgtcctctaggcctctgggctgtcctatatccctcttataaatttctcaatataatgaccagaaagatgtctgctcctgctcaagccctgactaggaacagcctgactgatgtgcctggttcagcagctactctgcatagggaggctgcaacctcaccacgtgcccagccaatctagtcacagacctcggctaggctgctgtcactcaattgctaatccttcaaacatgtgtccacccctgtgcatctggggagcctcggatcccataagctttcaatgtggggtaagaatctttgtattagacaatacatttggaaggacaaaaaggagttgttccttttacaacaacaatcctgatacagattaacagagtgggctgaagagaggctggctgcctgtacctctgctcctactccagccctctgactagagccctagtcaaaggcaccaaagccacagatggccacctaattagccccacttttcttccagatttccgcctgagcagctattcccaatcccttgtctctttccctcctggttcatagtgaacaggtcccaggcccaacagaccacaccaagtcctgggtcagtggagagggttgcctctgggaagtcttccgggagaagggggctacactatgcctgatctgacatgccagaactgtttggcagccctcaggcccggaggccactaggcccctgcccccgtctgctgagctccttacccctcccacaggaaacatgggctgacaggatgtggtgtggtgagtgtagaaagagccgagccaggtacaattcagtcaacggtctggcacagtcactgtgttccaggacaggccggctgtctcagggcatcttggggatatgaaggccactgagaagaagccatgacagtcccttggcctggaggatcctaggaatgccgtggctctgctgatttgttctttgccctgcttggagtgtccccggctcaggtccccaggcaggacagcctgatgtcagccagggaagtccacaccctccccacaccctctcgtctcaccttcttcaccccaagcttttgtgcatactttctttggttccagcctgccagggtcttggacttaaaggcctccatccatttgctacaatggactataaatggtcttgtgtacacagtatcctggactagaagttggaataagttgtctcagtctcccaacactggcttacagttgttctaggtacagaggttatgggcactggacactgagccttggcaggaaagcaagagatcatgacaagatgaagtgggctcttacagcatgcagaggattctacccagcttccctgccctaccctgccattcagaggacccagcacacacttggggctacatcagataaccaggggttccaggactatgaaagatacacatggtcctagtgaacgccatgcccaatggtggcctggctgtcgtgtggtatctcacatgagtgatcctatgaaacccaccttcaatttatcctcagacgaggaagtgtgtaactccgtgaaggtcagggggcagggatcagatctgtctctggcataccaaaagtacaacccagagactccagacagcctgggctgtggagacccaaataagagccacagaagcccgctctccgaaggaccttggcctacactgaagtctgcctatggcctgtgtgaggaaacaaggtctgtatgtctgtgtgcatctacggaggaggctggagattctacacaccctcctttcccgctcccatcaccgacgccctgtaaactaaagcactcagtccccttgtgaaggccaacaggagaccccatgacagctgtgcatgggcaatgtcctcagctcaccggggctgcctgaaaaagcaaggcagatcttggggttgagcaccttcaagggtcactggtggctcgggtgtggagatctttctccccaggccaggtggcagatgacaggagagagaagcaaccttcaccaagagtgccctagccaggcagttcagcaacccaggtaaggagtttggatggccaaaagattgtcatttggcagcagggaaagaagtggggtggggaagctcattgtgtaggctgcgggactggggtggccatcttgggaagtgtcccaggggtggcttctatgttggggagcttcctaagtaggcaggcatctttgagtcctgaccagcacccacctttcactattagtcatgacctagagtagcatccctgtgcccttcatggacaaaccagagcttctgctgtgatgtacttcaagacagagaagcaacactctccagtcgttggcagaggagctggtcctgataacccccagtaccagacacaggctccttctcctggagcagtgtccccagcctgggtgggagtactgcccaggacacatctcatcacctgctcactcatggagaaagaaactttgtttctcagagtgtcttcttgagacttccatgcttatgagtctgtagcaggctggccaggtgtctaggccaagtgaggggccagaatgcccaagtcagtacacacaagagactatcactggctgagggtggaggacttagggaagggacaaaggcattcatgagatctgctttctcaacaaatcagtgtgttgggcacagatgagtgtcctcagaggtccctcccaatgccccactctaacaccaacatagaactacattgggcgtggtctccaacatggagaaggcagggaggcctggccaccatagcttcaaacagctaccgtgttcctccagatccttactgcccactttcagtaatgtttggggagttttcagtaatgctccacctgctccttgtattgggtccagccacctgcggggtcagttggctcatgatgcctctatgctgagtcttcacccaaagagctccctgtttttctctacagctccccaggcacaataaacactttggtgaggctgacagaagcagtgtttcataggggagtcagagagtgggtggtgggtggcaaggcctgtctaagtctggaaaccacataggctgggtcctttagggcagtaccttcagggaaaggactacaccttagttcttcgtgggaagacccaaggtgcctaaaggcccttcttggaccctgtagtccccagcatctagcctaagagtatgatacggctggtttagctgcccagaagctcccgctttggaacagcaattacatgaggcaagccacattccaccctgttccatgtgtgccctgggtcccgggagccactgtagacagattcagctttcaagtacatcaaatagaaggtcactgagatgcctctaaaggtaaaggtacttgctactaaggcttatgacctgagtttgatccctgggacctaaggatggaagaagaaaactaactgccctttgacttctgacctctgtaccatgacacacatacacccactcacaataaaatgaatagaaatgcttaataataataataataataataataataataataataaactgagggaggtgctcacattggctctggtctctacttgcacatatgtgtgtacatgtgaatatgtagaacacacacacaggaaggtaagtgtattatttctgtgtttatactggacacagtataacttgtttggcttttgtgtgtgtgctaggaccctgttgtgtactcctgctgagcaggtacctgggatccttgggcttcagcctttccatctggatttacaagtgtgttccaccacgccctgaagtaccaatgtttgaagagacaaaattgtcccgaaatgtttgagggtatagttcagtgacacctgtaatgtgaatattatgcaaaaattaataaaataaaatagaatttaataaaaatattgattgtaaatttgtcaaaatgttgataattcgtccatctggggctcattatgctgttatttctgctttgtagtcggtttaaagtttttcactcaaattggtaaaacaaacaaaacaaagcaaacaaacaaaaccagcagctccatgggaggctgagaaacaaatccttgcagactttagcagcctagaacaagaagcagcgatatctccaggtccttaaggtctgggacaggcccctcgagtggaagaggatgccgttcaccatctcccagacctgaggcctggacaggactctgcttcctggctctggctctggctctggctctggctctggctctggctctggctctgcctctggctctgcctctggctctgcctctgcctctggctctggctctgcctctggctctggctctggggctctggctctgactctggctctggctctggctctggctctggctctggctctggctctggctctggctctggctctggctctggctctggcacaggcaggcctccatactttaatatcaaaggttttcctgggttgccttgtgctgtggtgagcaatgcagtagggatgggagaaatgacagacatcatttctgccatattccagtggctagaatagaagcaagaccttagatgcagcttctaggagggggtcagacaatggtggagatgcaggcagacatcaaggctgagccagaaactcctaaaaccaggatgtacggtacacagtgaaaagcagggaaagtaagacatgggagagagggatggagacttgagcagaggtgaaatgttctacatggatcctcaagaggacactttcaaaagaactacaggtaagtacacccggctggagacaggcaaaaacccatgcacgcaaaggctctagtccggagcctcagcagggttgagcaaaactagaggaaagtgggaattgagtatgtttggctgatggcacttttcaaatgttagcacagttcaccaagttactaaccactctcaccatggttctcataggttcatgctagccctcttccacagccttgggaagacttctgttcccatcaggcctcctcctgagcacaccctttgctgggctccattctctgcaggtggcatcagcccctactatgcaggccctgtgtggattctcatgagcatttgctgcagtgtgagtgctgtcctgtcggactagtcatctctcccattagatctcaggttccagagacctcctgttggtgaaggtgtcctcagggctgacaggtatcacacagagggtggtgactcagacaatgggagggtattgcccgggagaaaactgcatctccaaacgtttccacatgtactgtacttactcttgtattttggtttgttacaactcagctttagaaagagatgtgtttatatctaaagtgacaggaagggacaagtgaccaacagtttggaggccctgcagtacaagcccttgggggatagataggaaagaagaccggcattgaagagcggcagatatgttgctaagaaggacccagaaaagcggaagagcacaaggagtgagaccatagtagatctctgtttggatgcaagggccaaagaacagagcccagaatagcactgagtagctaatgcgctaagccccgccctccgagtgcttcccgccccgccccacgtgctaaaccccgccctttagtcagcctcttacttaatgcctggtacccggaaacaatgtcaaccttgagtaccgcccatcgcctcgtccttccgtccctccagaaaccagaagttccgccgccgagcgaacaccttagattgtgagtcaccgagtttgtacttctgcgcaggcgccctcagcccacatctaacttggctcctgcggcgagaccgccctgctgtcatggctcctccgttgttgtcgctgccgctttgtattctgccgccgggttcgggctccccccgcctggtgtgctactgcgagcgggatagtggtggagacggggaccgcgacgacttcaacctctagtgagtggagtctagggatgtggggtgcgggagcatagcgggcacggtgcctgacagcccctcccacccagtgtgactgacgccgccgagctctggagcacctgcttctcgcctgacagcctggcgaggctcgtgagtaacagtgctggggataggagacagctgggagcttgccaccctccccctccccgtggcagtggttctaatagcatttccagggtagggcagtttggaatgtccagtgggtccagggtcctgggcggggttagtgacaattccttgttcccagcagaaagcccgatttggcctaagtggggctgaagatatccattcccggttcaggtgagttccagttagggaggccatgtgaatgagaagcttggggtagtgctaacacatcctggccataacacacatctccctccttagggcagcctgccaacagcaggcagtaactgtaagcctgcaagaagacagagcattgataaccctttcaggggatacccctgccctggcctttgacctctccaaggtgcccagcccggaggcagcccccaggctgcaggctttgactctcagcctggcagagcatgtatgcaacctagagaggcggctggcaggtactgtatgtgtgggcacctgtaccttccctcaggggcatgcttttgcagaccctcctggcattgagtgagatgccacgactctctcttagctgcagaagagaccatcactagccccaagaagaacacccagccagcaggcactcagttcttaccaggtaaggggtgggcctggcatgtgggctggggctgctctttctctggaactgcctctccagatgtctcatgggagaatctttccatgtggacagagttctggccagggttctttggagttcaagatttccctgatcctattttctggcagaacttgatcaccagagaggcagctctgggcctggggtcaggagacggtgtccaggggagtctctcattaaccctggcttcaaaaggtacttgccacctgtctcccctgccctggtcccttccttttcttctatgtatttacatactcttgtcttctagtaagaaaccagctgctggtgtagactttgatgagacctgaggacagcaaagcctgttacttggccaggagcctgcctgcaaggaaaggggagatctaggaccccctaatcagagacaccccttgcttcacttcccctgtggtcctgctgttgggcaaaggtgcctctcatcccttctctgtcaaataaactgctccctcggggagagatgctaggccagccttgagttgtgaagattggccttggggagggggcacgagaagacccctctggtgtactgtggagccctgggaggcaaacagatgcatcaggctctcggcatccaggaggctctcccgcctaggtcttaaggcaggcagcagagctttctcaggcctactgtgttgattctgcgtggccagcacagaagctgagagcgtcctggtctggtagagccacaactctctaaggcttagactggtgtcccacacttgcaagccccacccaggtagcacagaggcgttgtcttggaggccaccacagggcattagacagtagaagccccttataggagatatggttggcccacagtctgtggctggactgaggaatggaggcctgcccccacccacttggccaggatcccagaggctgagcttcatggggctccccaccctccttggccatccagggcaccccgcccagctctggcctgactggtttgggagactaatccaatcccctagatccctgatgcctccgtgctggggcagctgtaaagggccccaggcctttgttccacaccatggaggagggtgaattgtgctttgtccagtggactctcttgtcttcagcatttggggacaccacctttaactatgtttctcaccatagggttgaggtggtgtagttgtgggtctctggccatttggacgttcaggacacaattacttggggcagagatgctttatggggctgcagatgagtgtatggaagtagtggggctaacgggggtgcacagcaggctggtaggcagccaggatctctgcgctgtgtggacacgtatacttgaactccttcttctgcaacgcactgtccaagtagcgacgaacgcaggacagttccgcggggatgggcagctggcggaagtgtgcacacacggtctgtgggtgcagcagagcgcagtgagggtctcactcgatggccccacacccacacccacaccctacccgctggtccctcactcacatccacaatgtgcagcttgggtagtagactgcagtcagccaacgtgaactggtcaccatcgagaaagcggcggtgggactcacgaagatgtggctcctgtgccagttcgtggtccagtggtgcacgcaggtagctgtccagcctggtcagggcccggagcagctgctgatacagggcttgggggcaatggtaaccatgaggactcagtcttgaccttgggttagcccgcctgcctggacctgctggcctgtgtctcaccattgtcctgtgtaggcactgggttcttgatgaaggcagagaacttgtggaagatgtcattgcccgctgtgttggactccctgtacctgggtgccaggctagggaagctataggtgtgaatagtttgagaattccagtcagaccctcaagtacactgtgcctcaaagcacccttcctaggcactctcccaggtgtcccccaaggaggtcccatctttgccctcttgcccaccccatcagatgctcactcaggtggccccaacgtctcctccagaaactcctcgatctgcagtgtgtctgtcttgacatccccatcgtacagcaggatgggcagttgtgagcctggtgcgaagtccttcagcacatccaatgccctgtgaacaccaggcagaagggaggtggctggcccgaggtgggcagaggccagggaagggtccagggtggtgtctcaccttcgagtgtccactgtggtgagtgtgaagggcacacccttgaggagtaggaccatgaagagccgctgacaggaagggcagtgtcctacgctctcgccatcctcactggcctgggtgggtggaacagaggtgtcaggctctgagcagacccaggaatcctgacacctggctgggtggagctctgcctcccactgccattggctctggaggcaggctagggctctggcctggttgagcatggcatctacaagtgtctagtgagggcccttgaactgatcgctggaatggggaggacaaaagaagttgggagcttagaggcctaggcttggggtcctgccagagggttccagtcacagagactggctgcagggtggggcaggccagagattcatcctctagtgattaacccacacaactgggtattgaggctaacagctcagggaagggagggaagagaccaaagaggaggccaggacctgctcccactcagatctgagcactggcctgatagctaaaagggccatctctggcaagcccccagtctggcacatgaccctgaatctctactaaatgccaggtgccagctaccagactgacatctatctcctcactaagaagctttctcccagagctgggccaggtccacgagccaaagtgaagagcgggacccaggctctctgatcctccttatggtagctcctcacccaggatgcctggctctcctcagccctgtgtggggcaactcaaacccaccacagggatagggacttgggcaccattaggaagacccacccctcctcccaaacaacaagaagaaaaaagcccagctccccttccagcccagcctgcccagaaccttcacaaagagctggagcttggtggtttcagccatggtgggagccgaggcatccggcggcagcagcagcccagggcacagggtgtgccttgggagctctttaagtctctctgatgccccaccctccccaggcagtgggcccgccccaaggagccacctaggcaacagacaggtttccagagc

SEQ ID NO: 848 - DNA, 910 bp, Mus musculus
gccctctgctccttctgcccagttttccttgctttgtccacattgctggcatcaggcccaggcacctgctctgctctgagcaaatggctgctcttcgcatgctgtggatgggtttggtcctcctgggtctcttgggattcccacagaccccagcccagggccatgacacagtgcagcccaactttcaacaagacaagttcctggggcgctggtacagcgcgggcctcgcctccaactcaagctggttccgggagaagaaagctgtattgtatatgtgcaagacagtggtagccccctccacagaaggcggcctcaatctcacctctaccttcctcaggaaaaaccagtgtgagaccaagatcatggtactgcagcctgcgggggctcctggacactacacctacagcagcccccactcgggcagcatccactccgtgtcagtggtggaggccaactatgacgagtacgctctgctattcagcagaggcaccaagggcccaggccaggacttccgcatggccaccctctacagtaggtatcccagcccacaggtccacgcacaggggagatgcctggggttggaaacagaccaagacctgaccctagagaacagtaacaaaggcagaacccagactctgaaggacgagctgaaggagaaattcaccacctttagcaaggcccagggcctcacagaggaggacattgttttcctgccccaaccggataagtgcattcaagagtaaacgcaggtgagagaagtcagtcagagggctggtcacatggtgacctggcctcaggactcctttgctctgtcactctcaagatcccagccctggctccccaaagtacctctacaccctccagctttgccttgacaaagaaataaaagtccaaagcaagtcagatcttt

SEQ ID NO: 849 - protein, 246 aa, Mus musculus
PLLLLPSFPCFVHIAGIRPRHLLCSEQMAALRMLWMGLVLLGLLGFPQTPAQGHDTVQPNFQQDKFLGRWYSAGLASNSSWFREKKAVLYMCKTVVAPSTEGGLNLTSTFLRKNQCETKIMVLQPAGAPGHYTYSSPHSGSIHSVSVVEANYDEYALLFSRGTKGPGQDFRMATLYSRYPSPQVHAQGRCLGLETDQDLTLENSNKGRTQTLKDELKEKFTTFSKAQGLTEEDIVFLPQPDKCIQE

SEQ ID NO: 850 - DNA, 24492 bp, Homo sapiens
  misc_feature (1)...(24492): n = A,T,C or G
nnnnnnnnnnnnnnnnnnnnnnnnnnnnnnnnnnnnnnnnnnnnnnnnnnnnnnnnnnnnnnnnnnnnnnnnnnnnntctgtttgtttttgtttgtttgttttttgagagatctcactctgtcacccaagttggagtgtagtggctcgatctcggctcactgcaagctccacctcccgggttcacgccattctcctgcctcagcctcccaagtagctgggactacaggcgtctaccacccctgaacccggaagttgcagtgagccaagatcatgccactgcactccagcctgggcgacagtggaagatactatatccaaaaaataataataataataaaagtttacattcaataaataaaatttttaaaaggatatttacatcagtgtagtatgtgaagtaaacaagaaaaagataaaactcactttttaagtaaaaacaatgagtcatgttcttgaagtatgttgtaatctttaaatatcagaaaattaagggaagttaatttttattattactattatttttttttgagacacagtcttgctgtcgcctaggctggagtgcagtggtacgctctccgctcactgcaagctctgcctcccaggttcacgtcattctcctgcctcagcctcccgagtagctgggactacaggtgtccgccaccacgcccagctaactttttgtatttttagtagagacggggtttcaccatgttagccaggatggcctcaatctcctgacctcgtgatgtgcctgtctcagcctcccaaagtgctgagattacaggcatgagccaccgcacccggcccctattacatctttgtttctatttgtttaattctcggtctggtgagggtcagcccccaccaagggtcctggcagtttcccttctaggctcgcccctcccctgcccacgccccggcagccctcaccccagcgtggctgggcgggtgggggaggggcttcttcctgggagggaggggcccctgagccccctgcacaccagccgggccccatctgtgacctctttgccacgcctctaataccgctcgcttgctcagagggcacatggccggggggtccttgggagtctgtgcaaagccttagtcacatggagggacctgagggaggctggatgtggaggagacagtgagagaaggtgaggtccccgtgtcatgtcacccatcacctgccggccaccaggttcctgcctgggacagctgagccctgacagccctcggcgaggaggcccgggctctctagcaacctggctgcagctcctgacacaggctgggctgcccttggcccagggccctccagagataacccaagtgccctgtgagcaggcctgagggagggtgggtagcccaggacagggcacctgggggtgaggcagagaccaaagacccacaagatgctccccaatgcaggctgagctccagggagctgctgggatcctggaagaggacagaggccccccaaggccttagaggaacccagagactgctgggcccagtgggaggtgtctggaccctccagcctgcgcccacgtcctctggcccacctgcccatcgtgcctctgccaacgggcccagagctgacgcacccccacagcccagcgcccgggtcaccaagtcctgaactcagaaatgcacatattccctgggacccctgagaattgggctgtggccaggccaaggccaaggtcctctggggaagccccagctaaggtcagcagcggcctcccagggtcagccatccccaggggcctcattacaggaccagggtggtaagaagtccgcagccccgcacagcagctgtcgaggggaggcagatgggctgagggccctgggggagtggggccaagacctgctgcacccaggagagaggaggcttggaggacaggggtggggctgcatctgggaggtcctggcccagactggacccgtgggcagagcagggtgggtgccagcagcctcagcacagacacactccgtcccacccaccaccagcgctctgcagcctgccccgggccagggaacagcttggcctgatcctgctgacacctcagggcaggacagggcagggaggctccaggcggccacccatgctgggcacacagtggactttcgcacggtgtcttctgccgtcacaccctgacccagggctggccgggagccttcggggcgacagctctgaggatggacgtaggggtacgagggcagggacccgggctttgggaatcagagctgaggcctggggcctccctgggagctggtggtctctgcgggtgcccaccctcagcccacatttccaccccgcttcccctcccaaggttgagaccagggaatggtgggcaccagtggaaggcacgatcctcaatctttgctgggccgagtccaaggagggccccctgcctccccagcccagcctccctctgccctgcctcgccccttagccccgctgctgaggagggagaggggcaaaatctcacccttcctgcacttggagaaaaagaggttgcttgtcctggggtgggggccagcaggggacctcgttactagggggtcccagcccagaccctcacccacccccttccccacccccatcctcaccccctgccaggccagctgctgccccagagtcctgccccctgcagccctgtgtggagccctgggactcctgtgggtgggcctcaccctgctggggacggtccagccacagcgccagggcccccagaggggcctgaacttgcctttccacaagatctgtctccagcctggcctcagaaaggagcgggtgagtggcctccaggatggggaaggaggaaggagggtgcagctgggccgatgggcctgactgccacagtgagcatggcccccatggccctggagaaccctgccaggtgggaagagctcacgccctctgtgcaggtggagaaagtgaggctcaggaaggctgcccacccactggccagggtcacccatccctgtcagatccggactcctgccagagtcacaggtgccagcccagcctggaacccctgcctggggagggggtcctggccctgcccactgccagcccctgcagttctgggggagtggtgcgtcctggggctggcggtcaacactttcaggccggagcgcaggtcccaattcaggatgttggtggcagccgtggtcacgtccagcctgctcagctgaagctgggtgcccagagcccctgccgggtgatgggactgcccggggaggggagacggagggctgtggggtggagacccttcatacagacaggcaggtgggtggaccccgtgggtggaaggaggcagcgcctgccttgagggagctcacccacaccctcagcacagctgtggggcccctgcttctcccccggggcctgcagtttggaggaggagcctgtcctgagacccaggggcaggggaagatcagggcagggtgcagggcccagggacatggtggctgtggctgggacatcccaattccatgcatccagtgagaacttccacagggaggggacgtggtcagaggcggggacaggcaggctgccaggaagagcagcctcaggaagagtggggagcaggaccctccgggaggccaggaagcctcccctccccagctcatccgacctgcccctccccaaagccttcaccccagcctctccccaccacaacctcctcccacagggacccaccctgcaaacgctgggccaggacccctgtcccggagaagcagccagctcagaacccccttggaggccgggagggtgagtcttccctgcctgacaccccaagaaaggcccagaactgccccaggttaaggtcactccacatctgtaatcccagcatttagggaggccgaggcaggaggatcaactggggccaagagttcgggaccaggctgggcaacatggggagagcccatctctacaaaaataaaattgaaaaattagctgggtgtggtggtgcatgcctgtagtcccagctacttgggaggctaaggagggaggattgcttgggcccaggaggctgcattgagctgtgactgtgccactgcactccagcctgggcgacaaagcaagaccctgactcgaaacacataaataaattaaaatggacactccagggaaggtcttggtgtggccccagagggggcatgatcagcagcctgtccccagcagtagggtcctgagccctgcctgacccgcctgctccgtgcagaagtggggttggaaaatgacgagatggaggctacgccgagaccaagcgccaggagaagggacccaggccaagctgctcggtgaggccctgagcacggcgggaaggggccatgcaggaccccctgagggctgggctggggagggaggggtctccccagggctcaccccccttcttggcacagggcaggggaaggagctggatttagacctgagggagaaatttatcagatttgaccagatcctgggcatcagccttgaccacattcccttcctgccccagactggccccggcaggcctggggggtgtggggtaggcaagcagagaccacactgatgcggggaggttggcccagagccctgcaggccaaagcctggggccgggcagcagtgtccgccgaggagagggtgtctggtgcctgaatgacacaacctgagaggcaccagccccaatcctgtccgtgcagcccagcggggaggactgcccaggagaccataggggtccggaggtcaaggccaggtgccagagggtcctggcaggacccggggtcactggaggcaccccacgtacacggcaggcggaggggacggcagtgccggaggaggggctgcagggaagcccttgtcagcccccatttctgacccaagggccttggccgggaaggccaagcttgaggcaagagggttctgagctggaagaggccaggccccccagacgcaggggccccgtgggaagagggaggccatgagctgaggccacagcagctgaggctctgagagctgagagtgagctggggccctgccggagcctcgctaccaactgctccaggtgtgggggacactgcggggcccaaacctggacacacctgcggcctggagtgtcccccccacccaacccagggcctctgagggtctctgcccaagctcctgggtcccctgtactgggccacctgcagctcccaaggcagccctgggggcaggcaggagcccccgggtcagaggtcgtgcgaccctggccttggacccttgggcctctgaccagcactcctgcctcacagaagagcccgtggtgagccacgagtgtgactgccaggggtcctgggggtcccgggccactctgggatccacgaggccctccttcctcctggccctggcaccccctccacccctctctctcctgcaggtctctgcttctccctcctctcactctagcccctccgtgattctctgcctgggccggccaccctctgtcctgaggacactggagcctggcccggcccttggcagccccaccctcaccgcccatcccagcctcgctggtgccccctccacgtgggaggctcagccacacctgcccccacgaccccatcagaaataaacagtctgtgccaggagaagccggatccgactgtccttgagcactgggtgatgggtgggcagggcctcggggagcagcccaggttccaggcccaggaggagctgagctcggacatttgtcctcatctaacccccagtggctgcctccctcccagctgggtgctctcctggcccgtcccacgctctctggtgaacagagccagattcatcctcaaacataggccaccctccatggcgcccagcagaaactgccctaggctggagggctgggaccgtggggtgacagaggctgcggaggcctgtgaccaagggtccctgcccagctccacagcacctggcagcccttgcccctgctaggagcgccctttcctcaccgctggctcttctcagatctgtggccccaaccccctgggttgcctcaaaggaacctcagagtgagaggcaggagcccccatctcaggggcgtgggcccaggctccctgtgtgccaccccacgttcccccgatgggaggcaggagtccctgaagatccaggcccagccctgaccgggggtgggcacagaggtggggagcagcctctgggatcgggtctccacctgtgccctgccggagccagccccttgcgctgaatggtacttccggcttctggtctctgtggggagcggtgcccagcctggtgctacagtgacccaggggtccttaggcgaggccctcccaggcttggcccctgcccagaccctgccctcctggggagctcccgcccagcccctaaatgggtgaggtggggacactttagccctgaccttccatggccgagctgggcgcttcctgaagccagactgggcctcagaggtccactgcaccgggatcctggagctgagcttctcgaggccaggggtgtgggtgtggtgtcgggtgtgggtgcgggtgtggtgttgggggttgggccgccccctcctcccggccctgctacctttgggatgcggcagcctctgaccagcctgctggaccccacattggacagatcgttcagcacccccaaattgccatctgtcccccacagacagccagcctagccctggctccaaagctgcagaattggctgaggcttggccataaccgtctttggaccccatggccagcaatgcacatatgagcctcaagtcccagggacatatctgctcccctatcctctggcttgtcccgggctgccctgtcctctgcgccgtccccggctgctgggcgggcctgacctccagggtggtgctgggagaggtggccagaggcagccagaaagggtgagcggagaggtggccgtcccccatgtcagtgaacacccaaacagacaggcacagagaggagggctgggtgaagagtgggtcccatgtgctttgagcagctcagagatgccctgaggaggggctgtcccacgtggcccgtccactcaggcctccttcaatcacagagcagctcccttgacgcagggaggccttggggagaatttcttgcccctagaggagccctgagctgcccccaccgcacccggccctggtctccccggctacaaactcaggggtgctcctgctctgcccctgacttgtccagaacactccacagcgtctcagtgatcccgggcactgcccttccctatggaagatcctcagcggggcagctctggcaggagtgagcctctggggccgtgaggcttgggtacctctgaaaggtggggtgtagaggctgcccctccccagtcccaggctgggggagttgatcccaggctgcaggtgggtggggctcacgaggtccccatgagtttatttgaggctggtggacactcagtcgagctcagctcccaccagtcactgggacagcctcggccctcaagggcaaaccattggtggggatgctggccggggccccagggtggagacagcttccctccaggaaaaggttggggtcagttctgggagcttaggcccaggccaccaggcttgtccatgacctgcctgggccgcaggcagggggatggccttggtgacctcttagggtggaggccaagtctttgcattttgtgactcaaagagactggttcccagagagcagggtggggcggccagcctccttcctgcccagccctccgccaggctccactaaggtcctgcctggcagccaagctcagagcaaagggaagggcacagagagtgtgcagggtggtccttgtccctgcccaagctgcaagaggctctgcgaaggtctctcctgcccctgtccaccttgcacagtcctagccgggggaggaggggagaaatctggcgtgccaggagctggcaactgcccagcccttcctggatgtggtgagagatgaatctccagccctcgggtgggcccaggtgcacccatgaatcagggctcgtgggcagctcccactcactggtcctcactcagccgtgtctggggagtgtctctgaccacctgctggccatcttgaccacagggactgaggagtccgtcctgaaccgaagcatgatcctgttagctcttccagctctccaggcgccaacaaccatatggtctcggtaacgactggtcagggaggagaagggacatgggacctgctgggctttctgcagcccactagaaaatggggaagaggaggggcttggtccctgttccaggcactgggtttgagggctggacacccgagatccctgggaacccctctggctatgggaggacctggccccatcagacttcagagtctctccctggcaggtgacccaggcctgcccagacggaagccattcagacccagagccacgtgtcctgggtctccctgccccgggccacccgccaccacaccccagagcttgctcaccaccgggaggcgctcttgtcctggaccagcctagcctgggttgggacctccagccaggccagtcagcgagccaccagccccaccagagtggaatgacagccaggactcagctggcagcgggcaggaggccagtcttgtggtgatatcccagccgcaactctcttcctgcccctcccctgtcctgacggcagcccccagctctgtagctgagccaggcttgcgggccacgcggggtcccgggtttaggcaccccacccctatctgttccaacagactctccctctcagcccatggcacagatggcatctgagctagcagcacgctgctgcttcaggcaggggttgataggaggtccaggtggaggagtgggttctcaggactgccttggcccccctgcaccgctgccctccttctccctgcctctcaggtgcctcccggctccctgggactcactccctcaccttggcctctgcctgggatgctacccggccacccccaccagccctgacaccagtgctgcccactagcccctgctgctacataggcatgcgcctcccccagtctgggctccttgacccccgggcactggggaaggggaacaaggaagcagtccacaccagcccactcccagggctcgtgcgcccccagcaagggatgggccacagaatccaggaagaagacgggctccggcccccagtggtcgccagcagccccgtagaagctcaccaccccaccccatccgactcactcctgctctcatgtacatttcccagctccccacccgggctcaccttcagaccagcggcagcgctcacccaccacgcctgccagggaagctcagtcccaacagaatccagagagggcccaccacatgtgcctgcctgtgacggcctgtgacagggccccagccagggccaacgagctggaggggcccaaggagctgggtgcagcgctggggtaacaggacagccccacggggtgctcccgagtctggaccagactcggggtggggaggcccagactcggcggggggcagacttggggtggggggattgctgggggaagttggggcctctggcaagggatagggcctgtgctcaagcccaaaggtgccccaggctgaaatgggcacccaggggtcactatcagagccccaacagctggccatgggggaagccatgcccagcaaacctggccctcgggaccctgcgggccagatcaagtttctctaccttggcctgagcttctcatcaacacttcacttgctgggcgtttcaggaccaaactctcagggtggaagtggggcttgtgtccccttctggggtggcagggctcggaaagggaatgatggtaggggctgtgagatgtgggtcctggcccccagtgggaagtcaccagaggcctcggaggcgggcatggctgaggaacacagcccctgccctatcagggccgctgggttggtgggccctgccagcaggaggagggtgggcaaggtccnnnnnnnnnnnnnnnnnnnntgggcaaggtccctgccagctctgtctctgggaccagtgggcaggggcctctgcctcacccccacgctgcctcagctggggcagcaggcccaggcctcttgcataagcgccctgtgggggacgaggctgcagctgtgcctggccaccccatcccccagcatcacgagtgttcagtgggctgtccccgggccctgggtggaggccaagcctggcccataaataggggtctcctcagtgccctccgctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaaggtgaggggctttcctgcgtcatccccaagggctacaggaccctgtcaggggaagggcactttccggctgggtcttccccctgggaggagtgagcgaagtcccgcagtgccgggcagtgccggccagggactgagcgggcgcgcaggaaggaggctgggtagccgcccgaggaggctgcccgcgagaagccctccctgggcaccgcgtcccgtctcccctgatgggccacgcagacaccgggccacacacgcgcccacgccagccagacacgtccacccctgtgggcacgcgacccccagaggacacacgagcgcacgttccacacctgggtgccaggacacgggcgggtggggcacagggatggcgacaaacactccgtgcgcggtgggggttgggagggacgcgcaccgcacagacagccggcgacgcgcgctctcgcccgggagctgctcggggaagcgccggagcgcgggtccccgcgccgcgcgcccctccctggcgtcgaggagaaccccagcggtccgcagagctgagccgaagacccgccccgatccccgccaggaatgcgacgtcctctgccgcccgctgtatgggccaggcgctcagccagggcacagaatcgggaccgggggcggaggggccgaagctggctggtgggcggcgtgcgagggtgagggactgtcctcgggaggggcgtggccagacgggggtgctgggtgtcaggggcgtggccagcttctggggctgaggcgtgaggggcggggccatctccgggggagggggaagtggggcgtggtcatctcctggggcggggcgtgaggggcggggccacctcccggggcggggccggggcctgatgggcgtggtcagctcctggggcggggacgtgaggggcggggtcagctcctaggggggcatggggcgtgaggggcgcggtcagttccctggttgtggacatgaagggcggggccagctcctggggcggggtcgtgaggggcgtggtcagctcctggggcggggatgtgaggggcggggtcatctcctggggcggggatgtgaggggcgtggtcagctcctggggcggagatgtgaggggcggggtcatctcctggggcggggattgaggggcgggggtcagttcctggggcggggcgtgaggggcgtggctgctcgggggattgggcgtgggggcggggccgggttggagaccggaggagtagacggcagaggcgcccccgcaggtaggcgcaggtgggtccggagggtcctggccgacgcgggtgggggtcgctcgccgcagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggtgggacagcgggcaggtgggtttctgggacggagaggtccagggacaccctcgggcctaacccctgaccctgaggtcacccacctacaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagacccttcctccagggggttggatcctctctggagcccaccattgtcttgtcaggccccttccctgccctctggagttttccccacataagcagccccccaaggcccctccatatgcctcctcccaattctcctccccaggacccaggggtttcctcactcccacctggggaatggctcccacggggaaacctcttcacttccggttctggcagcgacttctgcggctgcaccaggaatcctggttttctgagcctggctcccccagattctggtttggggacagggttcacaggctgtgcaggcgagagcagggcactggctggagagcagccgggtgggggagcatcccgggccagccgaggggctgagtgcccccaaagcccacaggtgcaccccttccctgaagcagaggtgaggtttggggggctgagtccccgacagggttgtctcttgggttcccagactggggcagcacctactccgtgtcagtggtggagaccgactacgaccagtacgcgctgctgtacagccagggcagcaagggccctggcgaggacttccgcatggccaccctctacagtacgtgccccgtggacgccgcccacacgcaggcctgaccagagggggctccccaagacccagggcagggcacacagcatcccccccgctgaggccagctccgtctccaccctgtcccaggccgaacccagacccccagggctgagttaaaggagaaattcaccgccttctgcaaggcccagggcttcacagaggataccattgtcttcctgccccaaaccggtgaggggtcctaatctgatggggagaggatcaaggtcagattagaggcaggcaggcagtctcctgactgggggaggcagaggggaggaggtggccccgccctgctcgaggcctgggccagggacagagggggtgagtgttcaagtcagaacctccctcccgcagccccttcatgaggagccccctccatgggggacatggagaccaggcgcccactctgtgccaggccccagcagctcccaggatgtggggcttcagcctggtggggggcatagggtagagggtgcccatgggggatacaggggaaccaaccatactgggctcaggcacagcctcctaggggtggacagcctgctcttggcagaggtggagaaagaccctctctttgtttccagtgcccagggagaggtgggaggtgatgggggatctgtgcagtttgggggctcagtcaagacgagctctgcgttacgggaggaacaggaagcccagtgggaaaattggcctaagtctggggttctgacgacagcccctggcttctttcttggcagataagtgcatgacggaacaataggtgagccactccattcattcattcattcattcattcattcattcattcattcaacacacatccacccaacccactctgcgatgggatggatcagggccccaggacagcctggtgctgcagacccatccttcccgatggctgcagtccagggccgggcgggagacactggggctgcccacattgatgggtgcacaggtgtgaggctcagaaggaaaacctgtcccagtggctggaacagggctgactcctgaaggctcatggttggggggtgcaggtgcgaggccccaggcagacaaggccaaggggctataccacagggaccacctggcagcaagggtgtctggctcctgggctaggaggaaaccagggtgggggagacaggatgggagggaacaggggatggaaggggagggccaaggacgctacatggatgccgtgggacagctcggagagcaggctcagggcggattcacccaccacccccaggagggaggcctaggctggagctggagtctgtggaccctggggctgggaagggtggagtctgtagaccctggggcagcggggatccaagccccagggatggatcttgctctctcagcggggctcagtggggctgggggcagagaaaagtccccgtagcccgcacctgctccatcgactggagtggaggtgggctggggtagactgcagtcctccatcctagcctttcggtcacacccctcaggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagtagagctggctcctggctgtctgcgctgtcatcacccgtcctgggcctggccctggccacccggacctccccctctaaaatctcagcctgacgtcaacaaaggaacaggccctctagtgtttgctcccagtggggtcttgagtcaggacagctaggagggggtgtccctcactgtctcccacccaccccacacagtcgtgtgcccctgccccacagccccacacgtcgagccataccccctcagctgccactgccaccaggccggtgctgagctgggggtcagtgactcatctaatcccttaggcaggtgccctgcacccccaaccccaccctgtcaccccctcagcagtaaaggcctgaggctcgaggccccagaggagctttggacctgttgggtatcttgaggtgtgggattaacgcactgagattgggcagagataagggtttcaggggacaaaaagaaacatttgtttgaaacatgccagagtgtctccaccccgcatcaggacagactgacagagtgggctggggacaggctaccccatatcccttctggctccctgagcgccccctgccctctgacctgggcctccagatcacagccttgtccactcaccagagccctggcaccacggccacaccatgcccggccagtgccctgcccaaccctgctcccttccagattcccacccaggcagccattctcaggtacacaatgtgcaggactcactgtgacctgcccaccaggcccccccgaggcagaccctgcagaggcaccaagcattttgaggctcggaggtgagggtgagcttctgggtggccttcccggagaagggggcttagggctgtgcctgagctcaaggtaggggggattccaacatcccagaggggctgcagaaggccgaagaggcaggatgggtgagctgcaggccccctcgcccagaggcccgtcagaactaccctcagctgccaggcatccggccccaccccggaggaaaggcaacggatggctggggttgggtggagggagccaggccagagcgctgcagggtgcaacttgatcagaagcctgtcacagtgggtgcagtcccaggccagccgccccagggcacctcaggggcgtaaagcctacagaggagccacctcagctctgccctgctcccgtgtccggaggagatgccatcttgctgcatgatgcttcgggctctgctgatcagttccctccttgccctgctctgggcatccccaggccaggcccaggtccccatccaggccaactttgatgccagccaggtgtgcccagccctgtttcctcctcatctccaatgagtcctcccggctttggtgctgcaccccgggtccctgtccacaccctctttgatccaggctcagcagggctaggggcaggggaaacccccacctcacccgctccgtctgactggagtaggggttggctggggaagactgcagcctccatcctaccttttcagttgcatcccccaacactccccagggcccaaaatagggacaagttggttgcctgtgcctcactgtcccccacccaccccacaaagacctgtgaccttgccacagccccacccatccagccgtaccccctgggtgccagctgcagacaggccggtgctgggctggtgggggccagttgctcatgtactgaggcccccctccctcagttctgcatcggggtcgagatgtgtacagcagcccctgccgtggccaggaagcagctgtgtcggggcagaatgtggtgggctcaggcccagggcacaggggcggcctcccagccttccctgcacttgccctgcagttccagggcacctggtacatggtcggggtggtgtcagatgaccaggacttcctggactccaaggacaccatgaagatggctgtggtcttagtgacccccttggggaatggtgacctggccctcaagtttggataccccacgtaagtgaccacacgagcccatcagactcagcctcagaggatggccagcatgaggccacatgaaggtccagagggaccatggtgtccccagcacattgaggtcagaccacgggtcctcgacggctctgtgcggcagagccccagatggcagccacatggagtccagagggacccaggccctggaggaagcactgcctgaggcctggtgttgagaaaagtgtctgcatgtctgtgtctgtgtgtgtatcactgtatgtggctgtgtctctgtgtatgtgtgtctatttctgcatgtgtgtgtgtctgtgtgtgcgtgtgtatgcatgtgtgtctttgtagatgtgtacctctgagtgtgtatgtgtgtatcactgtatgcgtctgtgtgtctgtgtgtctgtgtatctgtgtctggctgtgtgtgtctatctctgtgtgtgtcttgtgtgcgtgtctatgtgtgtgtctgtcagtgtgtctgtgtctgtgtctatctccgtgtgtgtgcatgtgtgtatgtgtgtgtcttctgtgtgtctgtgtctggaagggggacctggaggccctgcattctaggctgtgtgcctgtgaacaggtacttaatacccaccccacccccagcaggagtgtccccacctctaaggtcatcctaaagtcccatgtcctccaaggattgtgagggtgaacaggggaccctgggctcagagacagcaaggtaggctctaggcctgggcgctgggcaggggtggccactcaggggattggggctctttctccccaggccccatggcgggtgccagaaaatggacacgaccttcaccgagggtgctgtaccggggcagttcagcaacccaggtgaggtggggcagcaggcagggctgtggcgtgggggccctggaggctgcacggactgctggattggcacctggggccggggcgtgaggggtgccacactcgggggggaggtgccctgggcctggggtcagcggctctcgctcctccagccatggccctgagtgacatccgagtggccttctccgactaccagcactttgccttgctgtacttggagatgcggaaagggggcctgcggaaccagtggctgcagctctacggtgggcgggctgcggggcggagacccagacacccccgcttcgggtctgggatgtcacccctgtgcctgcaccagccctttctgcacgcggaaggtggaaccgctggctcctggtgtctgtggccgcgggtcccggcccctccctgcccctctctccctctcttcgcccctccagccccttccctttagcttacccgccctccccaccttcagctcgagcgcccgagctgtttcccgaaggcgcccagaagatgcagctactggcgccccaagtgggcctgagccccagccagggcgtcctgctgccgaagtcgggtgagcggtgccggcagccctgctgggagggccaggccccgggtcacacccctgctggaagggccaggccctggtcactccactgatctcagattcgggacagaagtgcccggggcagacccagcctgtctgggtcgggggagggcgagacgttgcccaggccggtgttcccaggaggagatcgccttggggcaggtcgggggcctccgtcccagggaagggggcgcggggtggcgcctcaggctcgatctctctgcagaccagtgtgcgggcgcgctctcccgggtgagtagaccatggccatgcggagccgcggaccatgggccctcccagctcggtgggctgcaccgcggggccctctaccttcggggcagctagggacgacagcgggggtgatggggcacccgggcggatccgagccgcagcagcctggggaaccgcggggctgcgcgtcgggagggggcggaggcaggggacgccgcccacctgctccttgttttgcagtgaggggtccagcccctgagtgcccgcaggggtcagctgctccgtgcgcccagccctgcccaaagagccccctccctccacaccctggccccaagcgcaataaacaccctgaatgcctgtggcgctgtgcgtttcttgggggcagggaggggtggcgggggggcggccaggtacatgggcgccctgggggaggggccgggtcaccccctgttgcccctctgggtaggcgttagcccaggagggaccgagcctcggctccgtggcagggaggttcctcaggacgggccccagccccagctctgggacttttctacctccgcacggacccagacccccagactgggggcgccgggagggcgggacacggacaccacgcggcgcgcgccccaggcttcagcggacaccgccgcgcgacgtggccttccgggtcctcccaagcggctgccccagtcagtgtcggcggcttccatccccaggcgcccctccgggtcccccagctccccagcccctgactcctggctccaggacccgccccagaggcctggctgttccggagaccaacgaagcgctcccaactctgacccagggcctgtccacggagagtggagggcgaggaggacaggaggagccgcataaaactctgccctgcctggagtctatgtaggacagtgttgtcttttacagacaagtctcgaagaatttgaaggaaaatagcctactagctgtaatgtacctagttcagcaaaataataataaaaatactggttgcaaatctgtgaatatttggatagtgtttaatctgggtgatgggtctacggggtgcagtatgctctgatttctccttctcagttggtcagagttttgtttgtttgtttttttgagatggagtctcgctctgtcgcccaagctggagtgcagtggtgcgatctcggctcactgcaagctccacctgccaggttcaagtgattcttctgcctcagcctcccaagtagctgggattacaggtgatcgccaccacgccctgctaatttttatatttttagtagagacaggttttgccatgttggccaggctggtctcaaactcctgacctcaagcgatccacccaccttggcctcccaaagtgctgggattacgggcgtgagccactgggcccagcccagaaaatttgttattaaaaaacaccactcgggccgggcccagcactttgggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaatacaaaaaatcagccgggtgtggtggcgggcgcctgtagtcccagctactcgggaggctgaggcaggagaatggcgtgaacctgggagacggagcttgcagtgagccaagattgtgccactgcactccaggcatgggccacagagcgagactctgcctcagaaaaaaaacaaaacaaaacaaaaaaacaccactcggcggagcacagtggctctgcatcccccctgcattcccaggaagattccgagccgggaaatgcaggttgccctccacagcctcagggatgccctttccttccttccagggtggggcagcctctgggggtggctgtgggtccagctgtggtcagcccccaatcccttgcagacgcatcgagtccctcacctcccacgctcagccctttctccacctagaagcccaggggatggattcacaagatgtgtcagatcaggcccccctgctcagcaccccacagtgggtcccattgcactgagagtaaaggcctaagtctttttttttggaacgaagtttcgctcttgttgctcaggctggagtgcagtggcgcgatcttggctcactgcaacctctgcctcccgggttcaagcgattctcctgcctcagcctcctgagtagctgggattataggtgcccgccaccacgcccagctaatttttgtatatttagtagagacggggtttcaccatgttgaccaggttggtcttgaacttctgacctcaggtgatccacccacctcggcctcccaaagtgctgggattacagccgtgaaccgccatgcccggcctcaggcctaagtcttgatggtggccaacaaggtcttctcttttaggctttcctttgacccaccatccactcccctccctccgtcctgctgccagcccctcacgtgtctcagggcctttgcccaggtcacccctgcctggactgcccttctcccagtgccactcagtgcactcactcccgtctctgaagtcttgctcaaatacctcccttggttgttgacctctgctaccccaaaacttgactggcccccactcccctagagctcgttctccggaccttttgctcctctttttggcccagcttccaggtgctctatgccttgggaaaggtcagccctttccctcccctgttctgcctccatcaccgacttcaagtgtgtgcgtggggactttgtaatccctctccttctgcttgcaaagctccactaaccttatatctcatacactgtattaatgtatcctacattaaagaaaattgctcccatggctgggtgcagtggctcatgcctgtaatctcagagctttgagaggccgaggcaggcggatcacctgaggtcggaggtcgggagttcgagaccagcctgaccaacatggagaaaccctgtctctactaaaaaatacaaaaattagccaggtgtggtggtgggcatctgtagtcccagctactcgggaggctgaggcaggagaatcgcttgaacctggaaggcagaggttgcggtgagccgagatcgcaccactgcactccagcctgggcgacagagcgaaactccgtctcaaaaaaaaaaaaaaaaaaaaagtataaaaaagtatctcagagaaggacgtggtggaagccagtggaaaagctgctgccagtagatgaagctggcccgatgtgagccacgaaacagaacatgacaccagggtgtgagccaaagtgtaaaataaacacctgaggtccacacggacccagcctgaggctagttaaatgaaggttttgcagttttctcgtcatgttttggaactaatctttgtttctggtcttgtgtcagttcctacagctgccacaaattatcacaaacttgtagcttgaagccagagttcaaaatcagtttaatagggtcgaggtatcagccgggctgtgctccctccgagggctctaggggagaaaccttccttgcctcttctagcttctttgtcttctttttttgttgttgttgagacagagtcttgctctgatgtccaggccacagtactatggcgcgatcagatcactgaagccttgaactcctgggctcaagcagtcctcctgcctcagcctcctaagtagctgggactacaggcatgcatcgctatgcctggctaatgttttctttttagagatgggtcttgctgtcttgctcaggctggccttgaactcctggcctcaagcagtcctcccactctgaactcccaaagcactgggattgcaggcatgagccactgggcctggcctcttctggtgggataccctaccttgtttccacctgagtgaccctctcctggcagagagagagctggacacactccattttagtttcttcacctgcggccccctttcaccttcctccctgaaggcatagctagtgtaaactgactcaaagcacgtccaggaatgcacctactgataagacattgaggcaagctgcaccagcagctcctggggacacgcgtggtggatggcacccaaaacccctgcatttatctctttgtgatagtttaagcctctgcacctggaactgtttactttttgtaactgcatttgtaaccaattaatttttttaactttttgccagttctgcttccgtaaaaattgcttcagctaaaatcccccctcccctatttagaccacggtataaaaacaaaactagccccttcctcggggccgagagaattttgagcgttagctgcctctcagtcgcggctaataacggactctttaatttgtctcaaagtgtggcgtttctgtataactcgcttggtcacaacactggcttctgatagcagcctgtaatccttggcttgtgggctgcttcgctccagttcctccctccatgccatgctgccttcttttctgtctcaaagcttcctctgcctcacttttaaaaggcccttgagatggcactgagggcctccctgggcaatccaggataatcaccccatctcaagggaatatctgcaaacactcctttcttttctttcctttttttggggggaaggggagacaggatctcactctgttgcctaggctggaatgcagtgcccagcatcttccatagacaatagcattcacaggtcccagggattagggcctgatatctggggcctgctacagccagcatctcagagttcacatgacaaagaagaggccccccagtcctctccaaatctgccccaccccagtcatcttggggatgaatctcccctttccactcttcccaaatgccagggccatccttgattgttctttgtctcctcctccctccacctccagtccgagcccatggtccacccctctcctctgcagcccccgtcctctctcctcacagcacagaatacggacttcacacacataagtcagacgtgccacttcccatccacccctgcttaaacctccaacagccaccaccccccattcattcattcacaatgtttattcagtgtctgtatgtgccagccattgtgtaagcgctgaagagacggatacactggcaggtaaaacagacagaaatccctgccctcatggacctcctggggtgatggacaataagcagggtaaataagtgtattggtggtcacttactgcagagtgacaggttaccccaaatgcagctgcttaaccagcaggcatgcattatctcccagtgtcagccaggcaggactctgggcctttgacacaaagtttcaggaggctgtggtcaagctgccggccgatgatgtggtctcatgggaaggctcagctggggcgtcagcttcccggttcccttgctggccatggtcatccccttagggctgcctcatgtcacacccagcaattcaagagcaattttgtcctattctagttgccagaagcaagtcattaataaagtccagcccaaggggaggggagtgcagaaaagtctaaacccaggagggtataacagggagctagctgccagaataaagcaagccaaagtgtactttctacagtgagaagtgtgaaaaatagggaaatgacaggagagagggatgtgagagctgggcagcatgctgcaatgtcagaacaacaccagggaaggtctcactaaagtgacttttgagtaaagacctgaaggaagcatgtgagtctggggaaagggtgtgccaggcagaaacagcagcatgtgcagaggcccagggggcaggagccaggactgggagtgaactgggaagcaggaggaggtgaggcaggcttgctgtgggagcactccgatatggaagcgtagcttacagacccactggccctccccacagcaccatgctgccaacctggccttcttgccgagccttgaacagaaccattatttatgtggccaggcctctgcctgggatctccctgtccctggtgggagccatcctcttcctcctgccctcatagcaaccgctgcagtttctcctggcgcttggccctgcctgagagtgtggtgtctctcctattggatcctagaagctccagggagtcagagaccttgtctgttgatcgatatccaggcctaggacaacaggcaagtaggaggagctggaggaataccatgcgcgggacagagagcgcagaagccttcttccctggagatcgctctgtactgtgac

SEQ ID NO: 851 - DNA, 1061 bp, Homo sapiens
tgggcaaggtccctgccagctctgtctctgggaccagtgggcaggggcctctgcctcacccccacgctgcctcagctggggcagcaggcccaggcctcttgcataagcgccctgtgggggacgaggctgcagctgtgcctggccaccccatcccccagcatcacgagtgttcagtgggctgtccccgggccctgggtggaggccaagcctggcccataaataggggtctcctcagtgccctccgctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagtagagctg

SEQ ID NO: 852 - protein, 190 aa, Homo sapiens
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPHWGSTYSVSVVETDYDQYALLYSQGSKGPGEDFRMATLYSRTQTPRAELKEKFTAFCKAQGFTEDTIVFLPQTDKCMTEQ

SEQ ID NO: 853 - DNA, 197775 bp, Mus musculus
  misc_feature (1)...(197775): n = A,T,C or G
gtctgtgtatatataaatacatgctatatatatatatatgtatatatatatatatgctatatagatgtctacacatctgtatacatgcatatactatctatatctaattatatacatatgttggggatataaatttgttatacattgctggggtttgaatgtaaaattccccccacccctcacatgagctcatgtgtttgaatattggtccccagttgggaaggttggggaacctttaggagggggagcctctcaggaggaagggagtcactatgggtgggccttaaagtttaacagcccagcccctctttctgcctggtctttgcttccagtctgcggatgcaacatcccttcaaaacacaagccaaaacactgatgattgtgatgctaatgatgataaggccttcatcccttagaaggcttttttgggggggagggggtagacatcttatcatgtcagcagacaaagtacctacacatatattttactaacatgaaagaaaggcccaaacagtaacaaaatcagcaattgtgctcataaaatacagcagtttgttctccctgtaccttttgtacgtatttgctaactctacccagagctatagtctcaaagtgagtgctgactaacatttttatctttcccaaagagtaaaacagaagtaataaataaataaataaataataaataaggatgcatccctgaattttgttctttctttaataatacaagcaacttcgtattgatattaaatgatgggttttaaatattttctcaattttttttgatgctagtcacaaaataattggaaacagatttgagcattcttacttttatgtttaatttgctgattagtcaaggatctccaggggaagaggaccaaaaaagtgtgtgtgtgtgtgtgtgtgtgtgtgtgtgtgtgtgtgtgtgtgtgtgtgtgagagagagagagagagagagagagagagagacagagagagacagagagacagagacagagagacagagacagacacagagacacagagacacacagagagggagaaagagacagagacacagagagagggagagaaagagacacagagagagaactgttgtgttataaagcatctacgtatgtgacatatagtggacaataacagacactaagaaggcatgaagccattgttttgggttcacatcgaaggtctaagaaaaccaaattcctagctctagttgagtaagagtgctctccttccttaacctgtctgtgctaatcatggtttcaactactcttccttccacattaggagacacagtccatttcctgagtaaaatgtgaaccccattcagtgacttccttccaaacacacccaagataatgtttcaccataaatgtgctcaccccatgacccagtcaacacctcaaattatctatcataatctaccaaattgcctctgtccttaacctgctgagttaagtgttctcttactgggacagatgcttgaagggagcttgaagggaggacgatttattagagttcacagttttgcaggtctcagttcagggtcacaaagttcctgtcactttgggcctgaagggaaggcaaaggtcttagcaaacagccggcctgtggtggagcaaagagtctcacatcctggctacaggaaacacagagacggagaccaagaatagctaaggactagcatacctttaaaggcaagcactcagttgcttcgctctcagactggtctctatttcctaagtctctacaaccacgcagcaagagattaaagaatgagtctatgaattaacctatggacggagttaaaacccagtcacttcccccaagtgccaccagcaggcaagcaagtttgcctataagggatagtttagagtaaaagcatagctctctcttaaattaacctgtcaataaggaataagttacattctgatttttaatctttttttttcaagagggtttctctgtgtagccctagctgtcttggaactcactctctagaccaggctggcctcgaactcagaaatcctcctgcctctgcatcccaagtgctgggattaaaggcgtgtgccaccactccccagcctgatttatactctttattgaattctgtagtataaatgctgccattctttctcatttcaaagtaccattgtcttgccagtgggtgcagaagaaatataccgaagtaaggatgtcatcactgagcattggaacagaaaaatatgagggatagttcatctcaagaatatagacaattggggctggagagatggctcagcagttaagagcactgactgctcttctggaggtcctgagttcaaatcccagcaaccatgtggtaccatctgtaatgagatcagatgccctcttctgcggtgtctgaagacagttacagtgtacttacatataataaataagtaaatcttaaaaaaatatataggcaattgtgaagtacagtaagacagaatgcagcagggtttgattatgtttcattatctactaatataacttagttaactgtgagattaatgtaagttaatgtttaatagtagatgtgtctaatagcctgcttgcaaaatttccccaaaatcaaccctggggtcctggtgggaattggtgttaggacaccattaaggtggtgttgcccggttaaggagttggctcaatgggtgaagtgctaggcatgcaagcagaagccttgagtcctgggcctcaaaatcccagcatctacacaaatgccaggcaggcacggcagtaattccagaactctggaggaaaagataggggatggaggaggagggatgtagggcggggcggggatgataaactgccaagctagaatagctggaattggctaggttcagcaggagaccctgaatcaataaataaagagaaaaatgacagaggaagacacccagtgtgaccatggactttcatatacacatgcacacacacacacacacacacacacacacatgaacatatacacaagcacacatatacacaccatacacccatacacacaaaacaataaagtaatatatttttctaatttaaagaacacattgggcaactctctgaagactcatctagtttagatttactctgtggaagcttacccagttttatcttgatccaaagtcattgacaaagaggattggaacaacctctgggctattcttgtccaaggccttgaatctcttcctgcccttagagatgagccacatttacatatgttagcctccccccccccccaaaaaaaaggccttagctttgtcaatctgtggcactttaaatgtgggtgggtacgggcactcccatgggtttggttgacaacccaacatagagaaacgcacatagatgcccagtctagataattgtaccacaattatctgagagacttcagaaatcggaattaggctttacttctgacacataattatagcaatggactcagagacagagaaaacacgttaaggattattccttgactttcagtgtggtgattcatcagccaaatccacatcagccaaacgtaagaagttgctgaacgcttatcaaatgaattcaagttgtaagtcaccaagttcaaggaactgttgatgtctatttgaaaccacacagaggaaatttctataggcactgtcatcctcaccccaaatagagccaagacttggtgtgtgtgtatgtgtgtgtgtgcgtgcgcgtgtgcatgtgcgtgtatgtgtgtgtgaatgtgtgtgtaagtgtgtacttgatgtgtgtgtaagtatatgctcgctgtgtgtgagagtgtgtgtgtacgctcggtgtgtgcaagtgtgtgagtgtttttaagtgtgtgagtgtgtatatgtggtgtgtgtgtaagtgagcaagtgagtatggggtgtgtgcatgctagctgtatgtgtaagtgtatatatgtgtgtgtgctctgtgtgtgcatgtgagtgtgtggtgtatttgagtgtgtgtggtgtgtttgctctgtatgtggactgtgtgtgtgctttgtgtgtgtgcgcgcgcgcgtatatatgtatgctctgtgtgtgtaagtgggtgatcaatgtgtatgtgaatgtgtgtggtgtgtatgtgtggtgtatggatggaaagacggcaagatttttgatagcttcataggcctgggatttctttttttttttttaagatttattttatttatatgagtacactgtagctgtcttcagacactccagaagagggtatcagactccattaccgatggttgtgagccaccatgtggttgctgggaattgaactcaggacctttggaagagcagtcagtgctcttaactgctgagccatctctccagcccgacttctgttttttataagctaaaataattgtcctggattaaaaaaaatatataactcttactaaggtcagttgtaagctcatgccattaataccatcacatggaaggcagaggcaggccaatctctgaagttccaggtcaaccagggccagctgggtcacaaatgaatctcaagagccggatggggggcgtgttgtgagttactaccatcctttctaacagcaagacatgccagaataaaaggagattgagagtcagtatgttttatacaacatttttaaaaagaagtttggcgtttgtatgctatgtaagtcataaacatcagagacatttaaaggttagttaaaattaagtggttttggtgattgaggtaagttaggactcaaaattaatttgcaaacattagaaaaaaacaaaacaggttcgacattgatcctaggaatggaaatgatttgctcgctgaaaatatgcgactcatccgaggtaagaaggggccttggggctttccctgtccacaaagaccatcatgcgacctttgcgcaaggatgcctttctccaagtttcccacgtcattcctgcatcccattcgaaatccatttagaaaagtctccacagcctggttcagggctggtatcccacgcccaccccagccctgaagaccgctgctgcagccaggaatcccacatttaaggtgtagctcaacctttgaccactagaggtctccgggaaagcactgacccgtataaccctgtttatcatcctaactgtagacttgttgcacagcccggcgagcccgctctgctggaggctgccttctgacggttgccaaccagccctggctcgccgtggcgccagcctagcagggggatgggccaggcggtggctgaccatcacaccgggctgacttttaaagtcacgactcagtccacactgtctaggggttacctctggatccccacttcttggctaatcaagtgaggggagaaccccaggtgggcagctggaacccctctgactggtcaccctgcccaacactagccaaggtctgggctttctgagtgacctggcatcagcaggccgagatccacctccctgttttgccccgctccccacccctttcccagtgctccccacactcctctttcgcccaccccctgccctgtggaaggtcattggggttccattcaccgcccctgttttcatcagcgtgggaggtttctaaaaaatagtgtcgtctagctgtaagagagagagagcgcgagaagaaaaaaaaaatggaggaggtgggggcgcggagggggagccagaaaggaaatagccaggttgagttcccagtttttatcaagcaattcgctcaccaatgaaagcaagctgcagtggcagatttgagccacacgcggtagtgtgtagcaattagtagataaaatgctgactaaagtgctaaaacatgaagtattattgtagccaaggtcaaaaaatgcttcagttgccttttgcaattttttggtgggggggggggaagaggggaggggaggccctgaggtgagtggagagatgggaggtttagaaatggacgccttctttcttcaaactgtactttttttttatgatcctgtttattatagcccgagctgcctaattatgtcactgctgggttttgcagctaacttaatcctcctgatcctttatggaacgattcacacacaccgaataatgtgtctccccccaccccacccccaagccccttgaggcccagggtgtgtgtgtgtgtgtgtgtgtgtgtgtgtgtatactaatttttaaaccttttaaatatattaggtaacagttcaattgggagctcataaggcagcaggaatatacatgtgtgggtggaggttactgagtttcagtacaagggaaaaaaagaaatattggttcgtgtaaacatacactgctctaccctcctcctcctcttctcagacccagtcagtccccactacaagcctttttatagataaatagagcagttgctttcatgattataactgtcttgaatggattgtcttcttacagcattcaatctgtttatgagtatttactttacattagcccagggaccctgcgctgctggagtttgcctctattcccctgggtgtcggtgtctcaagtcttacatctgctctgtgattgatggagcctgaatccacgttattactctctcacaagcagaaatcaaacaggctattaactacattacttcaaagaactgtttcaatacaatctccttatcttaattgaaactttctttgtatggatagttgctacacagataatttacaggtgtctatcaaacatcacattaaagaggtaagaacagatttttttgaggtggggggggcactaacacagtgatctgtgattttaaaggcctttctcagtatcggataggccattgatttagtagatttatgatgttcatgggagtggggttcgaggtactggaggaagagggggagaaatccagtttgaaggtttagcagggatctgattataaaaatgcaaatattcagaaatattcagagctgggtttggaagaccttatcaggggagattaaagcagcgcagcctagtgtagtgcctaccttcaagagacatagaagaagggttctaattaggtgaagtcatttacagacacttaaagactacccaagttgctcaaatgctgtggaaagctgtgtgttttttaagagaggtttaatacacaatccagggatgccctcaggcactgtgtcgaggtttcctgcataaatgcagccgccttggtcaggcaggaaactgactcatagatgatctcaaagaaaaatcttgtcaaaatacagcaactcaagtttttttaatatatcatcttttgaattgaatgtatatatttacactaacaggacagaggctaccagaagcccgaggcagctcatgaatattttttaaatatgtaaaatgcccttcagtcaaatccattcatatgttaaaaatgaacaaaatgggttattctaatcaaacgtctgcagcgtgcaccataaagttaaaaagagagggtgaaagggctgtaatttctctctctaacccatgtttatgaaatggtaagatcagatgaaatttcaaggaagataattaaggagtgatgtgcaggtcataatttggctaatgcaaaagatggaagactgtaaattggtacactgtcctcccccacggtgcagagttggaatattactttaaattattaaaatagcttttcgacagcttccagaatacgggctttttggcatgggcttttattacttattgtaattggaggatctgccattttctttcgtttatctctgtgtatatagaaacaagatacatcttgccttttttatgacttctccatgttctgaatcaaaaaaatgtgttttagataatgttaagcgccctaattcttactgcagcggaggcagacgttatggaaaaaaagcgtcaaaacacacacagagggtccttccaccgccagatcaccgaagatgaggcgtttgtgctctgctgggtgtattaacttcagccatgtgaatataattttcattaaagtaatcctgtctcaactcgatgctgcgggtagaggtgaaacgttgcgaaagcgttaaaaatagcttgctagtaatttcaacatcctgtaattttatcgcggatcgagtttcaactgtcgtactatacaaaccttatcccccatatagtacatgtttacttttttagcctgccagacccactctggaaagattggtgccaatataataaaatcgctggggggttggggaggggtgctggaaagagtgggaggagagccgggaaggggtggaggaagcgagtacaccattttacatcaacgctgcgaaaatgcaagcgagccaggcggaggaccggcagctgggtcgcagcgagcgagggttttgcagtccctgcctgttccttgttctgtggctcttaagtttctctgtttgcataatagccgtgcatgcaaaccgcgcaatgctccagggctccagaacaataaatatacacatttaaaacctttattgtcttatgttgtgttaaccaccccccacctccgtttccaacagcttaatttctgatggtatttaactagtttgcaaatggattatttttttttcagtttcaaactattaccgagaaagctccccctcccttttgggaggaggggggcacgggaaggattgggggtggggtagaagtcggtatattattcctgtagcgccgggttatataaacacattatcatttgagagagcccttggcgtccatcagcattgtaaacacgtacgagtgtatatacttcaaaattaaagaatgcacacgcagaacccagagcccgaattcatattccgagcagactcgcggctcgcatgtattgatttatcatgcatggtttattgttcctctccctaaatgtagttgctgtccgttcaatattgttgcaaaatcacgagacgtgtgtgtactgctcacttgtctttctgctcttcttcttccttttttccccctgctgagtatttttttttgcgaagcgaacaaatgcattaatatttatatgtttatataatcgataacccacttttcccttccgtgtaaataggcatcagaagataatttaacagattagttctctcaaacatggcagtgaggaaacgtaatttaactatcaaacaaatctacatgtctaataacagcaaatctgctaaggagcattagaaagaggagcggcgccccggaatctctgcaggaaatgttctttatattagacatatacaagcaggtcctgtcagatgcacaacgcagctcgagagacttggtctgctccaaaaatctcagccgacgttacccacagacacgaggaactgagaagagaaagataccctcattacttggttttaggatgggtttcaaatttttttacatcttcctgtctgctttttgccttgatccattctcttcccgccgaggtcgaacttagcccttctccctatttcgaatttgatcaacccatctttggcagcaaacccacatcttttttacaggaaatgaaaattgagtcttcgaggaaatattaggatatattttcaatcattttggtgctgagggggaggctagagccttagtttttatattgagacatcacgccggnnnnnnnnnnnnnnnnnnnnccccctcacaccccccacaaactttttaccaaacttttaccctctgcatccccccaaaatcatttttattgtttttttaaaaatccctgcgctgatcatacctacataatgtaattttatcgcctcatatggggaactggggaggggtggtggggacccggagggcttttttttcttttcttttctttctttctttcttttcttttctttttctttcttttttttttttaagggaggcagaaaattagtgggttttgtaatattttttcacccagcattctatctgtgggccggtctgtattgagagtcttgtgtgttaatgtgcctgggaatagatatttgtgcttgatggctacattatttacgtggtgcttttttttctctccctctctctccctctctctccccctcctgcagtgggtcggctcaccgtgtggcttgcacggaccttatattttttataaggcttttcaattccaccttgaaggcaaaccaagaatcttgtcccttggcgactttttctttgtaagatgtacgccaaaggatccgatttgcatagcggagctccagctgttgtgggaagaaaggaccagccggcaacttttatccagctcgaaactttatttcctccccgaagacactccccagggcagaaatagcgaccatggcgaggtggtaaacctatctctccctctcttccttctttattatctacccccccccctccagtaatgcgtattataaggcaagcttgaaaatactgtattcagttctgcggtgagcaggatccgctcgttttttaaaggggtagcgccactaactggggctggagtattttaccattgtcagagtttggctgtcagctttacaaagaccgtccaactgctgattttagtcaagatcaaataacttgtcgagaagggttttgttccagggtgtgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacattcaaataacttgcgcatctgcccgggcggtatttcaaagcggtcgtgtaaccggcacaaacacgttcggcattaagaactatctcgcgcccactccccctcctcccggagccatttgatgttctggtttccagtgactccacgcgaagtggacgtcttccagtagggtgtggggctgggtgcaggggcctctgcggtgaggtgcgagtctgtgcgcgggatggacgcggagaggaccctgcggcgccgccacccggccacctccctcgggctctgtcactgcgggtgtgaccgcacctctatgggctccccgggtccgagggccgagcttggtggagtgatcgttacccccctacacacacacactcacacacacacacacacacacacacgggaactattttggggagtctgcgcccagggcgcggtgggagggagggcgcacggccccctggccaggctttgtgtctcccgagacagagcagggtgatcagactgagacttttgagggcagctagctcggcgccaggctcgcgagctttcgaggtaggtctgttgttaaatgaatggttcggtgctgaactcctccggggccctggagctgccagcccaggcagaaattcctggagctgatggagttgattgcacttttggccttgctagctcactccctctcccccgggatcgaattacccctcagtggtccgcggctggttaattaagggagttcttcagaacctcggcccaggaatctgccttttcggaaataagctccgccctcctcccggcacacacccctcccccgccctccccgaaaagcctagggtgtaagcattcggctttccgggctccgcctgcagcctgactaaggtggtgtgtggatgcagagtgggacccctgcagcccaccaacaggttgagcgccttccttcccccaccccactgggctcaagcccctcccccgacccaactttgctgcgcagctgtcttccttctctccctcccccttcctgatttcttattatttgcttttcaaatttattacttcaacatggcctgtgatctggagaagggaaggattaaatatccagaaaagagctggtgcctaacagacttcggactaaacccaggaggaaatcattcagtgttttatgggatatttgtggtcactcttttttttttttaattgaaattggaatatttgtttaaaagaccccgagttgaccccactaggtcctctttaatttctgttgatgtaactaaacggcaaattctgatttaagaataaaatccacagacgatcccatctgtctgtcagaactgttgacaatgaatagatacgttttttaaacacacgatctctttttaattgttccttatggggagttgtaatgatctaggcatttcgtatctactgtatgagccatacctcagaaaattaatcttgccatttaaaagtaaactctagggggtttgtggagagagggcggctctatttataatcctcagctgcttatacatagtctaatattatgcatgatttgttttttaatgctaacacggctggtaattagctgtatgattatacttgtatatttcattaggacttcggctgatgtcattgtgagttattcagccatattaaaacaattttcaattgagataatgacacgcctcaaaattatgcaaatggaagctgcattgtgcaaaataattatgacaaatggaaagcaggtagaaagtttcccggtgcaggatcggttttccacccgggtgatgtcatttcccccctggcctaagtcagacgttagcagaacagcagcagccaggctcctggggaggagagtcacagaccagcatttactgcaggcgccttgagggggcaacagggcctctcattaagaaatttgctttgttttcgcctactcgattaacttgtttatatacattgaaatggtttttattattgattttaaatagttttgagggatgcctttgccgttgctaaatgcaggggaatgttttcttggtgttcaagaacatttcatcagccagcagagtttattttaagtaaccaaatggaggttaataatttcctgattgagctgacatcggcacctatctgggaaggacgaccaggattctgggtactctctattgaaaagagacgttctgcctttttctgatttcttgaaatgggaagacgtcagttctaaaagcaggaacatgatcattgtgcgagtttagaaatagcgtccctgtgtggttcgctgtgatttgcagcagatttttttttttttaattccacatggatctttgcagtcaatgcaggagactgggtggtacaggattgtgcctacccattttatagatggggacaagaacatgccaaagtcatgttgcctgtcaagtgtggccagtgtcacccagtccttcctaaactttcagcttgcctccttcagtaaaaatctattactgaaacatgaaaacacatcatagtagattctagaagcatgcaccattaaaggcagtcccttgatcattttcaaacgaggctactcaatcagctcccaaaggagatattcagggttagaagattttattctatgtagttcaaataatcctaactgaagctatagagcaaaaatattttcatagttattaataattagctatcgattggtttccagggtgatggtgacatcagacattgccagtgctggtaacctgaagtgaggaaaggcacttgcaaaagaggtacactggaggctgaggtggctcagtggatgaagcatctactgggcaagcataaggaacagagttcaaatcctcggagcctcataaactggaagcaggaaccctagcttgagatagtacgcagcagtgaacagcaccttagacaaggtagatgttaagaactaacccttgaggttgtctcttggtttccacaagcatgctgtggtacactagtatgccatacatccaaatgcacctctctctctctctctctctctctctctctctctctccctctccctctcacactcacacacatggggggggagaaagagagaaagtgagaaagagagagagaagaggcacatttctattctacaacttagcctcagtttgaccttagataactgtaagaatctgagcctcagtttcttctcccagaaaatgggaataatactaagaactgaaaaatttgggggaaaatcaagacacattataataggggaaagcgctttagatattttaaaattcttaaaatgagaaggactcagggtaagaatattatgaacttttttaaaattttataaacaatggcaaatcatagtaacatttatgtggatttcgttggatctaatgatgatcctgtcttaagtcagcatgggaggaaagagcaagacacgggcaaggaggtagtgtccatggtaaccacccttgattggcacatgtgagcagtagctcttcagggaaggacatgtcaatgtaggtgggtaactggtcctgttactgggtaacctctaatcatgcttattctcaaactgctgagtacttaatctattggcggttggctttccaaatgcatgcatgtgcaggcttgggtttttacatgaaggtttgttgatggcctggaactaggaatggggaaggttaagctaatgatgtcattgagtcaagaccaagcacgcctgggtgttttagactccagcttgctttcaggatttctaacagtctatagttgtcatcatccaggatacactgaaagtcgtggtccatttagaaactgcttcagagatgctctactgagagccgcatagcacagttggagttggagccaagactttgaagactttcaacagtctcgctcgaatgatataatcgtggagaatttctcaagcattctgtgtctcgctatttttatccatatatgggcatgtggtatcgacttcctgggattgttttatggactaaatgagctactatatggtggaaaggtactcagtggatagataaatagtgattgtctgtaatcgttaccatgaatattggtatgtgcttttctcattggaatttgagtcctcctggcaactcctgggttactttgctacaaatccctccctggtggttctggttccttccactggggctgttttttctacgtgtgttgagctcagctgtgtcatcacaacagaatatttcttaagaatttttattttgctactgaaaaatgttactgactggactggcaacatttttcaaaggattacctgatttgatcatacctggggcaggcagatgtgttctggaatctagatggtctgccttgggctgtctttgtttttgcaaagcccttaaggtgaatgtagagatctctgagtctccttgacttaccttgctgtccttaaatggtgctctgccttgcccaagactcaattttttcatttgtataatggaattgctgatcttgaatctactgaggaaatcagagatgatgattaaaaaaaaaaaaaaaaaaaaaagccggggcatggtggcgcacgcctttaatcccagcacttgggaggcagaggcaggcagatttctgagttcgaggccagcctggtctacagagtgagttccaggacagccaggactacacagagaaaccctctcaaaaaaacaaaacaaaacaaaaccaaaaaccaaaaaccaaaaacaaaaacaaaaacaaaaacaaaaacaaagaggggaccaaccagcacaggacttaggaaaactcagtctctgctggtagtgactattttcatctagaatcaggacccatgggaacttaaccaccaatggctgtagttactctgcctactgtctattcctagtcattcatttttttttttaaactaaatgaagggacatctctaaccatgtacagaacaagaactaaagtgttgcgcagagaccactcaactggtctgtgctaagggtcggctagctaaaacttgaaggctgaatatggcccactgatagtttataaataaagttttattgggacgtagccaaagtcatttatttatatagtatttgaaactctttgattagaacaacacagctaatacttttgatggttaccatatgattgacacagtagatatatttgttgtctggcctgattatttatggaaaaagtctgttgacctctggcccataaggttgatgtagaagatggaatatttctattcttcagttcctcggtgttgggaatcgagctcaagaagttacacttgtttagcagatgctcttcctatgagctatttccccagatcctagtcctctttcctacttggctccaaacaagatgtcatattatagacataattaatatcagtataatgtccttatcacttacaggcatgcacatgtattaatgttgagtctaggacattcatttttatgaataaataaaatttacattgaagtatattttgaatggctgagatccaagctccaggcaatataggtattgtctggattgtgttcatcaaagacaacctacttgttgagggttaaccttgtaggcggtaaagagatgactggaaagcacttggcaggctggccctttttctccagaagctgaccaatctttttttttttttttttggttttttgagacagggtttctctgtgtagtcctggctgtcctggaactcactctgtagaccaggctggcctcgaactcagaaattcacctgcctctgcctcccaagtgctgggactaaaggcgtgcaccaccacgccctgcgaagctgaccaatcttaataaaaagacaaggtcaatatgctcaacgatgtacacacagtcacaattggagatgtgtatcctatcacatgagtaaacttgaaaacctgtcatctatgtgtcctagtgtgtactgagcccttaaacacagtggaggtgaaagggaaacgcccctttcggggacctcacagactatcccaccctgactgacagatactggtcaacaaaatatcatcagattttccagctgcgaatgagctaagatctctctggatgtttcatgacctttctagaaaagtagaaaacaaggtcttcatcttcagagtcttatttgcccgacacacatttccagagtacctactgtgtgctagagctgcatacccatttatatagaacacccactgtgtgctgacggcatgaatccccatctcaggagcctgtgagttagtggtgctttgcatcttactttagctaggcccatctcagggttctctccttttgcaccgtaatctagtttagcaggagtctcctcttccttgaagttcactgagttcagaacaactgagcatcatatcaaaacattacgggggtgctgaaaagatatctcagtcatttcagatcgtatgtttatcttacaaaaactgagccacctgtaactccaaaccaggagctctgtaaccctcttctggcccccaagagcaccacacactcactcactcgtatttgcatatataaacacacacagacacctaatttaaacttcagaaaaaatatttttgacataccttttggaaggctggagaaatggtttagccgttcagagtgcttactcttcttgcagctagcctgggtttgattcccagcacccaagtcagatggctcaccaactgtatgtgactcccgctgtcagggatctgataccctcttctaacctcggtgggctcctgcacacatgtgatgtccatgcactcacacacacacacacacacacacacacacacacacacacaccaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggttggtcctaatttgttaggttacctcagaaccccatctcacactttcttctttgctactaaaacccatatcaccccaatggatgccaaaatacatgaacggatgtttgtccaaagaaaaaagccaatgatttagactgagggttcagcctggagccgccatgatggtctatccgggtacctttttgatctgcaacactcagcttgttgaaattagggactttgtagtgacaaactgaaacctagacttctggagagaagaagagtcaagccgcaactcagtcatgttggcagttcacaaaagatagcactcttctcagacggatgaccttaaccaaggtttaatagtgactccgtactgaaggcaattaaaacctctcttgacatttaaacggtcaggcccatactcaggaaatgttattttttatgaagtacaagagtccacgcatgtaaatacttggttattaattattaataaagcatgccgttgctcatagtggcatctggtaacacacaactcgggctcatttatcaaagtctcgttttacccgatatccagcatataattgcttgaatcaaatgcattcgcttgtcattttttatagcagggcagttggatatttgccatcctctactcagaataatattgtaactaatgattccttggtggttctgcttttaagggtatttaaaacaaatttatcgattgctgcctcggagactctttcgcctctaagagatgtggtcatggatcctttgtttctggaagaatctgtcccctagtactgtggactttttgagggtgtagtgtaatcctcactgtgtttccatagatcagaacctaggccttggcccttagagcatgtccatgcaagtccgggacagtgagcatcacactaatgtttcaaaatctgtgagtttggggggggatggctcagtgggtaacagagaacctgagagttaagatacccagcatttatccgggtaaaaggcatgcctgtcatcccagtgccaggacaggaagacccgtgtgtccctgggctttattgagtagttactccaacaaattgatgagctctgggctcagtagaagaccccatctcaaacagtagaggatgattgggaagggcatctgaattcaacatctggcctacacactcacgcgtacacacacacacacacacacacacaaacactcatatggagaagtgcaaacgcccacatgcacacgtgtatatacgccatataaacccactgaaaaccaggcagatagccattattgaaaagagggcgctgacgtcagaccaatgggatccagctcacagccgacctgtatccatccacagccggaaggatggagacttgacactctagactagcatggtagtttgacagtgtgaattttctatagactctttgcgactgtataggtaccgtagcctagattctcatgcacaggataatcatgttcacagaaagcagacagcagaggccacgtgttgctagcccggccgttgaccctcccccatcttccttcctcatgactcaggcataccgggcctgaaaagccaccaatcctctactgttcaattccaaagccttggcttggcttaaacattaaactcttgcctttgcgaattaggctttgctttccacagcctcaagcatgttgagctactgtgcaagctggaaaataaaaatgttctaattgtgtcttttaaataagcataggagtgaattaattacaccatattttgtctttagttgcttagttacacaatagcatattcctgagcaccgggaaagataaattggctctttctgtgctgtgtgtcccttaatcataattactgtattgcttcagagagtgaagcacacatagatttttgcattttttattaatagtccgaaatatgcatatgatctataaagtatatgctgctcaacctgttttatatgcttttatgtaggaagaagttttattgtggttggtagcatttgcattagttgctccaagatgtagttctgggaaatacataattgaaatgtttttgaattgctttttctggccttttcaatcttattcaaaataatatgcctctggtctcggagcagtctctctcatttgatttagcatcttgctttgcactgcatgcagggtgctgttttaacccctgcagagcctagatgaggtgctgtgatttccctgggtgtcatcatgtcttgggggagcagggctcacactgtaagcgtttctggggatgaaagggtttgatgggtaccctaggctaccatggcctgctcttggtgtacttcctgatttttcatttgggtgttttagggcttgaacaagcctgaactggacaaccttgtgtgctaggcttctggggtccagtagaataccgtgctgctgttcctggaacttgggtttctatccccaccacccctaacctcctccaagaaagacagcaagaaggaggcagcttaatacagttattgaacaatggctgagcctggcttaagatccagatacaggcttggtaaatgtatgtgaaaactgaccccattgttctattgtgtttgaaaagcaagtaaattatttacagatatttgctaattaaagcacatttaaccaggacaaaaggacacagactaactggagacaaagagctgagtgcaaatatttcagtctcactaattctgtgtattcttaagggagaaatgtatgtgtgtatgtgtatatacaaaaatatatacacattatatttatatatacatatatttttatatatacatatagatatgagtgtgtgtataatatttataattttattttacatttatttctttattttgtgagcgatgacaagtggctgtcacaaggggcacctggtgcaggtcagaggtcaactttcaggagtcaattttccccttccaccacgtgggtcctgaggattcaactcaggctggcaggcttggtagcaagtgtctggactcgccaactcatcttgctggcctgagaaatgtgtcctaaaactgtgtttatagagggcagggacaacagagtgtgtgtcaatgataagagagtagaagtctttcagagttctcacaggccccaagtagagattctgggaggtggcagatggcaatcaatgttttgtatggtatgtacgcatgcatcaaattgttaccatctaaaccttaaatacagaattttatgtgctaaccacaacttaatgaatctagagacattaaccgtgaaatatatgtacgtaacatatatttataacatatgtactgatacatgcctatgtaagtgtgggtacatatgtatggcttccgggactctatggggaaggcttttgcgctgcagaggtgattggccaagtccctgtcctattacttgtcagttgggttcactgtaatcttcctaaggaatgtcagatacaagaggttttgatagaatcctgagttctctttggtccaactttgacttgttcactggctgcgactcagctcagggaaccatttgggagaaaaacaatttagctgtattctgtaggagaaaaatgagtgtccttgtactttccaaaatgcttttgatctggcttcaatcttgctgttttgataagatggcttcctaactttggtcaagtccaggttggacctttctgttgtgtctacaaaggtcagaccaatggaagcagtgcatagaaagtgaaagataaggttctctctgacttgccctgcttaaaaagatagatggctgtccattggtcaggcagattctctggctctcctaccatcaagagacatttttgggtttagacatgactagtccctggtctcttggcattgctgcttgccagggttccttaagacaaaggctcttgtctaattaccctggacattttgatagaatctcaggtagcaggaactctgagacagggagtcaagtttcctctacattgttaccactgaaatcaaagttgcaacatttcccacagtttaaccattgtgtggctgcaacttggtatttatctgtcaatcatacacagtgcggctcatttaattatccgggattctttaaggtttggggtattttgatactatttcactactaataaaattggtgtagtgggggctaagacaggtgaagtataatgcccaagttcacatagaggtgagacttagaccaaaggctgaaccctagggaaacctaggaagtagggaaacctgattcttccaaagatgaaggctaagcagttttattattttgatgtgaatccctataattttaggatatactaacaaactccaaatattggggtctttactaagcactgacttggtatttatttgaacctctagaaatctgtagttatgttgttgaccgattagtaccaattcaagtctatggtaatgtcacatgctctataagggaatttcaaagttccttagacccccacctggagtccagtgtcacaggagaggagtctcagcctcaggacctccaggttgtcttctgaatgttgtctagctaccacacaccccacatgggagcatacaggcatctagagaggacacacacagttcatcaaactaccccaagtcctgtgccatggtcagagtaatggaagaaaaatagagactcctgtgacatgggtgactgtccatcttggaaaggcctgccaagacactgtgggagaagtcacttctgaactgaagtctaatgagatttcaatgggaagcctaagatgtttcttcacaaggcgaggcaaaaacaacattcctggaggatgatgggaaaggacatggcctcatgagtctagtgacccagttgtcaatacagcagatgccacgtggggacatatatgcctaatccagactcttatcaaacatcattttgatgactacattgcctggctccggcggttaaggaaacctgaagcccacatatcaaaatgtgtccccttgccgccttcttcttcttcttcttcttcttcttcttcttcttcttcttcttcttcttcttcttcttcttcttcttcttcttcttcttcataaataaagttttattcgtactctaacatcccatgatgtttaaaaaagtcactttacagtgttcacactacagcggccgagaacttatgacagagattcactgagattaaaatacttggtgcctgaacctttatggaaaaatgcttgccaaatcctggtctaaaatactgttgtctgcgttcatcttaaaactgcgctgacggctttagatgctagtttttgtatatgtcccgcaacagcaagtctctgaagaatgctttcctgtcctctcccatttggcaaaaggataatttgagcacctgtcttcaggtttctaaggtcatccatcaggaaaatgacaaggactgaatgggaacttgaattttcctgactccagggtactgatgatggtctagactccttgatctgctctggttatgagcagagaaatggcggtattagagaggaatgtgctaaggacagagacggcccacaaacagcttccatctttccattttttcacccaaaagccacttcctccaagaagctttccctggctgtccagaggaaagggacccgtgtggagcacacacaggccagtgcagaaaccaaccatggaagctagacacatctaaggaacaatatgatattcagtggagagctggaactctaaggctaacttgctgtttggctctaaaccattgctcctcaggccctacctatcatagccaggaaggagtcgtctcaattttatgaaatcttcaattttgtatgaaaggctagaactctgcatgatgttcattggccattcaatctactttttgacatgctctgtgagccaagcaaaacatgacctttagcctagctgtgacccatggactgccaccctgcagtgtctagacctttaaattatgttgtcatatttggttcattttctgtaattaaaccagaaggaacctgctggtttaaagggggaagcaggaaattgggggtgggaggatgggtgtgagttgagcattcacctagatccaaaaccattctttgtagccgcctttcagcatccagagcaaagacagggatactacggactgtacaaagggagtctgactttccccctcgcacctactccaaggtcacaggaagggtgcgttgattgcggtgtgaagaggaagctgggtaaatgagctgtcggtggttggatatcctgaaggcatcagggaacaaggaggctggtgattgaagaacctctgaaaacactaggttgtctttggtgggtagagatttgtgataggcactgtgaaaaggagaagttgaggcagaaggaaagccacaggcgagaaacagcatgacattgctgggcgtgtgttacatttggtctaaggacttcagtctaatgggtagacttaaaaccgggtagactgagtttcccaacatgtcactggggcttaaatctgaagccagtgctgattaataattccacaaatgtgttttcttctttgaggttaaaatacaaaccggcagtgtgggctcccggtaaggcagtgaatatttactctgtcggtcactcactgggctgtcctggccagctggccccatgtctttggcatctgagtttcttcactgaattgggtgaacggaactttatttttatatcaaataaaatccacaagggggtcagaaccaaattaggacctggcttatcctgagcttgtggttgatatttggcatcgtacgctctgctcttcctggtcctaatcctagctttttgaagtctgccacagtgttagacaacctgttagtggccccttaataagtaatttattggtttgagtcaccgggctattgtttgaaaaacaataaccaagaaactcatgacttgaaataggctaagcttcctggggtttcacctgtcccaagagacatgacaagtgaggttcaaaggttttgatctgtgtttgagatttctggaccctgaaacagacacgcttagatccattctcttctggccacttgaggcattaaaggagctgttagaggacatctctggatcagctgtaacaaaatccaatgattccagaagatgatggagtcgcaggacaccactggtgtcccagagcttccttctcagtgtgtcaaaggtcatacctgcagctttccatgtaccggctgctactccatcacatgatgcaaacctagtgtctcctgagtgtgtaacaggcgtttatttttaaatatttccactttccctctactcaaaacaagtctctgcaaattgctgatctttgtttgaaattttgttcggttccttgcctgcctcttcctcctttttttcctttccttctcgcttattgtttaaatttctgttttcagccgggcgtggtggcgcacgcctttaatcccagcactcgggaggcagaggcaggcggatttctgagttcgaggccagcctggtctacagagtgagttccaggacagccagggctacacagagaaaccctgtctcgaaaaacaaaaacaaaaacaaacaaaaaaaccccaaaacaacaacaaaatttctctgtttttctgcttctctttctcccctgcctctttctcctttctcttcttccatctcttcttcctcttcttcctctcttctttcttcctcttctttcttattcttctcttccttctcctcttcctccatctcttttttggtagtaatgggtaaaaaggctgtacccctgtccaacccttccaaagatgcaaactaagggtaaggatgtatgccagccagaatgtcctgggtgcaccttaggggaaggagtctccaaaacagcagatctcagcctgggagtcttgacccctttggaggtcacatgaccctttctcagggatcgcccaagaccatcagggaaacacagatatttacattacaattcataacagaagcagaattacagttaagaagtagcaatgagagacattgtgcggttgaaggtcaccatgacatggggaactgtactaaagggtgtctgccttaggaaggttgagaaccactgttctaaatagagactgcctgccagctgggacattaggtccttttgctttgggctaatcccacagtgtgtatcaggttactagaattcagttggaaacgctgttgtggtactccttgtcaaattattccaaaataatatgggtcagaaataccaaaaggtcatcgtcagttttcctgtgccttaagtgagactctctgtttcctttctgtctcgagcgaatattcaccataggagttgggttgtgtttgtgctcctaaaagttgatatgccatcaacaataatgtattgggttgtaaaatatctatcctggactctaggggcaagcaaaaagaaggttctggtaagaggagctgaatatgtttttctaatacaaattttatgagttacataaatggtgatattttttaaagtttatcagtgggctctgtttcctgttttgttacagtatacattctgttccttcacattttcggatgttactaaatcagtaatttaatagccaaacaggtatttaaagtactcctaaccccagaatcccttaaagaacctctccgattggcagagtgaaaaatatgcccaccatgccagaatatgaagatgcctgtgttgccttaattaatcgatttatttgtgtgtgtgtgtgtgtgtgtgtgtgtgtgtgtgtgtgtgtgtgtgtgtgtgtagtgggtggttcctctccctctccctctttctcttttagaaaaaaagagcatccttatctagattttggccagagatcttgcagggttttgtgctcatggccttatagatctcatgcgaagcaaacacactgccagctgctcagctggaccagcagtctttagaagatgagttttgattgacaagctagaaagaagagaaaagccatgagccacagagtccttctgtggtagctaaggacattatacaatattactctagaaaaatataacatttctcttttcagctataagtctttgctttctactgaactaaacctagtcagcatttattagtactatgaggggatcactgaggggtcaaaggtgaggatgatatcagccgatttgtctgtaggtgcttctttcattgtcatcatgagatttcttttcccctcctctccagaaatgcacactggcattattatgtagctcttggaaatgtccagagatagcatcccctgacccaggatggaggcagaggcatgtagtacttctccattggtttatcatttgcttagaagaaagcaacctactctccagggacagttgacaccggagtttagcaccttactgcacagagctcattttgtcaccacatggtagcgtacagtgtgtcacgtgtctgggctttgcttctcaattttttttttttttttttggctttttgagacagtgtttctctgtatagccctggctgtcctgtaactcactttgtagaccaggctggcctcgaactcagaaatctgcctgcctctgccttccgagtgctgggattaaaggcgtgcaccaccacgccgggctgcttatcaatttctaatgtagcaaagtattctagcggcaccatcttagacaacatttactcctcccagtgtctgtgggtcaggggcctgagtggaggttacctgggtgtctccgtcttgacaaactgcgaccacaatgtgagctcaggcttttgctaccacaaaactcagctgaaggtgaatcaacttccaggtttattctcttgtcccccagaaggtctgacatcccaagggttgttggtctggatatcaagtgggctcctgctagaacgcatggacctatgtgatacctgtgtgtatcctgtcagacacggtaagccattttcagaagtggcatcccatccctcttttcttaattctgttgatcagcatgggaatttatgtgtcatccatactcagacatagatatggagggaagagagttgggtgtttggagacctctaagtgacctcctatgaccttcgggaacagagctgattttcatctcggacagctgaggctgctgtggattgaaggatgttcttgctctgtcttgttcttttatttcctccttccttttattaggtagcctccttgggcagttctttccccaaacacctcctccctcttgtaggcatgtaattatagatgacatacacaccagacagcagattgctttaatcttttaaagatttgttagtcttacagcgtgtcaacaagccatattgagtctttttaaaaacctaatgtcttgatcaatgcatttgaggagtttagctccaaggggcattgtatctgatgtgggtaaatcatggcaagccagtagctgatagaaacaggtgccacactgcataagaaagcggaatctgtacggtatagtccttgagaaggggcattcaatcaggatgcctctgaaagacaactgaaaagccagataaaaggcattgttccttggatttctgtttctaatgagcaaggtcattaaagaaaggtgaacaaatgaaccctcctccatgcccttcaacctcggtgcactgactcggaggaacagcaggcctcctgtcccctgaattccatggaaattagccattcccgtgaggagactgacctatttctctttaaggaataactcaactcggttttcagcaatgtgttccagacctacaaaggcactaagtgtttgaagagaagataccaggaaatcgatttctgacaacttaacaaacaaaacaacacaactatgtacatcttatttacttatgttgtgtcagggctgtgtgcgtaggtgttacaacatacacctgaaggtcagaggagacaacctgtgggactctgttcccttcttctaccatatggattcaggagactagactcagatcagcaggcacctttacccactaagccatcttggcagcccctgatcaatgtttgatattgtagacgactcctggggaagtatttgtgcaagccctaggtgaacattgaccaaaatgggtctagactcaaaaagggagcgtgcctcaatggtaaagaacacaagttggctgcatgctctcttcaaagtcttccgctgcctttgaagttgacctcagaccatcttccattgcttactttttttctgtctccccagaccttccctggctaccctgtgtccttgccatcaagctgacgctctctgcccctcccctgtacagctccttctcgctccttgtttgtgattttgtttactttctggctcttctgctctactcccccatcccactcccagtctatatactcagagataaccatggagaccagaaggacagtgagttttgtctccttcattttggccaaacgccatcctgcctgacacatagttggtgttcagtaatggattaaaataataataataataataataataataataataataaacattgcttgtggccacttggcattaggcacactcaatggaggcctgactgattcctgatcacacctcaaccactacactggtgtcccatgagtcagagtcttacttccagatctttcctgtctggtgaagcttagcattgatgctcccagcatcaaggatggaagtgcaaatgaattttatcctcttcaggcaatataccctttatgaagggcatatttgtatttattcatccatttctctccttggttgaccttcagcctggtcctgttgcagagtcagggcagcatcctggggtcagctagaattcagtcagggaacttgagaataaaatctctcctgactacatgagataaagctcatgtcatgaacatttccctgcaaagatgctgccttctaagttcccttctgggcctgatgatgaaactatccagtagaattcattcattcattcattcattcattcatccattcccaggctccacctggaatacacaggacattgggaaaaggacgctgtgtatgtttgacccccacctttcaaaattcacttaggaaaattcaggctttattctttaatttataccatcgccctgagatcaccagatttggaactagaaggttatagatgcccagaagtgttctttgcattggaccccacaccatagcttctaaacctgactagaattatcatccacagcagttgcaaattgactctttcctcaattcaggcattttcaaaaatgctcaagaattttttttttccaaactgagctgaagggttttgactgaaggccagctcatttatcaaagcatagcatctccagaaaactagaaactaggacgtaagaatacaaagctctttaagtgatccagtataggataattacattattatacaaagctgtaggcctcaaattagcccggtaccatcgtgcgtgtgcgaactggtgagtgagcccagctaaaaagtgtttaacaagagggagcatgcccagatcgtgtgtgtgtgtgtgtgtgtgtgtgtgtgtgtgtgtgtgtgtgaccagaaggcaacacgagcaaggggatttccttgatgtctacataaatgtttcctgaatgggcgcagttcagtctctcggtgattctgtccccattaaggccaataaaagcaagagtatagcaagagtctatctctgccaggtaacagtgagctttaattcaggtgtcctctgcctcctctgtcctgtaccaacagaggcaaattcccttcatctttattcatctgaaatgatgttttgttttgagacagggtttcatatagcccagactggcttccaatttactgtatggccaaaggtgaccttgaactgctgagtctctggcctctactccctgagtgctgggattatagcctatgagtcaccaggcccagtggataaggttctagtatagaatccagggcttcatgcacaccaggcaagcatgctaccaaaggaaacgcaaagttggctcattcctttgagtgtttgtacaatgtcctgcagaactgtatatgagactagagggggagagtcatgtattgattttaaacaaacaaacaaacaaacaacaaagcaaaaacaggagccctaagagtaatggttttgagttattgcacataacagatctgtcatgcgtggtggttgaattttggaggcaatgtaaccagttaacttcaacagaatgttcgtatggaaggcaagtaagacagctacattagcaaggttttcactgtacaggtatgaggacctgggttcaatttttggtactcaccacaaagctgtgcctataatctcagtgctggggagaaagacagaagacttcccaatagatgaatcagtaaagggccaggttcagtcagagagtgtattttaaaagccaagtagaaggtgatttaggaagacaactggtaatgtctccatgtatgtatacacacacacacacacacacacacacacacacacacacacacgaacacacaaagaatgctctcatcggtgtagctcaggtgaacccccaccctgagaattatccccatttatctttttggatttgttaccattttagggtccagagctaagtatatgggtaccaagctatataaagccatctgaaagcagttaaagaatagattatggagttagcagtccattaatttgtctgaaggaagcccagccaaactcaggcttcaactcagttttcctcactgggatccagtttcttgttctctgtgaaaattgtccttaacttgaaggaggcaaaaccagagagaagaaatggaaattaagtggaggctattgggggaggtttcttccccctgacacttgctttgatggaagaagagaaatgttctcctgctcagaggagcagtctgccacctaacaggacttcatttagcacgctttaaaatgtagttaggaacccataatacttaagtttttgtttgctttcctattgcttgcttgatatgccagtgctgtgggccttaccctgaaggatagtcacactactggacatgtgacacagaccacatgatacctcagagcagtgctccttagcttgattgtgcaaggacagagttcccatggttcctggagctatggactttacctgagtgactgtcaagggtaatggagatgctggaagaggaggggctggaagggaaaacttgaactcagtggccaagaaaccttcacagtgaatcttttccatgaaactcaaagaataagacctaccctagcatagattaagaactatctttaccacccagagcagaagatctctgtatttttaattagaatttgaataacaatgtctaacttatcttggaggcaaagccgctatcagaatgaggcatctcaggaaaaggtcaatggatggatggaaagaaagaaaaggaaagagagagagagagagaagatagacagattcataataaacaagtaaacataataattttttaagggatggcaagatgactcagtgggtacctccagactcgacaaacagggttctattcccaaaccaacaagatggaaggaatgaataaatatccacaagttgtcctctgaatgccctctacgtgcatgctgtagctggcattctctctctctctctctctctctctctctctctctctctctctctctctctctttctcacactcacacaaagtagaagatattttttcatgaaaatatttttcacatcatgcctgtgctccttatgtctacagtcctgagacataagagagatcccaagagacagacacaagaatggcacccagctctttgggaagaacaagagagttaagcaagggtacagctgtgattccacacacacacaatgtttatcatctgagctcttaccaaagaagacagaatcatgcaattcagcagcaaatactgatgccaaagaaaggtttagcattctgtttcaggtaataatagcagcgattcccactgggggcaccaacttagagccaatagcttttttattttgcttcataaggacattaggaaatgataggtatcatctatttccatccttgtagcagagaggttggtattaacccagacaaaaaataaggacttgaatagaatatgtctgtggggtctgcccttgtctgagctgctcatttcttctctccatcggcctatgtagacttcatcaccagagctcccgagcccttgtggttccatggatttcggccatagtggtgtcctcctaggattggaaggaggggtgtctaaaggcagttgtgttttcttttgtccttcctatgactacctaagctgatggtggaagggtctgccccatcctggtcactaaccctgcccttctgtgaccttctaggaggtgctactgagttggtaccagcctaggttcctgtgttagccatgtcttgtgttttctttatggagtgccaccttatagactcagtttttggttcgtccctttgtaacccattgggttatcttgaccaagtatcctatttctctctctctcttcttctctctctctctctctctctggggtcttgggagttacaaggacagtctttgacatcagccagtgtagtatgatgaagccctgtgtgtttccttcatcttcctccctctaccactgatatataaagattccctatctctttctgtttccctggtatctgcacatttgtgctcaccctgcatgagagaccgggaaagcagctgaacaaagcgggaagggcctccctcctcctgctatagaacttggaagggggccttgtaaatcagggggtgaccatagagctcagcactcaggtgacaagctctcccctttactggcagacaccactgcatatcctatgtatgcctgtccaagcagagtgcactctaagagttgacacgatcgttctcttcattcttggatgccgtaaggatgaaaatgtttcattctctttttaaaaagaaagtgataattatttttgagaatttcgcaatgcgctgtgaacactgatccatcccctcccctcccctggcccttctcttaaaactctcccttccttccacctaacttttgagttttctcccccgtcaagtctagtgtgtattgctcaactagttttgggagtgggacatgttctggcatgtagtcagcctaccagggatcacattattagagcaaatggacccccgcctccccctgaagcaatgaaatgccaaccaccccttagctagtagtagattgccgttgccacgcccacacccccactttcatgcagggatcttctttggcttgagtttgcgcgggtattatgtatgctgttacagttgctgtgagttcttagcggcagctgccctgttgtgtccagaaacacagtttccttgatgttatctaccacctctgacccatattctttccagctccctctctcccgtgattatccctgagccttgagggtgaggagtgaggatgggggagggggagagcagggggagggtgtggtatgtatgtttcattttaaagctgagtactctagtctctcaattctcaatggcaagttgacccgttcctgtggcacccaatggactattagttcgatcatccagtttgtgtagttatactaccacgagttactgttctgtgtctccatgttctggcatgctttaagcgctacaaagcactttgtgaaatctgagctgttcatggccatttgagatgaacacctcctgctcttatcctcccacccctccctgtccctcatgagccttctgctacaacttgcatgactgtgcatcttcatcttagggcttagctgactctatagttctgttctatggtggtctgccatggtggggggtggggggcttggaggctctctgttgacagaatttgttaacaaagacataggcttagctatgtgtcaaaaattcattgaagttgtttaaagtcattgagcatttcaaatctctctctggtcccaggctatgagtgttgtgaggtatctgattccggatctcatttttcaatattataatctaaagtcatgctggtttgttctgtggacaggaactagaaggttccaatttcatgtctatgtgctgctgatcatgacttggtcacatggatgctgtaagggaagcagagagatgggcctatttcttgaaggttatctacgagaagaaaacgaagagtaccaattgaggaaaagttagccatagctgtagtgttttttaacttccctcatgtcaagggacatattattgatcatgttagcaaaatcagctacatagtccactgagttgatgctcagaccccaaaatggagagcccagctgaccatttggaatcaaactttaggatgtagtcatgggctttcaaggtgaatatgtgaaacctcaccaggagtgacttcttcaaagattgaaacacagaaaagggaaatctgggccttgaatgtacctaagaatatgtctcctccaccttctctttcctgaggtgtggaatgaggaagtagacaaccaggagccagcaaagcggagtgcagccctaaggtgtcaggcagctgtgcaggcagctgtgggggcagctgtcctccggtatctcctccgtatctctgagccaatcacctttggtcaagaccagactctcttctcaaagatgtgcatgcagtcaacagccttgggactcaaagacagtgtttgacatcaaatcaaaaacaaaaaaacaaaacaacaacaacaacaacaaaaacccaggtcccgcaccacacacctgagttccctaagcttgtctcttctcagcaaggtgtcccaagtgtgggcagctgtgtcctgatcgtgttcccctcaaggaggtggatcttagagaaactgccacagatgcgtgaaaagtggacccacgtgagaggtgtagacatcactgggttcctcttaacacaaagagggttttacttcaagggtaatttgagtcaaaagctgcatggaagtcaaggaaaacaaaaaaataagaaaatacagtgccctgccgggcgatggtggtgcacgcctttaatcccagcacttgggaggcagaggcaggtggatttctgagttcgaggccagcctggtctacaaagtgagttccaagacagccaaggctatgcagagaaactggaaacaaataaacaaacaaaatgaaacataaattattaaaatataacattcattacaaaataatagtgtagtacccacaggggaagacagtgattgtcgtgtggaatctcatcacctaatacggaattaagttaattctttactgaatgtaaaaaggataaaatgtttggacaaggacactgatttttttttttttttgagacccgagattaggcaaaacattcagaggcaaaaataaaataaaataaagcaactcacaacccataagagaaaagcgagtgagccagtgagaaacacgggaatctacgaattcttcaatgaaattcttggtctgttacagcgagacgacattatttctttttccccaaagatctgctttattctatatttgtgtgtgtgcccatgtgaatgcctgtgtacaaatgctagcacatgtgtgaccaggtacccccagaggcctggagagcaatgaggttgctcagagccagacctctaggtgttggtgaggtgtctaatgtcagtgctggaaacgaaagtcagtactatggaaaaccagcaagcactccttgtaactactgagcagtcttcccgccctgagagggtatattgtcaatcaacaaatctgacaaaagatttgagtccagaagttgcgaaaccactcaaagttcaaggctcaaccaaattttaagactgtaagatttaaatatataacaataattttaaaaaacctaacacctgaaaactaatattttggattggctagtcatgtggtgaaatggaactggaaactgacgagaggcgagaaagcaccatgcacacagttaattagcagtgacagtatctagccatggcaggaatgaggaaaggctgtcaggatgcaaattggtagagctatcccagaaagcaattgggtggttgctgcgatccttcacccaggtatttagagacctgagaacctgtgtttgcagaaagaccccagcattgtatccattctgtttataattacccaaactggaacatcccagaagtccatgtgactgagattggttgagtataactttgtatctgtctatccagtgggcacctgctctctggagggggattcaagctgtcacttcaggcagcaacatggccggctcccaaggcactgtgctgtatgagaagagccatcccagaggggggcttgtagcagaattcaatgtgtgtgtgacactttaagacaggatgatagatcagtggttgctggaagttggtgggagaggggtcatgaccaagaaatatgagggccttttgacgtgtttttaaaaggaacatttcttgtctggcaataacagtatcggtggctataagggttggtgaagaactttgtgaacatgtaacattttcatggaagtcataggtgatgaaatacattctcaagtactaatagattaatgagaatggctacacagtcgtatagattctgtaaatctctttactgtctagcttcgtagtgtgaaatctggtacctgcttccatcctcgctccaacgcggtgcctgccgtgagctgagggctcaggaaaacccttctgtgctcttgatggaggatgagtgaaaaaaaatccaatagtaacttcatgaattttgatttttgattgggccttgtgtatcccctggagtgatccaggcgttcccaaggactcctggactgtcctttgagaatctcagctacaatggactgagctgtattttagtcgtcttctaactatcctgtcttcctgtcttgggtttttgttttttttttttttcctgtgtccacatgtcctctggttttgctccatgacttggttcaaattgatcctttttaaaaattaaatttatttaaagaagcaactctctatatttcatacaactagaaaaaaataaactctgtttccagtcattcaaataaccacaaaatagttaagccaggaattatgtgatatatgtaatacattttccttaattgtatctgttgtgtacacatatataatatgcctacacacataatatacatgcacacatatcccttgactttgccattaatcaatacataagtgagcctcattgacattctttatgtccttaccccttgtttccaatgatacatgcattgtaggtgggtacatattctcctgcagatgtgtgtgtgtgattgtgtgtgtgtgtgtgtgtgtctgtgtttttctgagaatcatctaaatccatcgcagcgtatcacactttagaaaacataaaggcagcacatggctaactctgataaaccttttgtgccgacccagtgaatcctagccatgactgtagcctgcagctgatatcataacccttttaaagaaaatacctgtcaaatagttgcagcccaagaaggttagagaagttgcttcctgtttcatagcaacaaagtccaggcctgggatttgaaccccggcacccaggctgcaaagtcacctagataggaatcctagattgccatcggagcctggtagtgactcagcactagggtgtgtcactgtccttcggggccctcgtcgggtacacaaaaggagatggatcaaatcaagatgagtccactgaaatagctggtgtcagcacccaaccgagcaggctagggacctggcctggatgaaactcagcctagaggggatttcacatcttgaaagaaagaaagaaagcatgtgctgtttgctttctggtggtttcagttgctggttttggtcttgcttgttcctttttttttttttttttcatctccttccttgttttgttttataagaaaagattgaagtctaggtttttgtgttgtgtgtaaattttccaacctttatcacatgcggaagggccttgggggttggctgctttgtgacttctggcctggattatcttttctgacttagagaattcgtgctccagtgaactggttttttttttttttttttttttttttacagtggtagaaatcaaatcctaattacggaaacagtttaaagcaatggtgaagaggaaaaggagctagtgagcgtcttaacatgtcctacatagctattgattaaactctgggttaattgaaaagtcagggtccattaacaaaataacaacgtgtatttctttgtgatccttctgcgttgtctgtgagtgaatcggggatatttattcagtatttattcagcactaattctcagtttgctgagagctcatggaatcatggcatgagcttattggaattcttttcatagacacagagagacttgcccaagaacgggcactatgagaaagttagtcagccctgactcagaataataagtatgaacatgtgacagatgccattgtgtgctcagaggaaggcttcccgacacatttttcacatacacgtgggtcgttttgtttcagagagttgtgtgctgtttccagctcttatcagatttcctcacttttaacaatggtgaagagatgccctctctctaaatccacagtaaaacacaaggaaggctgtgttcacaattaaccccaagccaggtttttgatttatatgtctgtgtgaattcctgcccctgcctctgtctctctgtctgtgtgtgtgtatgtgtgtatgtgtgtgtgtgtgtgtgtgtgtgtatgtgtgtgtgtgtgtgtgtgtgtgtgtatgtgtgtctaagtgagtgaagggagagtccagggagaatctagagagataatcttgaaagacaagtttattcattaatgacatcataaggattgtatttttctcttggttaataaactatttgttcggcggctgctgtactccagccaggtctagtcatgtcgtttctcggaaaagatctgaagcaactggtaattgaaatgataataatcatttgatctatttgagaataacactcatctccaaagttgtctattctaggaagccttatttggtcaaaatgttgccaaattccatttgtgttcatgtggagactaatataccatgatacttaattattttccagaacattctaaatgctttccctggtatgctccctcctccatcccagaagctgtccccatatgctttgaaacaatacccagcctggatttttttttaattctgacatttcataatcatcatgtaatagctataaatgcaggacgagcagaggtcttctatttcaagaagttgatgaaatagtagagttgattgtgggtgaaatcagctcctgcaaatgacatttttttttaaatgtgccccacagcttataaagtcttcaggtattttcttgagaagagggcaaaacacaatttccactttgtctgcctttacgagaagttcatatttgatcaagataagagaggggatcccgttacccagtcttgtgttccattcttgagagagttcttgtgactgttctttttaacaaccttctttttctcagaagcagtcctgaaccagacaaggaaaagcaaaatttacctcttaccttaaaacattcaacagaacaaaactgagtccttcttactgtgtaaacatcattttaataaaactctttttgtttgagttggaacagtgccgggggagtggttagggtgtgtgtgtgtgtactgtgtggttgtgtggggggttgttcatgtgtaaggtgtgtgatgtgtgtatattgtgtgtggtgtatgtatagagaagtgtgtgtgtgtgtgtgtgtgtgtgtgtgtgtgtgtgtgtgtgtgtgtctgtggtgggcaaggtagggaagagagagttgtatctaacagcaaaattagccaaattcggttgtgaattccttttctgtctaatagttcagagacatcttcctgttgttcttttgtcagaactattttgaaatttttctgtaagctttaggggtttttcacagctaagccttcttcagaaatgttcagtcagagaaagagaaagagtcagctcaagttaaactgtcaaacgcttccaatcagttcatttagaacccagggagagggatccctaagtcttttccagagaatctctgggccaggggcccccctctttgttcctcatagagatagccactaaatatcttgctgggctaattctgaggcagaaaacttgtttcctggaagcaattagagatgcttaaaattcaaatttatgatccttgggaggaaccgaagcttcaacgacttttcttagattcaaaggcgttctcaccgccctcccgcccctccccccatatgtattaaaagagaaaaaaaaaaaaaaactacactcatttctcagcttgcaaagtttttcagaaacacgagaatgtgtaagttgctttcagtgggaagcacataacatttatggagtatttctttggggattacatcacagttttatttaatttttttaggacaaaagttaaattcaatatttgtgtataagccaagggaaaatgtaccataaacataggaatttgggggtgagtcagagttccaagaattctagatttacttaggccatttatatgaagacaggctaaccattagtcatccagccttatttttttttttcgtttgcaattaattgcacctaaaaattagctttcacccaaggagttagattggtagatggggctttgtgtctagcattaaaaatgcctgttagaattactgtctcctgattctgggaaccttctaacacacagcaaacacatcatataaattattctttaaataaagaggcctggaaagacactgagctgaaatgaggtccctgggctcttctcctcctaaaagctacacatagtatgcttgtccaaggttagaccatttgctggaaggtgaggctggacccgtggcatccagggaggcttggctaagaatggatcacttttctttttttttttccaaacccagaataacattttctgttcttctccacctcctgtaggatgaggtcatcgctgtctctgaaaaggtgattgttaaattagaggaccttgtcaaatgggcgcattctgatttctccaagtggaggtgtgggctccgagccactccagtgaaaactgaggccttcgggagaaacggacagaaggaggctctgctcaggtacaggcagtcaaccctcaacagtgggctcaacttcaaagacgttctcaaggaaaaagctgatctcggtaagcacggctcctgcttctacattcactgtgtggggatgtgcagtgagctacatccactctgtccattatcctggaaccccttactatcaatatatctccatgaaatgaagtaagaactatgtatgaaggaagatgcaatatgtaagagttatatattattttcgaattatatagcatagttatatgttgcagggctggagagctggctcaatgttagttaagaacagtagcgttcttttagaaacggtcagttcagtttctagcacctgtaccaagcagctccaagccccctgaaaactcacctttagggacatcagatgcctcaggcctctgagggtgcctgcactcatgtgcacatgccacacgtatgtgcacgtatgcacacatatacacacacacttaaaaataataaaaatgagtcttcagaatatattatatatcctgtatataattatctattagggtctagagagatggttcagataggaaaactcttgccttagaacctaagtgtgatccccaaggcccatattacgaagccagtcacaatggtacaagtgtgtaatcccagaactggggattctgagatgggaggattgctgaggctatcccaagtaaccaaatagatgagttccaggccagtggggaacaaaagccaagatgtgtggcttctaaggaataatactaaatgttatcttctgacctccacaggtagatacatgcacagaaacagagcagacctagaaatgcacacacaaagaattatatcttataaaattacatattatataacagtatagtatgtgattttttttattaaaaattataagcatggatattacatatgtgtgtatataattgatttatcctaatggggcccaagactaagaattggaaaatgccagctgggcatggtggtgcatgcctttaatcccagcactcaggaggcagaggcaggcggatttctgagttcaaggccaacctggtctacagagtgagttccaggacaaccagggctacacagagaaaccctgtctcaaaaaaaaccaaaacaaaccaaaacaaaaaattggaaactacctgggcaggaggggagaggaaccgtgtgagctgttgaattattgggtgtctcttgtgtaaagtctcttactggatgacatagcatgtgatctcaaataatggtctatgtgccttcaagatccaagacttaattagggttaatagtgaattagcggagacttaaaatatttgctgtaggttggtagtaagacaagtaggatttcaagtcaaaatctcaggtatgtagcaacctgaagcaaaatggtgattcattcacttctggggtaatagaacaagcaagaaactgctggggtgggtgttcttggcttttccttcctctgatctgtgtttatccctctttctcctacaaaggagtgtctggactttagttttcttttctctcctgctttggagtgttttgaccatatctgaacatcagctctgcccctcagctgtgtgaccttaggtaaatatgtatggtctaatcttccatcctcccatacaaataaggacgtgagaggcctcacactgcgaaggcattctcctgcctcagcagacgctcctcctgagaccatgtgaccctgtccacccttcgtctggacttgtttgtaccctcagtggccttcatggctggactcttctggtgttgctcaagaccaaagctattgacctctgctttagactgcttgtttcctcttcatgcaaagaggaacttcgtttttaacacagaggcatcttttctttcattagtccatagtgctgattttcaggggcctggttgatgccttaatgtgacaacttcctggtttttctgttttgttttgtttttaaacctagaacttagcttttacaagaaaccctgacgattttttttaacagacatagactgaataacaccagggaactgactctttttcatgtgattctggtttgtggtgaggcgtgctgtttgagcaatagcgtcgagaccatcctgccatttctagcaactgttgcctggtagttctttgatagatgtccgacagtggcattttagacccacagccctcttgtcatgagcgacattatagaaaattattaaggtagctttttttctttcttctcggctgaggaatttttaaaaatagtctttacgtatttcctgttcacacaggcccagttttatcaacccaccctgactacttttatgatgtgtgaaaatgttgactagcagtgaatctgctgggtcaccttcttccagtgtgaccactgttgtgtctccatttgattgctttgcttttaccttaacattaaaacctttgtctgactcttttttttttcttccttgagttatggaatatagcgttactaataaaacattaaacaggaaacccgtggggggacaaaaggctatgtaaatggttaagcttgatgtcacacatgtaaacaagagtatttatagcagggttgttttgtgtttcttttttttttttttttcgagacagggtttctctgtatagttgttttgtgtttcaaggggatagtttattaatgagcacacacacatacacacacagccctttaaaaaaaaaagtctataatctttgtggtttccacccccactctccctccctcccctcacctcatgtggttccagaagaaacaggtttgtctaactattcaaagcacttgctgctgatggtttggtcttgaaaatgtagattagtggctttgaaatcaaatggcatttagatttactaaggagtaccaggctaatggctaagtgcagctgccctagaatcttctctgtgggactgagatgaagcccacaagtgtagactgatagaaggcttcccagatggtttgggatgtgtgtgtgtgtctgtcagtcagtcagtcagtctgtctgtcatttgggacccttttgtggggttagcttgggaagggagatacccaacaggagattgattgagggaccctctaggcgaacaagagaaaccccatagcttttctttttgtaaatgtgaggcacccctttaaggacagaacgtagggccttgaaattctactgggttggtatgaactgtggggaatttgagacaaatagctttcgtaattggaatgcacgctgtgttgtaataatgtgcaaagagaaacaaaaactttccttaatgtaatgagtttccattatctgtctgatctaaagtttgtgaatgcacattgttgggctttagactggaggcttttagaccaggaacactgtggatgctcttggccgtgcactgtcccgtcccagagattgtccgactctccttctctggctgtcacatcaaaggattgttttggcctttttttttttttaacctcagttttctctttctcactcaatctcagtctctctgtgtctctgttcctttctgtttctgtctctggctttctctgtgtgcctctatctctctgtgtgtctctctgtctctttctctgtgtctctatacttctgtctctgtgtgtctgtctctatctctgtctccgtttctctctctccctctctctgtatctctctctctctctctctctctctctctctctctctctctctctctctctgccacaccaaaaccacctccaataccacactgtaagtggaagctctcagctcgcagagccttttcttctgtagatccttcctcattgttctcatcaaagaaagatgaacttttgagattgcttaaggaccctcccactagccaggaagctagcaaagaatggaaaaactcacctctccgtggagaaagtcaaactttgagtgtgctatttttttttaaagcccagttcctctagcctgtttaaaaaaaacatcaataataacgaaagaattagattgactctcaaaggcagattttttttttttataatataaaacccagctaaatgaaagtgcttctcttgctcagagttagtaagtttcctcttatgccagtttgtgtcatttcccgtctctctgtgaatagtgaaagaacagaattaaaacaacacaaatgtgtgtctggcaacaaattaaactgcacaaagggaaactctgcccagtggtacctcccagtggccactccaactctcctcaccatccttgcctggtttgctggtgttgttgttgttgtttttgttttttgaggtttttttgttttgttttgtttttgtttcctttaaatcacctttcccttgagagcagcctgtttgtttttaaaaaccttccagagtcttcatttaagactcttaaatggctgctgacaacaactacagatgcagctagtgaaaaggctaatcattaaaacaataaacatttcttccacgtgatgcagcacatttattgccccccccacccaagcaagttcagcatgagaccagcaccaactgggtctctcctggggtgggggttacttcttcagcccatttcacactggagggtgttttttgtttgtttgtttgcttttatgctgtttttaaagtgaagaaagatctctgtgtgggaacagaagggttaaggaatgtgttattcataagcataacgaacacaaaacctgttcgtccagaagaatcagactgattaaatcattcactacacaagcctctagttatttatttttgtcttcagaattacagtacttagctttgtaataaagtggacctgatgcccatatttggtgtggcacttgagagtcgtcaaatgaagacttatttcattttacaaaaattttagcaacttaggaatataaatactatcagttaaacatagcaaagttgcattttttattccttgggctatcgtttgggggggaaaaatcaaattattttatacaacactgtttctcacagagttcctttaagtgaggtatgaaagccacagtgtaagctttattggcctataaatatgtcattatagttggactacatttatatgcttcggattgttgtttaagccaagaaaatatgtctctacaggttgatttttttttttattgaaaccctttgaggcatacagcaaaatgtgttttaggccaaggttattaaagcagcattttcttcctttttcccccccttttgtaacagactcgatgtcaattaccatactgctaactgtttgtggatgggcagttatgaatggtttcatctctaagtatgtctttagaggaaaaatattaaaaagaggggaaaaggaaaggagaatgggggaaaaggagaggtgggctctgggaggagaggaaggagtggggaagctgaaagctagatgtaaagtaaatgaatgaatgaatgaatgaatgaatgaatgaatgaatgaaaaaatcaggaaggctgaatgaatgtgagagaacgagagcaagagagcaagagagatagatggagagggagagggagagagagagagagagagagagagagagagagagaaatataaatgaaaaaaaaagaatttaatgtcccctaagtgtctacttgggcagagagtgacctctcctttccctgcccctgtaggggcttcctctatactttgggtagtggatggaaccgagcgagcatgcgccgccgtgcggaggctgttccctctacctaaagatctgctgctctctggaaaacccctgagctcagcacatgctcctgccttcaggttctttgttgttaaaatgaataataatatacacctggctttcggctgttggatttgggaggagaccaagccaggacagactcctcggggcttccggagcgtttgtaaccctggagtctaagttacttttgttcagtgttagcgtaaatagatggaaggtgtgtctgatcaggagctatgcggaaccatgcgagcaccgtggtttgtttctgatatccctaatcagtttctccggacaaggagtagggtttctctccacattgcctctcccaatagaagacacaccaaagtgtgtatatatatatatatcctatgtataaattatatatttatataatgctcctgtttatctttaatctagccacaaacctatcaatgtaatgtactatatatggttaatcattgtattatttacatacgtaaactgacaatattacacatagtaatacctaatatgatacatgtgcatgcttttctttatattataaatcacacaactggtattaaaacaagctgagccatccattgccagttataaacggaaactttcgggtcctttgttaaaaattgactgcagttgttgattagaaattcttgaggcctggtattacaaatggttctttgtagtcacctctgagtatggagtgtccagtggcttcctggagtactcaaggcaacggcttttactcttttctctaaagaaagggcttgagagtttcccatttgaaacacattaagagcgtgagttgtctaatcaactcattaggactggtggctcctcattaagaaccacccccaaccccttcttctttcttctctctcttcttgtaggaaggggtcttctggaaatgccgtctgaatgtgttgtgggttgccctggtgctgtttgtgttttgatgttaattctgctgcccccactgagaagtggacctgtactctggtgatgtcactgaaccttctctccattctgactggtcaaatagaggctagagctgacgactgggtagtgtaaggcaaaggtgggactggaggagagagagagcaagaggaggtggaaggaggatggagcagagctagatgacccagagaagccgcaagtagcacggggtctcatagctggggaatgaattagtatagtgatagatctgcccaatctaggtatatagcttataaatataataactggttgtgtgttttttatatgggcttattgggataagaacttaccctggcagaatgtgttatattctcagttgcttggctgaactgtttccaactgaaatgtgagagttttcttagatgatatatgtttgcaatattctattggtgaataatttgagaagccctacagggactgctcgaaacactttggcctttctactgtccttactttcaaactagaaagacccctctgggggattctcctatgagggtttgacagcagtctgggttgactttgattccttacagactctgatcatagcgcagttaatccctgagaagcacgctgctacagtgtcattatggctcgtccaggagctgcctcttgacattgtgagtgataatccagaagccctttaggttaaagttcgaaagtcctgagttcaagtccaacctggactcagagtgaattcaagggcagtctgagctatataggaagattctgtctcactaaaggaaatgaaggggctggcaagatggctcagcaagttaaggggcttgctgccaagcccgacgagctaagttgaatatggaatatggtggagagaactgactcccacattgtctaatgtacacacacacacacacacacacacacacacacatataccccaaataagtaagttttataaatgaatgcatttcaacatgcataaatcgacaaccaagacgttcagaatattatctaagaataaccagaaccccacaaactagcaattcaaaagggaggggagaaaatgactttttattttattagaaatcaaaaattcaactttactctctccctaaatagttgaagttatcctgaagccgtgacggaaaggaccagtaaatagttttccaataagaaatattcatctatgtttcctgaacccagctgggaaggaagtctttgccaagtctcctagtgtctgagttgattgacaggcattggttgcctctgctttccacacacactgccatcccatatggagcgcactcctgtccaaaatctttctgtttggaattcccatggacctgaaaggtctccaaaatggtctatgttgatacatcctttgaagatgggcagccgactagagagaaagtctaagcctgggagtttcttagtttgagaagcagaacaaaaagtgacattagaatatcaaggattctgtcttcccttatgaaatctaacacagaaacaattctttgtgaggttgtccaggtggaagaggttggtccagttaacatttcttcccccttcagttctgatggtctttagagttctctctctatttagctaaacaaccccaaatgttttcaattctttctccggatgtggtttttgagcttcttcaccatcctggttattcatttgaggacgcatctcttgtgtttatattacggtggtttactcatttatattgtgaggtactgctttgctaagaatcctccagccagagtcaaagtggcttccaggcatagaaagactgcagtctggtcatcatgtatggtcagatttccaacagctggctatgctctgctgtttccagagatgctgtgaccctagtgaggtttagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtccttgtgtttgcattttgtccaacctgtcggcatttctgggttttacttttcactggtaccttttcacgaatcaaattctttgtggctatttctcccataaaaccaccatggggaaggaaaccagctcgtatttttgttctggcttcattcgtgagacatggtaatttcacaatgactgactgtggaatggtcagctgatgggaaaatgaaagaaagattcggctgtccttgaactcccatctcctggactccctttgtctcttatacctactttggggagacccttggcttgatacaagctcattcatccccaggatgaaagacaaacctccaaactgggagtggtgattgccagttccctttggtgacagcattttagtcttgtctctaggacaaaatgtatgggaagagagatctatttggctcctgatttcagagggttagatccatcttcagttcgctccctttggcaatgacatcatagccaaccaggaagcagaaggccaaacaggaagcggccaaagacagtgcaaccccaggatatgtccctatgatctatgtcttctatctcatccctacctccttgaaattcccacagcctcctaaaataatgccaagtttggggaccaaacactgaaccaaggtcctctgtgggacagttcacattcagttcatgatggaatccagttggcctactgtaatctgttgaacatctcttgaataagaaatgcaaccctgactcttcttcaggtacttttttttttttttttttttttgaggtttgactcaaccttgctgttaattccattctgtaaaatgtctttcacgtcatgatgcttcctttcagcctctcgtgtctagccactgtgtgtgtccacgatagatctctatcacagtccttgccatcttagaatccaaaacacagccgggcgtggtggcacacgcctttaatcccagcactccggaggcagaggtaggcagatttctgtgctcaaggccagcctggtctacagagtgagttccaggacaatctgggctatacagagaaaccctgtctcaaaacaaacaaaaacaaacaaacaaacaaacaaaaaaacccaaaagaatccaaaacacacctgaccctcaggtgacttgacatgaggccatacttgagctcagcatttcatcttaatatgctttaagaccgacgtcgattcttttaaacagctcctgtatccttcagagtgctttcaatgggagactttcttgcaaaacatgtgtttctcgaaatgtcaaagattcccttcccaactttcctctgacattatctagttaaggctgtgtggttcctgcaggttgcggcaatggaagactgaaatttgggcttttagcccatattaataaatatagttatttaggacaggtctgaacagaagtggattttcaaaggctttacaaagtgctttgtgcacagtggggctaaacaaacatagctgtctgtgtgagctttcctcttctctctctctctggatgcctctatttacaccgtattgatagggagtgctaatttctttcattcctaaaaatccctgatctgtgcatgttcttcctgtgagtctcctccaccacttatatctttaataatttatactatacatttttatatttttgaattctttgtcaatagccacccctttccttgataaatccaccactactggataacacacaaaggttgaagggatacctctagtaaactataactccagcctgtatttttaaaatagtcatttgagtgagttgtttctgtggtcattttggggacatgtaggtaaaatagaaaaaaagtcgtgattgccgattttctttccatgtccaggtacgtcctccggcatttacacgggtgcatctgtgtagatgcgcagggattggtactcagatatcccccgcccccccattcaaaatgtacccttcaggagcccacctccatactggattctatagagaatgatgtaactatagctttgtgacgcaatccacttttatctggctgaggagtgactctctgttgaggtgcttcatgctttaacgattactgttggtctttccaatggcttctggttctcgcccgctctgtgctcttcatagctgtttacgcatttgcagaggggaatctccggctcccctgcacacggggactgttaaaccagcctgtgctttttccttatctaaccctgtccctgcttgtgtaaacttcaaccctgaccactccccaccctcccaaattctccaaggcgcttttactgtaggaatgcccctttggagagctgtatggggggtggggggtggggaggaatgctcctggctcctgcaacccttggtcctttgagttcgagatcatttgcctcacctgattgggctctaatcacaaggagtagtctctaccaccttgcagagcacctaagtgtatgcagatgcctctgccttatcttcccaggaactagctgagctctgcaaggttgggcccccgacttcaaagctgtatctagcaggctgagcaaacatttggcttttataatcagcccctcctgaaatctctcctttcagtccacctgagcggtctatgtacattcaaaggttgattcgtatttgttactgcacttcccgatacaccctgtcatggaggggagggggctgggggaggaggggagggctatctcgtgggggtatttggctgcgaacttttgggaaagggaggctaatttgtaatcgagtatctgtcgctcattttggaaaaactttttcgagagagcttaaaggcaaaccaggtgatctgaggatcagtgggggcattagtgcgtgtgtgcgtgtgtgtgtgtgtgtgtgtgtgtgtgtgtgtgtgtgtgtgtgtgtgtgtgacaaactttacatagtaatactggcacttgctaatgtctctattactcaagggaatatttatcttgctacagatttacagcagagacataaagggttcaggtccgtaaacaagtccagacggaactcgccctgcgttatcttttttttttttttctctttaattagcagccagtgtgtaacctgccttttttatttatttatttttcttttttttaggtagcaggttattaaggagatgactttagctgctcatgtaatgtttcttttcctaggcaactggcccgatgtaattctcagctcccttaacatggttacttactaatggttgaagaacacaggccccaccttccaacaacccagtcaattcctttggctcacaaagacggcattctattaggccctgccgaaacaaagctctgggcctggcctattctctccataagaaataaaacattgttttcatagtaatgctgataataagggagagttcaaagcgtgatgaaaacatacatatacttttctagtaggggaaaaaaaaaaactcagacctggttacctggctaatttacccgtcatgtgatggctgtgtgtataaatacaggcttttttttttccacgtatggaacctgcgccctttcatccttttcttcttctgttctttaaagatgacaatgtccatttcgttcccattgttctgtatctgtgttttccatcggagatttggcagaataggcagatacaaagttgcttctttccgagaactgggcgaacagtctcctccccaccgcccctccctggggtagagttttttttaagccagactggtattgcattctttgtttcacacaatataaggtcctgacattttaagtgcaccttgattgcttatctggaaagcaaggtcgacaatgcgggtgtcacgggacttggggaggatctggctagccttctgggttgcaggcaccagcacacagtaggtgcaattagctaatgataccagtttccgtttgtgtttccttcagaaaaacaaaccttggaaactgctgtttcctccactctccccaagcccagcagaaggttttgagtaaagaaaacgtatgtgaagacatattaataggtaacagcagtgagtggtttaattcttaactcccagacaccaggttatctattacaaggcattgagacagactcgggactgcatgagccatacccgactctaagggccaccgaaaaccttcagagttcttttgaagtgctttttaatatgttttgaatcttctgattctaaaatttacccctgtaggcgttgccctgccagccacctgccttgacctttctctgacctctctttgatcagaaggagcagcgatccaacttggtcaggatcctgagcctgagcgtactctgagcgtactcacgtatcactgagtgtttctctgagagagaacagacagttcccgggcttcggtggattgctgtatgggttactgtgagaataagcgtgtgggctagtggtgagacacagttgcagcagaaaatctcgcatccatgacgtgtttaatgattccaagagcaaggatattatgctggcatggccgcagtttggggatgctgttgaaatcggaggggacgagcaagaattatcaatgtgtgttagaataacctgtatggggccgtgatagcaaacacctcaaaagtttgagggcattgcacaatagaggtgtgtcttacttaggtgcagttctgtagtagcgtatgcaaaattctccagaagagattttctccgcagttacctcttcaggggaccaccatggtcacatgggattctgtgcttaaggcagggtgtcgaaaagacaagggaagggctgagggctgagctgggcaactcatgtgcagtaggctagagtcatttccacacctcacttataattaagtgatgtttttttgtgtctatgtcttacttcaagggcatggagaggtcctagaatcttcttggaagaaatggaggtggatgctaggattactaacatctcagccatgcatttaggataatgatggaacataaagtctcaggttagaaaagaaacagctttcccagctaattaggacttatttccaatgtctacactgtcttatatgttctccacagtaattcctactggttgacgttttattacttttcaatgactggaaattcacaactttataaaagaggccaattttatctttgctccatcactttataagaaatcatagactggagagatggctcagtggttgggagcactgactgctcttccagaggtcctgagttcaattcctagcaaccacatggtggctcacaaccatttgaaatgagatctgatgccctcttctggggtgtctgaagacggtgacagtgtactcatatatattaaataaataaatctttggggaaaaaaagaaaccattactttctgtaaattaaatttgaatgcgcagataagccatggtgttcactaacattatcctgcttccattcttatttgtttttttgtttgtttttgtttttggtttggtttttttttttttttttttttttttgagacagggtttctctgtaaggccctggctgtcctggaactcactctgtagaccaggctggcctcgaactcagagatccacctgcctctgcctcccaagtgctaggattaaaaggtgtgtgccaccactgcccagcccattcttataataaactcacacagaatggatcaactatccccagttcttgttggtatttcaattgtttgaaaagaatccagcttttcttttattgccctcttttacttgtggggaacaaattccacccctttcccctccctcagtacttcctggtggccttcgcctgaggagttgcctctatccatcttaaatcacaactgctttagtgtctacttagcagacaggtagcgaagggttagctgcaaatgagtgagtgcaccaaggaagatcttgggtcagggctatcctgggctacctagtgaaccagtatcgggaaactgaaagaaaatacaacttcagtctgtttccctgtgctttcacattttacccaacataaaacaaacaaacaaacaaacaaaacaaaaaacaaaaacagactgtggaatgaacaacacaacaataagaacttttcccctcttctctactttggttccttctggaagcagcacgctggtcacgggtggtggtcactgtctccttgtgtgtatggtctgcgttcattggtcagaaggcagagtcttgctttcctgcttcattttgcagctctctttttaagggttgaacagaagcctcacatttggcgactcccgtggaacagggctgtgaacgtgaaaaaaaggttccaaaagacataggatcccagtgaattatttaatttatgtcaaatgtatttgagatgtgatcttttgtagtccgggctggccttgaactcctctagtagctaacatgaccttgaacccggagccgcctcgcctccttctgtctttggagtgctgaactgacaatttattctgccccgcctgacttcctttaaatcttaaattaaaagctagagcagcctgttgttgttgttgttgtttcaggagactatttatcactgcaactgttgaacctttagagtaccgattggctatgccggcaatgaaaaacatttcaatcccgtgctccggcttccaaaaacacagcctaaaaggaaaaaatacatctcgctaataattttatattgagcccatgttgaaataacctcgtaagttaattttactatactaaatgtctcattccaactctcttgacctgctctattcttgatgaccttagggaaccacttcagagttgtgagactgggctaggagagatttggacaggagaagacaggagaagatgtttagcagcccaggcttttatttttgaagcagaaacagcgtttttatgaggctcaggcatcactcactctgggggcagagtctcatggtggagtacagcagacaggtacagttgtaaggtagcctttagtgagactgtaatcgtgaaagaagaatccataaaacatgtcctgtcagaaagcaactgtatccctgcttagagcaagagtcgtgagccgagtctctgtagtggtctcacgtacgtgatggtttactaaggaggacttccctcccatgtcccatgcatcccttttactgtaagtatattgctatcggtggagggtgtcatggtcatttctgacttggattttattgaaggggcgtagacttgggtcagactcttctttctagatggaaatgacctctctgtgtctctgataaatacctcatggcgggtagggagtggagctaagtggtagagggcttttgaagctcacccaaggctccaggttcgccctgctcttcggaataaataaataaaaacaaatttgagaaatatcatgatgtttcctatcaagagctggcagaggcaacacataactattcgcttctctgtgaacagctcagactctggagagtctactgagatgcagagacgataatagtttagcttaaggctcttttgtgatttattcatttggattttgggggggtttaggttgatgcaaaactatgagatttctcatgctgatgtgagttctggcaacaaatggctatccgttccacctcaaggcaccaggcctttcatcttctcattgggtgtccctagcttatcacagaaatattttcatattatattcttagagtatagcctacgagccaaaaagagagttggcaattttaaatcacaaatgatagaacttttttcatgaaatgtcgactctctgcctagttccactattcatggtcacagacggagacaatgcggtcaatcaagccagttcatataagacaatgtctccccaaggcagtgccagtggtaaagttcatgaaagcatggaattctccttgggtggaactctctggatgaataagatttcaatcacactgctgtcctgagagtgacagcaggaacggaccagaatctatagtacagatactgaagtcagaattgagcaaatagtagccgtccttactccatgtctgaaaacaaatacatacagagcaagcaagatggcaacaggatggcatagctggtgaaggaagcctggagacaggattcgatccctgagtcctgatcaagggtaaacagaggaaattggcgccataaacttgtcctcgaatctccatagtcacatgctgcccctatatcacaacctaataatacatatatgcatacgtacatactatttaatactctagtatagattatatatgtgtataaatatgtatgtgtacattatattatattaattatattatattatattatataactataacttagcctatagagcaagtgtctgcatgtccttctggaatggaacccaaatcctgggttcttaattaagaactagtatatagattttcatgggatgtggtcctttcccaagcttgagcctagagtttcttatagaaagtgtaatacgtgtttttttgggaagtcaatggtagtgttcaccaactctggaaagtatctgcaatgattctgttttacaaaaatattgtaaatcagctaaacctgccttggaaaatctcctcaggcatctcagctaagtccctttaaaaaaaatttcccagcagcctgtgcagatacaatggcggagtacagccagccgtcagccagccctcatgagtgtctcctttggagaatggagttaacaagcattgaatgtaggttgacatcattcacctgctgcccctaccccccccccccccacacacacacacacacacacacacacacacacacacacacacatgtcaggtctcccacacttgacaaggactgctgggttgacttcctctaaacctaggaaaccaccatccacttaagaacaaacccaaggacaacatgtctaggcagaaggcaaggcgtgccttcccctctcatttctctatttctcaactgtcccaagtctggatctacatatgatggccatgttgtctcctccgctctttcgctttagaatatccgaaggggtcctcctctcatggcgagcctttgaaaataccttttagcagagtaccgtttgctgcagacatctaatttctatggcttaattttgatatgtcaggtttcataagccaaggcccacttacatgtttcttgggagtgctttttcctcttctgatgggactatgtttattatgggactcaatatcatgtttaatactctaagtaattataaagcagtgaggttttgacttttacgtaaggagatctgcatataatttgttctcaaactttgactcgtttcctgtgagcttgtgacaagaaaccttttgtttcctttccctttttttctttcttttccttctttttttctcacatcagggttgatctgccattgactcacttaaaatcctttcaaggaaaggaataagtatgaacccccaccccttcatctctttaaaacaaaattgaaaacgtatatgtgagtatctgtgtgtttgtgcatatgtgagtgtgtgtgtaggaacgaatatatatgagagagtgtgtgttaagtatgagtgtgtgagtgagtgtatgagtgggtgtgtaagaatatatgtcatatatgtataacatatgagtgtgtttgagagtatgtgtgaacgagtgtatcggtatcaatatgtaggtctgtttgagtgtgtgcgaatgtgtgtgtctctgtgtgagtgtgtatgtatgtaagtgtgtgaatgtgcacatgagtatgtaagtgagtgtgtttgagtgtgtgtgtctgagttgtgtatgaatatgtgtgtgatcatgtgtgtatgtgaagagttgcttaggagtatgtgtgtgatcatgtgtgtatgtgaagagttgcttaggagtatgtgtgtgatcatgtgtgtatgtgaagagtgagagttagtatatgtgccatggcacatgtatagaggtcagaggacattttctcctatgtttgcataggtaccaggaatttaatcaggtcaccaggccttgtgacaaacttacctgaacatgttcctatccctgctccacctcctgtaccttttaagtgagcacactgtctgctctcaagcggtggctcccaatgtgtgtcatggaaaggcatggttgcctgtatttaaatcttgcacgtggaggctaaataacgtaatggtcacagctcagacgtctggcaggctcagacttgaacccagagtcctcgttttctgcctccatgaccttcagcgagttgcagagcttgagttttgtcacccataaaacaattctgcctttgtgaggtatcatagaatctaacagcacgctaagtttcatgcgcttaggaggattgtcgggttcaatatagggtttcgtaaagagtaacaagtgctgtcaaaagctggggtcttaggttgggaaatcctagaatcccatcatttctaaaccaccctcacaatcctttatgatattagtgactggcaattttattactaatttcctttatgtaaattggtcataaattggtcattggttttacttaaatgattatattaaatgggaaactctacattactgctgtcaatagaaaaaaaatccagataattttccataattaatggtaaagataaatagagatggctatctctgcactacataatactgacaaggatggattacatttctgtcggtgtgatagaatatttgacaaaaaaaaaaaaaagcatctttcaggaggagagcctatatttggccttcattccaatgggataaagagttcatgaaggtgggagaaggtgtggcagcaagagggtgtggccaaagtggtaggcaggaaacaacaagatcacatttcatccccacacaggaagcagagagccagaacaggaagtgaggtaaggctataaaatttcaaagcccacccccaatgatgaccttcctctaggaaggctctccctcttaaaggttctataatcttccaaacagtgccaaccactgggaagcacctgttcaaacacagacgcccctggaacatcatttcatatgcaaatcatgactctgggtaccattgatctctctctctctctctctctctctctctctctccctctctctctannnnnnnnnnnnnnnnnnnnnnnnnnnnnnnnnnnnnnnnnnnnnnnnnnnnnnnnnnnnnnnngcaagtccttcagcagcaagccattcattctgtattcagagattccctcccataccgaatagatctataagctcagaggcctaacctcaggtgagagtgggaaggttaaaaacaaacaacatgtaagcatgaatttaactctttgtgagttagttgtgctataccttaaggaccagaaggctaaatgctgtagaaacagtgaaaagggaatctgaccttcttaatatctgcacttttatggctcagttcatacccagctcctgactgcaactaggaaatagaaaaatctcaagctctagactgtttacgtcttggagtgggcaaaggctaatcattgtggttacctgttgtggtttgaatgtgaagtgtttccacacagcctcaaatgtagaacattgggctgcccactggtacgttattttggaacattctgtaaaatttttagtagctagaatctagtgggaggaaatctcatgttactagggcagattgttgaaggctatatctcactcctgctttcttccttgttcaatgcatcccaaatatcacacaatgaagaccctttttccagccacacggtcccattatagtgacactctgcccataaacatagggccagggcatcatggactgaagccacagaaaccatgagccatcctaagtccttcctccttcaagactgttcatctcagatatttccttttgcttgtgcagagggtaattatagctactgcatgaccctgagaacactagtcctagctctcacttgtttctacacaattttgctagccaaagggttacttgctgacctcaaattccccaaattggttgcatgagaacaacttacttgcctaagtgtagggcttaagctaagcagaaggaaataaacacagatttagacacaaggatactttagcagcacacacacacacacacacacaaatacaagtgaggctcacttttgcacacactcctgttgcataattgataaaagtacaaggcccattgaaagtagcctcaaggtcctgctgttcccactaattatttaagcacatagagcatggtttaggaagcttgtttaggactcagtgtagaacataggtagtctgggcatgacctgtggcttgagaaatagctgtagatgcatttgtcagacatttggactctagtactgttctgaagtcaaatcttcaattcgattgtatgcctcttgttatctagtaaaagtaaaatacgtgccagccaagcataccatcatggacttaaaacaaatgcatacagctattctaaccttaaaggagacattagaagaatgtcctggaatacaactcttcctgtccatgatcaagatgccaaatccattgaatcagagttacccacgtctcgccgccaacaatgatgtatgatcttagagggaatggttgataattataacttacaaggcagtgcataaacgcacggggcagagtggaaggatctggtgacaccacaagaaaccacttgagaagctggtacagctactaacgtttgcagaaccatgagcgatacatgtacttttgtaacgttagccttctttttggtgttttcaggaggtggggttattagccaatgactgcatttttgctaaaagttaaacaaaacaaaaaaaaaaaaaagggcacaccccttttcattagagccaaggagagggtttggatgaggctccctggttgtacagcgcatcattacctcacgaagtagcaagcaagctcaatggaaatcattccttcctgtctcccttcattcttagagttctcaatgagttctctgtccgtgtgaatagactgcatggcagagccttgggcctcgtcctcagattatctgctttgattccttatccctgtctaaaaaattaaacactacacatcctcttgaattctttattatctctacttgttacatcctgttctgttactgagaagattggaaaaggagcaacagcccgccctggcctactgaccttgacatgagcctcacagcaagagtggcctgtcactgaggtggcaagttcaagactgtggccagaacctaggacatcatagtcttgcctcaggtaaagatccagacaggcaggcactctctaggctagagtcactaccagtttggtaggacatctcttattcaaataaggaacaaggtaattccctgtaatgcctatgagttctccagaatgtcccccagaaagtaatacatgctaagcattgctttgtttttacaactgcttcctgtgccttggtttcactccctggggaatctcgggggacgtcaaagtgccttaagccccttctgcatacaggtactttatgggaatatataacatacacacaatactggaagcaaaatgacctatgacctgtgcagccaacaacagctttggtggcattcctagtggtcggttaacagaatgtagattctaggattcttgtgaccatttttaaaaacactttgaggatctactccagggtcgttcgacttttgccggtttgtgtacctccccccatcactttcagatttgcatcctttctggttttgcaatctgggttcaaagtagattccagtttgcagaataaccaacatggtggaggtaaggtaggaggccaataagactgtagaatcagtacacctgtggaggttacggggacagaaacccacctggggagcgctggagtgtgccaggaactaacccttcagtgtctggaccccatccctcaagagagcactcagggagcactgcctggaggagatcagggcagaggctgtttaatgacctgccctgaagcctttgtaccatgaggtcccaccagtgtggaccaaaggaagggcagtcctcgctgcaagcctggcatccttgaatgaatgcaggaggccacggctgtcgagaatctgtatgtagtttaactggaatcccaccccataatgcttaagtgaatagtgctcttcatgtgtgctgcctaaaaatagtttcctctgtggtgggagcagagtttcacgtttatacgagcatctggcctacggaatccagtactccattctttaaatagcttcgcctggctctggagtactcggccttgaaaatgtctcccagctaaacaccttgtttacacaaccccgtttaaatataaacaagctccccctttgaaaatgcagaagaacagtaatttgggaatcaattatgctttagggttatctttggtgtgtgtgatgtgtgtgtggggggagggtgctgtagtacgggtggctgctgagaatatttaaactgcatccattcagcaaggcatttctgaattatctactgtatttagaatttaggattttcctgagtttgattcctacacatgtaaatcatgtgtgagtttggagtctcttctagaccatcatatgtaaatccagttaaaattgaaagttttgggagatgaagaattcataccactactaatacccaactataatagaaacataatcctatgtccagtttgcttctccatcagagacgttttggggccggttatcatttggcagcaggcaatgaatgtacttttgttagtcttagggggggtactagtggttagtcctcacgaaaacaacgtgaaagtcacagattgaaaggtaaacattacaaatggatggctaatggttagctgttacagtccaaaggggcaggttttttttttttttaaatacttttatgacccttgcccagcctctactgaaagatactgtataaccacagttacacatttcaagtctatatctcctttgaacatcctttttcaaagataataggaaatagtcccacagagggagagagggtgagggagaagggtgggaaagagagggaaaagaagaggaagaaagagattgctttttcaatttatatggtttttaatgttatactaaaaaagcagaagcggctttaaaatctaattcgtggacccacagcatgtggtataataatgacacctcaggaaccccaagctcccacctcagccgtcctgaaaattaacacatgttcaatcactctcaggattgttcagtccttcactgttgaaaggcagtctagatgtgtgtctgtgtgaagtaaatggcttctatgcatataggtcaatttgagaaggggtagggggagaagaggcaggcagggttaaatgaaaagggtaggaagaggaggaggaagaaggcttgttttctgtaaacacaactaaaatggctttttggactactcaaggactctagttttacagtttacattaatttaaaaaacaacaacagcaaaagcagcagcattttaatcttttaggagcatatgaagaaaaagcggatggtgagaagtcagcccttgtagagtaacttttttggtttttgttttgtaaagaaatgaatgtcaagagatcaccagtcacaaagttgtcaacatatgtctatgtctgacgaagcagaatcattcaggcttgttgttttgtttttttcctttgttttgttttgtggccatcatctcaaagaggctggttgtttttcatggcccaccaaaataaatgctcccgctgaactggagtgatgcatattctctgctaaacattgaaatatcttcatttagagatcatttccattttcaccagcggaacatttttagatgaaaatctcatctcgttctaaatcatcttcacaaaatagttttcctgttgtgaatatcatcagtttgtatcgcagaaagtggagacagggaaagggctaatagtcattcatggtccccaaacccagagactagcactgtcaaaagttcaattccagcctgttggatttcctgatacagaggtgttcctggctagagagatgcattggtgttttcagaacaactttgggggaacaggaaataggcatgtaagacacatagtgatttcatattacagcaaacaagaacagtgaaagcatagtaactatgtgttttcccttttccatacttggttaccaagtggtggtggtggtgatggtgatagtggtgatggtgatggtggtgtatgcacactcttcctgtgtatggatgcacatgtagagggtacgagtgcacatgcacttgggaggcacaaggttgatgttcagaattatcctttttcatcttactcctcagggcagggtctcttagtgaaacccagaactggcctatatgcctagagccacttgccagcttactgttagaatcccctgtctctgcatgctgtggtaaaaagtgcaactgggccatgcccacaaggcatttacttaggttctggagatccaatgccaatcctcatatttaagctctctaagtgctaagccatattcccagttctgtaaaatctattttaaaaagccaggcctggattttctttctcagagccatgatttttcctggagtccctatctccctgtctaacattcccatacccttaaaactacaaagaaatccaaaattcaatctggtttcattttatacccagcacaactatccttaattgctctcccagggatgccttccctatatttacacaactataggatttcttttcacagactctgaactttattaatttcatattgattttatttatttactgattgatttttgagacaggattttatgtaacctaggtagcttcaacctcattatatagtggaagatgacctttatttatttattttgtgcctctatctcttgaatgctgcagcttgtagatgtacttcatcatgccttgtttatgcagtggtggggatagaacccagggattcatgcatgtcagacatgtgctctgcaaactgaaccacctcactagtcatattagatcaaattcagtaaaatagccctacctctctaacacttgttgctctcaggagttcttgagatctttgtagaatcctctaatgtgtaggctaaatgcctctgctgttctcaactaaggctcttcttctgcacatgtcctttctgtgtaggtgattcagtttctcagtgttcactgtcaaaataccatctgcagaccctgcatgttatctgacccttgtggcatggtaaaagctattttgtcttgtgtccatttgccaaccatgtctcaaagtttctcagtagcagcactctccgttggctcatataagaattatagtgaactagagacatcagctttcacaaaaacaaagtgtaaaatgcattttcttttattagatttagtactattagctttgggccattcttcagccttttaagagctttttgtctttgatggcatgcatttagattctatctgccaaccatgtcttttgcaagtttgaaaactctcctaggtttttactcaatcaagttgattaacacagcaactaccacacacagttgactggtgccatttccatagtactccatttctatttgaatttcttccttttttttttttcaagacagggtttctctgtatacccctggttgtgcttcctaaggtttatcttcctaactcaattccaaatattttagaggaaactttagttaccggtcaataagtatttgtatcatgcagggcgcacagctccgagcaaatctgagtaaatccattggtgttggtgaaccgtacctctgccttacttactgtactaccacaatgctctgtatccaaccaaagaagaaggcctggtgtgaggcagcaccatgaaccccaataggcttggcacacagcactggagacacagttgagccatgagagcacccactgctctggtagaagacccaagttcagttcccagcacccctgtcaaacagctcacagtttcctgtaactatggctccctcttctgaactccatgggcacctgcatctatgtgtgtgcatgcacgcacaaacatacacatgaaattttaaaggaatttttttttttagaaaaaaaaattttttaggtatcttaataagtttacctaatgttgcccaacaacaatcaatttactatggcaagatgatatacacacacacacatatgtatgtgcatttgtatgtatgcatacacacagacatacaaacagtaagtagttgtacttgagaatacttactccccctataagtgggagtaagtattcttgtacattctatctcatttcttaaaaataccaaagttcccagttacggttcccctcaaagaatttacaaatcctactacgagcttcaaatatcctgttggaaacacggacctctacggaatcatgcagcccagtgtcttctttccgggcaagtgctaaatgtttgtgggtcaaacattaactgattaccactcatattccctcaaccctgtagtgacacaggcagacttggcatttgttttctaaaggtgtagacccttctgagctccccaggttccaccgtggtgtagaactgacatctgtgctcttttgttcatctaactcaaaatattgttgagtgttattaagctacccctgtctaaaggagaaaggcagtccatctatggtacaacgaatgcccttgagctttcaaaacccatggccaggccggctcttgccatgggctgtgtttcgaagggatcccttttgtaggcatggtctgaatgtggagactcctcctcatagaggagaaggagcagtcactttctgcctctttgctctgaacctagtagaaactgcttttaacatcccaaagatagagggaagctttttttataggctttgtgtggttccttgagttttaaccaaagtaaaaaaagaacaataataaatcgcctttgagtttctgcccatagaactgtttatttagcattttctgtaaaacaggagatcttctgtcctcacaagaaagactgcatgtggattgcctgggagacttgaaatgatttctaatcttgtcccaactgtctactgctctataaatgaaatgtttcattttcaaagagacagtgacagttgtcctgaagatggcccctttaaacacaaagtgttttccaagagagcaatggcattgttgcttttattggaaaaatggattttcagcaactcttaacctgcttacatcttagcagggcctttgtttccgtgaagttgtctgcaaaattgtttctttgattcacaaactcttaaggactgccatttttgtgggatgggcaaatgggacagtagccatatggaaaaagaattgaacttggaatatgtaaatatatacatatatatatacatatatatatatacacatatgtacatatatgtgtgtgtatatatattatactacatatagtattggatatgtattacatatatatgtgtgtgtgcgtgtgtgtgtgtatatatatatatatatatatatatatatatatatatatgtaatatagtattggggtaagaaatatctacctcagtgttttcttccgctgaaataagcaggtcttttattgacagatgggtccactgtaccaaaaggccttgcaattttggggaggtgatgaggaggtagaccaccaggttactactaatcagcctttcttttcccttgggttgggcatttttaaattatttaggatctcagacaccaggtatgctaatctctagacaggatacagctttgttgttgatgttattttgtggtgatggaggctggacccaatggtccatcgatgaaccaacctggaaaagtgtgtatgtgtgtgtgtgtgtgtgtgtgcgcgcgcacgcgtgctcgcacgcatgtgcttatgagcactcatagaggtaggaggtctgtgtggaggtcagaggatacctttaggagctggttcacaccttccaccgtgttagaaatctctctgttgtttctgctgctgactctgtctgtacaccaagctagctgctcaacagaaattcttccatcttcacctcctatctccaagtaggaatgctggaattacagacatgtaccatagcatctgacattttacaaggcttctggagtaatcgaggttgcagggctaatgattgttacctgctgaactatttttctagacccaaatttatatcttaggatacttgacccaacagattttcaattaagaatcactattttttcctctgaaaatctaaattttttccttctctctatttactaaataccttaattttatttatgattcagagagatttatggttcagtgagattctatttactcccaataggttgtgatttctgtggtagtccactaaagactgcatctttacaactgataatcctcccaaaagataatttttttaaaaaattacttttaaatcacgagaaagaaacatatggtggtttgcccccacctgaaaaaatgactaatatccaaacagaccaagtgagttagtcagctcattatgtatgctcatatgatcaagtctataagatgtatttaatcaacatattcttcactgattccatattgaaatacttgagctctcacatgccaatagcttttatttagagtcaacagttgctgaaaaagctcttacttaaattatctatgggaacaggaatgtaaaaagaacctggattcacttcctttgtagctgtgcctccctgtcataggctaagacttaggcaccgggctcttttttaaagcataatgtacatgaggaataaccaggactgtagagggatgctaaggtgaattcaaatgggataatgctggagaatcccactcagaatggagttccacacgatgtaaaacacactgtaatgtgggcaaagggattgttcctacagattaaatgcatgtctatagaaggatcattgtgtttgcttcagatgtaatttcatgcctgaaaatttacactgaaggaaaaatggtctggatcccattagccagggctctgttttgctgtcagtttaattaaatggaaagcgttggcaagagccgcagaggttcatagaaatggtacgattttgtatgttggaacaggatactaagaggtcgcccagcttgaaaaggataccaaaaaaaaaaaaaaaaaaaaaaaaaagacctgtgactcagttgtgtttacagatttcctccagtttacaaggagctcagtgataagcaggctgtaataatttataggtactgtgggggacaatggcatgaccccaagatagggaatgctaatcttagggaggactgatgtagatgtgacttggctctaaacaataggaggagggaggaacactttctttaacaaaactaattgtttcctttgttttatggatccatggggggtggggagggcggtacaggactgcttttaaagtgtgtgtgtgtgtgtgtgtgtgtgtgtaaaacaaaagaaagaagtaagagaggggtggggtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttcccttgttcagttcaactttattgcatcttgacatcctgtcttgtaattgaatagcaaaatctggacctagctcagaaaggaagaaaagttaagctcttcgtcctccttttcctcctcctcactctcttccacctctcctcctcctccttcttaccctcctcctcttctttctattcctcccagctcctcctctccctttaccctcctctcctcccctccctcctccctctccttctcctcttcccctccctcctccttcctctcccacaaccctcatattgaagagaaagggagcccgtctccaggttttatctcatctacaactcccccccaccaccacctttgaactggcatccaaaagtagtgaatgtttgactttgctgaaactccatggctgcccttgtaccttgtactgtactgagggagctgatgtgtttgtgcctattctaataattcagtcgatatgggttatttgaagaaaaacttttcaatcttcagtttgaaaaaaaatacttaggtaatgaaagtattttatatgatacacataattatgcttgtggcaacccccatcaaactgtctgacatagaaagtgaacctccattaaggtatggcattggtagaaatgggaaaatgttattttaccactgataatacagaatgcttaaaaggttttgtaaaaataaaaataaaaaaataaaaagatactatcagaagaaaaaaaaaaaaacacccggtaccagcaacccataaatctaaatctaaatcattattttcccctttaagttggcacagcattgtcattattgttaggagctgaatagagctgaatatattcactggattgtaactccctgacaaggcatgttgtgtgggatttaatcagctacaatccataaaagttgggcctcttactcaaagccgtgtgactaaatatttgaacagtggaatattcaggaatctgcaggagggatgctttccctctttttagttggccaggtttttttcttaatttgttttaagtatgcctatttcgtcttagtaacactaacgaccacttgttatgttcaaagaaatactgtgactgagaaaaaaaagagttcaactctcgggtgtcatctaacatcattacttacatctgggttctcaggtgtgtctgcctatgtgtgagtgaggctttcttctattatctcccctacttttataccctctttccacaccctacacaatgcttccatgcgcagcatcttcgaatttctggctcaactgtcttcactatgatgtaatttagttaacgattcatagatttgagtttgtttcctcccaagcccgagctttgactatgtaggtttcagagatacctgtcacttgtatcattgtatgtcctcggggaaaatgccttgaacagggtgaaggtggggaggggctcgtaaggtcaaaggtaaagtagaattctgaggtgtctgctaaggggtggtttaataatacacacaacattttcagtagatactgtatgtcctggaacagttcctaaagccagtggtcttcaggtttcaaaagaagcagagtgacagagaagttgggccattgtgggctggtgtgtgctgcatggagtgaaccttaagatagccaggtcctagaattaggtctccagaagtctgacactgaggaaagatagccctgcttctccgtgtggttcctggctctacctgccagaagccccgccccttttagaggatgccccgccccttttagaggatgccccgccccttttagagggatgccccgccctttagaatattctagctccacactgtgggtatgcggacagaaggctcctgggttgtctctgagcacacgcgggtggacatggaacagagctgaccagtgatataggttgggacccttgtggaagggttggttaatcgctgtctcagccaattattgcttatcccgatgatgtcaccacagtgacatcagagggtctagggtgctgcttatgaaatactcggaactgaaaacattccttctgcgtttagcatagcacttcaggtgaggataatgtggactttcaataaagtgaggctgctttgtgttgctttgggatcctaaaaaaaattgtcttttttttgggggggggattacagttaaattaatgcacttacacacgcacactccatgtatcagaacgaagcagcacagggcacaggagacttttaatctttactactgactttctgcatgtacaattttgtccaaaaagtataatttataggcacagccttgtaattgtgcttatgaagatgaggcaggaggatcacaaattccaggctaacctcggcaacaccatgatttctggtccagcctgaactatgcaaaaaagaccctgactcaaaagtaaaacataacgaggatgatgaagatgatgctaatgactacaacaatgctaatgttgatggaggaggagaggggaggaggaggcagaacagggagggctaggagcttgaggtggaaagtatgagttagcagccactgtggggctggacttttaggctcataaaaaagcttgggttggtcttttgaaaataaaatgagatattccagcagctagtttattttaatttctcttcttttccagttcgtgacagtatttcaaataattaggctgatttatgataacagatagcttggagatgtgggatgcctctgtagcacagggccagtttattgtatctggccttatccaattataaaattgagtttagtcatgtaatgttgccctaactaaaatatccatcactgcaagccgactttctcaacattgtatacggggaggcagttttgagcttctcactacgaggcaacctcacatgggactacagttacccagctttctcccttaacatgtaagaacataagaaactttagctaagtttagtctcctgactctaatgcacatgtttggtgacagcagtcagggaagctctggtgacgagcaggaaggatatgatagactagggtaattatttccccaagaaaatgaatgtgcggcgctgtttgtacaaataacataaagtgattatttgttacagaacaataaaaggtcgtatttaattttaaacaccatcccctgggaacttctgggtattttgggttgctaatccaaagctggcttgttgttatggttaacaacagcatcttaagggatggaagggtgggggaagggaagagagggaggctgtggcagcttcccttcctcattccccccactacgagagaatgtgggacaggaatgctgaaatattcacattggaatgaggtttgtatttctctgtttcccccccccatattgttcacgtgactgtttatttacaataatctgagtaatctcagaattcctcttcaagtttttttttttatgtatttattttatttttttttttttttggcctggataaaaaagtacagctctaaaatatttctcctaaaataaatccgagacggtctcatttgcagtcagcagggttgattacttgcagacacactggaaatttacatgcgcgtccctccagtatagaccgctgatctgctcagatcattacggctagtgcttggctgtgtgccaagaggtcgaaatctgccgttgtaaatcgtgagttgaaatagcagaaagtagatttgtaacttaaaaagtgtaaacagtttggagaatgaagtaatttcagggtgtgattgattgccttctgattgtactttcaatgagcctggggtctccagggcagatacgtgctgtaactgcttattatacattttcggttttccaggcaataatagcattgttgctagacttttaaacaatgtatgcatctcctggagtgaccttttaggaaatgaatagttttattgtatgtccattactttgcctgaaacaacgtctttgagttattaatttgactagttccataaataaagaattcaaaacgcaaagcagctgttcagcccagagcacagtgtggcacgcgcgggcttcacaaccactgtttgagatggacgacccaggaacaaatggtttcgtgggtgataaattagtaatgtttctagagcccgtggttaccaaagattagcctttcagagctgcagaggcccagagttattatcaaggaggacagctcatcagtggctttccacagcactgcaggagcagctctgcctttgtgaggcatttcagtgttgtggacgacatcagtggagggacaagtaatggctatgtagaagatagatagatagatagatagatagatagatagatagatagataataggtgggtaggtagatagatgatggttgatagatacatagatagatgatagagatagatgattgatagataaatagatggttgataatagatagatatatacatagatattagatacatacatacataggtgatagatggtagatacatagatagacatgtagttaaatgataattgatagatgcaaacatacatacatacatacatacatgacagaaagttgacagaaataaataataaacaaaaagatgcatgattgaggatacatacatacatgatagataggtagatagaaaaccagagatagatagaaaatagaagatagagagaggtaggtagatagattatacacacacacacacacacacatatgtatatatatatatatacatatatatgtacatatgagtaagtatatatatatgtgtgtgtgtgtgtgcatatatatatatatatatatataatgatagatagatagatagatagatagatagatagatagatgatacagaaaagtcagagatgtagtagccatggtggggctcaccatagccccattggtaaagtgcttactgagtaagtatgaccccatcatctctgtaaacagacagatgcagcagtgcatgcctgcaatgccagtgctgggaaagtaatgtaagggattctgagtgaatgtatgtgtgagctcgggtaccatgaagagactctggcgtaagatggaagacagcaggcatccacctctagcctccgcgcacacacaccccaccccacaaagcagaagaccaggtgtgtgttctgctgatgcagctgccggatcacccagacaagtctttgtatctttggtcctctttcccccatcagtaaaatgggtataagcatgatgtttgaaacattgttttgagattcaccaaaacggggaggattttgagagtgctctgttgactgagtgccctccttgccttcccaaggctactgtgtggtcacagcacaggctttgctcactgcccatctgagactgtaaatggctcacaggggtgtgtactctgagaaacaatcacccactttcacagtcagaggccccagaaataatctgcatgctaacattagtactgtagtttcttttggttttgttttgttaaataaaaacaatttgcctgaatatagcaaaccccccctccttttctgtatttgttattccttgtttaactccatattttttggaggttcacattttgttcccatatttagagaggaaaatttgcagctcttaggcatttatcggagcatttgctacatttcaagtggtggctccaggaacccagtggcaaaaggagtgcagccatactttatagatgttcatgtgggatttgcctgtagaactttcttgacttgtgcttgtcctttgcccggctttctggtttgatatccctacatgttgctgtcaaactcccgaggtgtgacggctactacaactcaggagctgaactgtgaatgcttagattgcctttgtttgaatgaattcaatctagatcaccatacatagctagctaatattatggtgtggcagctggggaagtcaagacacccttctttaattacaggctgggaaggtaaagtggggtattctgtgagtctgaggaaataaactggtgagggtttctattctcctcaaggaaacactatgtcaaaataccaaaagttagtgtttgaaggagtagggaagaaacggaggggttgctttatagtatgtgtgctttctagaaggtggttggtagagacggtcggacaaagtagagataagcgaatatcaggttgaaacagtgttttagcctagcaggctggcaataatgacagccctttgaaggcaaccctccccatctggctggaaggaagactctgccaaaccagcttcggaatgttcctttggcgaatagcaggagatttagggacgtaggatttagtggacctacatggtttgaaggaatcaggatgcaacatgaagcattttcattttgagttgttcaaattcattcatgtctatggaatagagacctcccagaaatgctaggtgtgaaatcatgcctacagtgtgccagcactgtacctacagtatgcctacagtgaacctatagtgtatctacagtgtgcctatattatgcctacagtgtgcctaaccaagacgggagccatgagtcctgcatccagcatgggtggggcctggcccacgaagggctgccttgaacatctgtagcattagactaacattccagccactggcttcctacactcaagatctctcctctgagaggggaagcagcccttggcactgcataacattcaagtcagaagacaaggccattagacatcatggaattccaatctatgcatctatctatctatctatctatctatctatctacctacctacatatccatctatctatctatctatctatctatcataatcccacaattctacgaagaatggctgccgatgtgaattataggggattttaaaagcatctgtgggaaagcgagaggaggaatgggttttttcacacacggacaaagaccatcagtcccacctgagaacttccttccctctgtagtctcaactggggctttcttcttgacttttctccctctacggagcccctcctctggactaggacctagccctttcaaatgtgctctttcagctccaggcccgctggatacaagggttcccaaccctttttatccgggagccatagcaggcactgtgagcggctaaagcccacagtaactttaaggccccaccaaacaatgctttcacatcttttcaaatcaggagaaaataccatgacctttaagtcagtaggggaagctttctgaatatgtactgtttttatagttgttgtttttagtcaatattttgtttctgttttgtttaattgacacctacactccagtgccccttccggttttttgttttttttttaaggcagagagtcagacagcagtggccacatggctgtctgttgaagttgacagccaaaagagctctagcccaaccttcatcttaagggaactccccacagaggggcgtggttttgtccttcttctgagacttatggaagccgacttaacctcttctactcattagcgatgtcacacgtcctgttttacccgggaccattgtgggctctcaaaagcaggagcagactgctgctgaccatcatagtcactgcatcctattcccgtggtcaggtggttagtatgtccatcttcttaccctaccgtcttttctggctgtgaagaattccttctgcatcctagatcttgaccttactagtttctactgtattcaagcttccctttcaggagcatttatatgtgtgcatggaaatacctatatctcagaagtgtcatagccacgttggccatgactgttcccatggccctacagaacgccacaaaccttaggcatccatgtagaatatttgacgacatatatgtttttctacccaggcagttctatcatataagcgttaaggctttcctatggaggagaagcaaagagggcaatggtgattctgggttactggaagtcgcaacgcggctaccctccctggctccacctccccatctgtgcagagaacaggaaatgaaaatgcagacatggcatgagctagcacatctctgcaaagccaaagcctgcctcatggctctttctatattgcttcttcccaggataccatctctactcctgcctttcttctttgatcattttaatttagcttattataagtttgtacaagtctggcttgtactgtgactgtatttacatccgctggtgtgttctctcttcttgaatcccaatattatagatcccctttcttcttcccaactaggtccccttcctgcttcgagtcttatttttaggttatactgtgtgttcatgattatattgagaaaacagtgttttgtaggagcctctcaatcctccctctcttaggatctttccaacccctctccccgctttgtgcgtgtatgtgtgtgtatgtgtgtgtgtgtgtgtgtgtgtgtgtgtatgtatgtgtgtgtgtgatggcccctgagtcgtacaggggtgattcggacgtactatttagggctgggcacttaacagtcattcattctcagcatgtcgccagctatgagtcactgtattaattattgcccactgcaaaaagaagcttttccagccgtgacggacagccgtactttagtagggcacggagagcgagcccccctcggtttcttcttaaaatgatttattctagagctgcttttaccccaaccataatgtaattgtactttaatcaatacaaaaaatgtctgtggaaccaggggagggctcgggaagagagaagccaggagatgggaacccttgtttacttatctctccgaaacaatgctcacgttaaaccacctgcaaatgaaataggattgttactctaacggccttggagaaatagctgcccattccagaaattcactgggcttcctatttccagtggcctctctctcttttttttttttaaatttattttatgtaaatacactgtagctgtctttagacacacctgaagagagtgtcaaatctcattacagatggttgagagccaccatgtggttactgggatttgaactcagggcctttggaagagcagtcactgctcttaacctctgagccatctctccagcacctccagtggcctctcttaaacacagaagcatttggtgggcaaggtaaatacctgcttacacttaactggcagctaaggattcgatggtgaacctagaatgagctacttcgtacaccctccaaggtagatggatgcttgatgcagcatcagaagagggggggtcttggctttccagggttgtgactcctgacctctgttccatatgacccttgcatccctaatgttattcctctgctgagcatctctcacgccagcaagctgcctcattccgagcctgcttgtgccttctcccttctcataacaggttttcctggctagaagcttctcacaggacctgtgaggagtagccactttagtgctctgtgggatcagaccgtcctggggtccagagtaaggtcaccttgaacaagctgcataatgtctctcaacctcagtttccttgtgcacgagtcggaagcagcaaacgcatccatccctcccgggcttgctactgtgactaaacactcactgaaggcttagcgcttgcctgtccagagcatatgttcaacgagaggcactgttttcctggcacaactgtgctcaataactgaacattctggctgggggcctaggatgtgattgtcattgtgtctgtaggtttggtgtcaagcgttgtgatgactgccatgtggataaacaccaggaagcacggttggcatctcgcaaacgggaccgtatcttacctggcgaggtgtgggagatcgtaggcaatgtttctgagtctgtcgcacttgaatgtggtcggagatgaaacaggtctgtcaagctgaagatctcaacgcccgcaatgtacatcctgctatccgggtctcttaacacctgtccgttacccgatgtttgatgtatgaagacgcattaaacaaaagcggaaacacctgaccagggtgtcgctgaactccattatgcctctgtcagcttcacccttcactaactagaatttccgaaggctttcgctacctgtctttttatcgtcttggttgaaacaaatggtattttatgattttttttcttcttctttcgggtttagaaatctcatttaaaccgacataatgagacactttagacaaaaatgtaatcattcgcacttcttcccgtacttactgtcacgacggggcagtcggggcgaacattcgacttattttcacacaagctctcatccttgctgtgcgctctgacgtgtcccaacattccatataggtgggatggctttgtgtctgttctaaacaattatgtagtagaagaaataaaaggactgttgtctgatgggatttttgagagaagcagaaatcttagaccaagcaggccaaacggctctcttttcaattctggaaagaacacaccgatggggtccaatgtaaagagacctatcatgttatcattcacagcggagatagatttgtctgttggttctgggtgttatttttaaatagctttaaggaattggtgagtgaagacatgaagatcgatcgtcttgtttcttgaaggcgaagaccatgaaccagtcatggttgcccgttttgcaatgactccataatgcttagagaagaacattctaacccaagctggcttggaggacaggttactgaggtgtttcttccactagtttgtgactgagaacactatctcagcacattgttagagaaaggttcttgagggttctggggcagggggtaagggaaagctacttggaaggatcgcttttatttttctttacacactcgattttaaaacacgcttgctgtaaggaaccagctgaggcgatatgttgctgttgctttagacaccatcccgtttaataaaaagagcaaagataatgttgaataagcagatgtcttgccaggggggaaagagctcccttcccggagatctaagaccatttgccccgacttcttccaaccgtgctcgtatggctacctcacagagtccctgtaacagttgtctctggaagtccttgaagtttcgagatttgtcaatggaacaagcatgctttgagatacccaggctgtttttcagagacctaggaatatcttgattgtgaggagtcgctatagtatttcagccttgaagtatcaggcagcccgggccttgtaaatgataacacccattttttaagaagctcttcatccacatcccacctgagggggtcggatatcaaaccaggtttaaatttcagttgaaggcagaatatattagtaataccttccgtcactgaaagaaaccttggctacttccaggtaccaagtgtgaagtctcaccttgctgagatgtggccagccaagggccagaagtgaaaatgagcaaggagggttcaggttaatgacagttcagccgatatgtcccagtttattctgcatgaagatgctcatagtataagtggcttatgtgtttgtatgtgcatgtgtatgtgtatgtgtgtgtggtgagggtcatatgagtgtgtgtgtgtgtgtgtgctcaatgcacaatgcatgtagagggccagaggacaacctcaggtgtcattctcaagagcatcacctacgtcattggcctggtgcttaccagttaagctggctggccagtgagcccctaggggatcctcttgcctctgtccccccagagtcgggataacaagcatgtaccgccatgccctccattttaatgtgagtccagtagattaaactcaggtcttctttcttacaaggcaagtactttactgaattgagctgcccccagccctatggtctatcttacattacaactgttgcactggcacatctaaagccctgagctctgcgtctcggcatctgtgtggcatcccaattgttcaccatgaggttcaggcactctctcagagccaccagtctcctctctggactccctcactgtcctcttctccaccgatgtgatgtaaaactgacaccctccctgagtgggtcctgccatgttaaatgttggatgtctgtagctagacagagtctggccctgctgggtagaaaccaagttaagtttatggactgaaagactgaacccaaggcattgttctcgcgtgcctacgggatctgtctgcctttccttccatggatcatcttctatccaacacccacaacgacctcatttgcccttgggaagaactgatgtggacatgttgcccagggcctgctgggaagaccgaaagcatcttctgagatgaaagatgaggctgaggttggcacctacggttcccccaatataacctccgggcttcttgccttcagggtttaaccaaagtgtgactgccctttgtcacagtgctcagcctgggccacagtgacaactctttgatgtcagcaccttcacgttctcatgcctgtaactttcctcaacatcttcctctttcctcttgaggtggcagcagcagcacatgtcccatccttgaggtctctatggcagtgtgacggtctctatgggattcgcgtcttatggcctctgagtcctccatctggaaaatggggctctggataataacttcccatagtatattctagaaaaggggctccagctttgggaagcccctcattcctgtcccttgattccttagcagtaagattgcaagcatgtgtcaccatacctaccaattttgagttttgtacttcacacgagttctggacctcaaacgcaggttcttattctcgtaggggaagtatttatcttcctggtgatttgtcgtgtaacacacttgtctccagagtgctttaagtttaaacactccaaagctctagtttccacccttcaaatagcccaaaatctggaaaggagagcccaccttgaacaaataaaagtaagcatagttgtgtgtttacagggtcactatagtatctttgaaattaagctggtgtcagtagttcaaataacatttttagaagtaatcatagaatccagagtgagcacaccaccacaagccagccggtgaatattttagatgtataggtcatacaagtgtctgtcacagccccttgactttgtaagtgtgcttttggaacacagacgtgaacagagatatgctaagtcaatgtgcataactgtgttacaataaaactttatccataaaaaacacacccaggactgactttggctcacagttttgttagccttgcacatgtaaatcatctcacggaaaaaatctaagatagacccgaaacagccatcagcaccataggaattgttgatatgaagtcacagtcatgtaattggagtttgtctgcacccatatgctacttggttactgcctcagtggtgagtaaaggtgagtaggtttggatgctggctggatattgggagccaaaaagacatccaaaaggagtgtctgtggctgggggatgctctataggcaatgtaagtgaaccacctccctgtcagacttcaacttacctggaactaaagctgcacagagaggaagtagagtggagctgtgtcatcaggtcccagtgatcttctgcatagtcctgggagcatattaaagatgtgaagtgttctctatggtcagtcgcctctttctatgagcttgagttgtggtttcattttccagtaggttttacaagtatctcctttaagacaataatattagtattacataatgtagggggaaaaaaggagatagaaaaatacccattctgactgactggtgttcgtcccaagtcaggacaggaaacagtaagtggtttttggaagtgacaccaggtacatttgtagcaaataccagaagaggaaagaaatgacacacagcacaggactctggaaggcttgatggttagaagctttctaaataagtaaataaaggtaaacaaacaagttgatacaaatgtcacatattttataccagtggcggtaaacctctgtaatgctccatcccttttaatacagtcccccatgtttctgtgaccccaaatcataaaaattttgttgttacttcatagctgtagttttgttactgttgcgagtcataatgaaaatatctgatatgcaaagtatttgatccctgcaggggtcctgacccactggctgagagccactagattataggaagcaaacggtaacagaaagggtctattaaaatagcaacagtgttgctatctcttggcttctttgggatcttgaatatcagacactaatctggccattctaccctacccttatgttataaactcttcacccagctgtgtgtccaaagctcctgttttcttgggctctaagacccaaaggcatcttgaagtatgtcatgccccaggatagccctatttccctgtggttcctcttcagagccaagtcatctaaccggacagtcttcaaatttgttctctgggagacacttaagtttttctgtccaacatggcagccaccagccatgtgctgttattaatcccttgaaacttgacttgtctacatctaaatatgctataaatataaaatgcactccagatgtcagaattttgttatgaagagtgtaagctctggcccaaatccttctgttttgatttattaaagtaatattttagatacttctaactagataaaataaactttaatgaatttcacctttctagtccttatttttaatgttaattacatatttgatttataggatgagtagtgatttgctaaaggcttttaaaaaaatcggtatattccttttcgtattttcaagtggttgtataaagtgttgcttcgtacatgttgagaacattaaatgtgatagagaatgaaataagacggtggttaactataattagaataaacatcgccaatgatgtggcaagattttacgttgtaaagtgtatatttagcaaagtgtaaaggttcccaaataaatcgcacaccatttttttaatccaattcatctaaaaaaaacaacaacaaaacaaaacccaacaacaacaacaacaaaaacctctaccaggcttgcagagctttctggctacattcgaaacgagcagcgtcattaaccattacggttctgacttttttgatttacagcaccctaacaccaggccacagtgccctaagcaccgccaccgtctctgcttaagagaaacatatacaagaattaaaaaatcaagagtctgtggcttgtggggctgagatatacctagcggaacccctcaggaggagcgctgggatttgagtctatcctcatcccagcaggatgctggctcctcaaggaggtgaactgagggcgaagatgcagcccgggatctgcccatgtcttcgatgggttcccctcagaaaccctgataaacccccccccgccccccagctagacattcacaagctccagcgctgatttccaatgagtcaccagggcgagaaagagacctttgctctcccttttgtgttgtatctcaggagccagtgataacttgagagaataaacgcaaccagcacagtgttcccgtttccttcggttacaactcccagaagtcagtgcgggaatctggacaatgcttacaagtttagggtgagagtccatatttcaagtgggaatacagagtgagacagaaagactgagacagagagacacatagggagacagacagacagacagacaggacaggtgcgcgcgcgcgcgcgcgcacacacacacacacacacacacacacacacacacacacacacacatactctcatatatgaaataactgcctaaattcatgggccttcttctggacaggtctgccagccacagacctctctcttcctgttcctttcgctctttaggaagagctgttgatttagagcccagggtgacctgtcacatgactgctcatcctctgatgtgagggtcatatgtttatctcaggctttctcttagttaattgaatttgttagcactcccaaaggtctgtagcgaggaaccaggacactgattctgagccctgcaggagtttatattctgcttattgattgagagacacatcttcacacaaatacaaaacaaccaagagcatattcacatggaaacctgtaacactcaccagaagggccctttctttattgtttaaaatatgtttaatataaaattggccattctagccattttagctagaaatgttaactgcatctttaatatcacgagatgatccctactctttatcagtagagcccatttgtctctccaaagctctgagcagttaggcagtggctcttccttcatccatccttacctccagcacttcctggggcctgatgacctctggcctcctttccatctctgtgaattaatgtgtgatatctgccctttgggtttggattgttactgagtatgaaataaccaaggctcatcagtattgagtgtacatcccagtctgctttctatggcttgaccatatcccatcacccagtcacatcacatgctgactattatatgtgtgtatcctgttctattgatggacacatggactcttccacattttggctcctgggagatgctgttatcaacactgacttataaatacctggttttgttttccactaccagtgttgtgccccagaaatggaattaattactgcctctataggaattctgtatttgaaagaaatggtcagaggcttctctaccatgaatatactattttacaccaatgtgtgagggtctaggttttttcacaagctcactaacacttggtagttttgttgttgtgtatagtaggcattctaatgaatgtgaaagaattactccctgtggttttgattcatgttccttataaagtcataatggtactgactatttttcccttgttccatttgtatatattctgtgatacaacatcaattaatttcctttttacattatattgacttgcatgacttcttcacatattctggctatgaatctcttaaatacacttatttatgtatgtatatatgtatgtatatatgtatgtatatataagtgtatgtatgtatatataagtgtatgtatgtatatatgtgcattcatatatgtatatatgtatatataagtatgtgtatatgtatgcacacatgcatgtatatattatatgtgtgtatatatgtatgcatactagtatgtatatatgtatgtatatatacatgtgtatattgtgtgtatgtgtgtatatatatgtatatgagtgtatgcatatataagtatgtacatatgtatgtacatatatatatattatgtatgcaagtatgtatgtatgtatgtatgtaatcagttgaccatgggtatgagtatatggatgttctttccaggctcctgttccttgttattaatgcatgtctccatctggatatcagtactacattgctattttatttacttcagtggagtgtgtgtgtgtgtgtgtgtgtgtgtgcgcgtgtgtgtggtggagcaagggaaaaggtaacagaagctgtcttcattttggatgctggttcagctaacaagggtttggattcttcctctataagaatgtgatcttagtaactgcagggcagattgggtcttgaagtagtaatagacctttgtaaaccgaaagagttgactttaactaagttcaaatgtgattggacagcagccttacctgggtggctaggaagtaaacagataagtcaacctccgaaaacgaatgtccagcttgaccttggactgggacaaatttaagcccagaacttggaacctgatgtgccccttctagttccctcttccatgagttcttcaaactcacttatactaaggatgaatgacttgcaataggttaaaggtgtttggaggtctgaaaagatggttcagcagttaagagtacttggctcctttcaatgggacctgagttaggttcctggcaatcgcaagaagcagttcacatctgcctacaacttgaggtccggttcaggcaaccgaatgccgtcttctggcctctgaagacacctgacacaggtgcaaaggtgcacacagacaaataagtgaaaatagcacaaacggtttttattaagaagttaacttgtttgaaagggaggcaaatttgaggcaggtcaggccccctaggttccagcatgtgatctcccaaggcttgcacttattgtataatccctgtcttgtatgacatttagatttggctgagatgatcatatgcaaatgacatgcaaaattctcaagatggaattcaaaaagactcccgaatgtggctttttccgctgtggccttttgggaggaccaaggaggtggagctgactggctccccagtggcttcatttgctacttaagagtgatgtctgcatttggtttgaatttagctttgtgatgttgttttctttctagagagacgaagcagtgtccagggtaaaaagctgatattcacatagcaatacctaattttatgtttgtgtgtctgtttaagctatgtcttttgatacagctggctacaatcctgggttatgtagttaaaatgttctttgttccatttgcaatcatgtattcttttctttctttctttcttttttcttttcttttctttttttaaaaacttttccagtgatgtttttgttgcctaccctgggaagatctgtttttccatttatcaaaacaaatggcaagctagggaccatttaaagtcgttttcttagttaataaagccaatctccttgttctgttatgttaaaagtacattatatttttattgccagttctgtgggcctgggtctgttttctgtctcagcaatctcaggcaggctgccccactcactcactgtgtggagaattacaaaatggttacaggcaggtcagctgacttacagtaccagcagccattctcaaaataaccacaacagtccaagcctgatgtatcatttacgtcacacactgttttcctgaaatcgtttgtggccttttcatttctattcctgatagaatcttgctcttggtcccttttaatcagacatttaatttgtttttattattaatattttccactacatgtcttggcctgcctccagtaaaacagctctgatgggcggggaggtgagggggggttaaacaaaaaacaaaaacctcttcctccctcaactatggttttgctgcaaatgtgttttgtcctttgatgtgtgtggactgggagaactaactctgaagccttgagagagatttggaaacacactgagggcaccccacatcaacacatagccacaaccaggaactgataaagttgatggacgactttggaattttaaaacggttcaacgaattctggctatttagtcacatagcctgcctgcatatttttcccccttttacaaatgtcttttctgtataatgtcttgtaattagaacaggaagtcattgagtaactgtaagatgaataaaaagcacttaacactgaaaggaaaattaccttccgagaaattatattcttttttttttttttgctctccaccctgcatgttacaatgttggtaatgatagtagcagctgtagctacccttatctgtaggatttttgtgcttgggttttctgaaattaaaaaaaaaaaatcatgttcggtaataatcaaagacgaatggacaggagataggaaatgcctaattatgacaaatattctgtcacaacagaaccgcaattaaatggaaagggtgtaattgtcaattgcagtaagggctggacggctgccaggtacgcaaagttgagggcttgcctttagttggttgctaggagcaggcaaaaagtataaaggtttcagaaaggaatgtctcctgtcggaaagggactgcaggctgcatagatcactgggcaagcccttcctattgacatgatgttgcttaaattgtttcaaaagtagacatcggtggttttttttttttttttgtaactctagcaaattcatctctgcttgggggaggggaccaaagaaaggaaactgtaggttgtctgtgaagcaaacccgaaggacattgtgtttcaaaccaaggctccatacagatttggaatcttttaagtgaaaaaaaaaatctttaaatgtttgtttctgttggcctccagacgcatttgccctaatacgattacgagaacgaaagggcgaaatacttggcagaattttcagttgaggtaattaggcacaggaaaggacatgcatattttttccaccaagcttctataaagtactagtgtgaagggttttatgaagttttttttttttttttggtttcaggctttctgatgttagacggtgatttttggtaaacatacagggtgatgtttcctaaacaacccccacccccacccctgccaggaggataaaattatgtttctgcaatattatgtaagagatgaaagcaaatttctctcctctagaatggatgttttcaacctcctgcacatttggccaccattaactattaagagagagagagagagagagagagagagagagagagagagagagagaagagggaaaagcattatggatatttgaaactctacgctccagtaatttattgtacttgacatttcatgcatctctttatacaaagacaatctgagcaacttacaggannnnnnnnnnnnnnnnnnnnatgatgtataagtaagggttttctaggggaacagaactgttggaatacacacatgcgtacatacacatacacacttgcacacacaccttcatatatgcacacatacatgcatacatgcacacacacacactcacacacatacacccctgctccccgagggacacacacacacacacacacacacacacacacgccatgagagccatggtgtacagctactgtttgacaagtcgaggtggagtttcggattataattacagtttctctgtggaattccatttgggagtttgaaaaatatatataaataagtgaaaaaaatgacattgagagaggttaacaaaacgtgtaattatgacataagcacgggattagagccatttcagtggagcattacaagatctgtactttaggtattaacttttaataggccaagttaaagttctctttattgaagttgaaatgaggtttagtcattgtgggactcttattccctttgaatatttaatttaaagctaagcatgttcacatttttggctggggaggaggacccaagaagtgggatgacattttaatagactatcataaccattgtttacagtgccaatcttgagtaccagtctttttctttttcttgttttccttttggcagattatattctactgaataaaaatcaagtaaaaaaaaaatgtgtatttaacccaaggaactagaatgttctagaaaaatactctgtacggttagttccgaagtttcttgtctgatgtgggtgtggttgaaagaaaatcattgttctgagaacactttgtttgtcttttgctaaacaaatgtgcaatttatccattctttgttcgcagatttctctactaaagtctcttgtgaaaccgaaaggggggactgcgtttattggtggctcttgttgcatgtatcggagtatttatgagtctatgaaaggagaaaggaggcatgggtctagcagcaggatttctgttaagaattcttgaaggggccatttgcttctatttgtttctctccgtgctgttgggaaatagaacatgccagccattgaagagtttaatgttcttatggctgtgtgagaggaagctgatttaatgtagaggcttaagaagccgttaaaggatcatagaacttaagatctgcaaggctcttgcgaagtcttaacgtccattccagcttatgcgctcttcttttcttcatttctcctccctggcgggctctattaacgtctataagggctgagggtctcctgggctctctatggtttatataaatatgaaaagcaattcctctgggaatggctaattacaaggttggatatttgcctccgtccaaacaatgccaaaattctggtccaaatgggtggttctgttcaagagcaatggagttagcataatttttgtcttggcatcactgaaggttgccacattagaccagaccccagctgtgcctttggcctcttggtgtagagagactttaatgagggaagaggggacagacaagagcattaggctggtaaatgtaagcttcaggcttctacccatctcctggttaggatgttgctatgagaaatttacattgatagtttaaatgtctacagtgagcattgcaggccttccaatcatgcacaaacttagccagagtgcaataattctggcttacaggtgggtgacgttatcagttctctgtgagcatgaattctccagttttacccggccaaagcttattatcttcatcctaatactataaattagatgataataataataattattattagttattattattattattattattattattattagaggcattttgtcataatgcagagttaaccaagtaagagttaaaaggttaaaaggaaaggttaggtttccagtgtcatggagataatcgcatgggtcgcaacttgagtttgtcacctctacattggggaatattcacaaattgtaattttgtttatagggtcttggtgaggaaccaaagactcactacctgaaaaaattttccctttacttcaatattaattttactctcaataccagaaatagtattagtgcgttttctattcttgagcacatcagctgtgcctgctcctttctggtttgagtgaagggtttgtctgttggcttgttttaatgtggtgacttctgtgatacctgccaacaatcacggaaatgtggcagaggcagtcaaacttaatcctagatcttattctaggccctagtagatttgaaaagggaaataagaataaaacacatacacacacacacacaaaagaataaaacacacatataactgtatatatgtaagatgactatatattaatatatgtgcacttgtatgttggtacacaataaatatttgtgtgtaatataacaaatacacatgtgtactattatataacaataatgttcatgtaactacatatgtcttatgcaatgtgttacattgtaatatggtatgatatataaatatatatcatgtattttaaatatgtagcatatattacatataagtcataaatacatatacagcatataagtctttaagtattataatataatacaaatctgctttaaatgcatgtaatctaaaacgcaagctaagtaagacactgacagtctatgcaaaccaacaacaaaaaatatcagactcagaattccttgtgtggaagtctagagtgcatgaacttgcccaaatggatgtaaaactacccctttctgcatttcaatcttacagaatctgagtctgtccttttgggtggtacaaagagtctaatcccattttaagtattccaggagatcttggacaatgctcccaggatagcccctgagaacactgttctttggcgaagtagacatctgtaggtcacctctctgtgaagtggcagtagggcttgctcttccaagaattaagagaagaagctggaaactgtgaggagggcagagttggtgttgggagcctggatgaggtacagagagcagaaggaggccatgtctcagcacagaaggttacctgagagatgattgtatcccaaacaggaaattagggaagagggcagagggagcaccattatgaaaagtactcaaggaaagttgagagaatgatgaacagaacagcaatgaggtagacccatgactcaagacatctctcaagacaccaattcagaagcagcttttccttgaacctccatccctggaaagcacagcgtcttcctttttttttttctaaaacacttggaaagactggtatggttgtcttatcttcccagaaagccaaagtcactactaaagtagacttggggaccatgaggtatttgcgcagggttttctatgtacagagagtagtataggtgctaagcgtgctcaacagagtgagctctgacagtttctgtctgtattctctcaaattcacgtcttgaacaaacacggtgtagggatataaataagagttggtaccggtggcacaggagctccttaggttagcgcatgtacagtgtgggcttctgacagtgtctcagtctacagtgggaatctcagcttcccatgctgtggcacactttgtagaatctcagggctagtgttcattggtagacttcttttccatgtagctgccctctaagtgtgccatctgacaaagtggcaggagtctaagaagggaaaggcatgtgaagacatcatgctagaagcagctgggcatctctgtttgtggagaagcctccaggctgaagagctaagggaatgtaattagagatacatttgggtgtcagcctcctgtgtacaaaggtcacaggcccaccttgcattactcctgattatgatccatcatcccgttctatcctaattcttctcccactggttaccagatgaccatgatagcatcagtatcctcaacaactgtctcacacagtcctctgcagtacaatcagggctcaaaacattatttccccactagacatacaaatgacgaatctgggagctgctgaccatcgtgtcaatggtgtgggtcatgaaacccaagtttcaatgtgacacggttacaggtgatggggctgccaaagggagcacttgccatttctcaagcttcaaaatgaaggaaggatttctccacatagaatctgggttttgcaaatagacagaacacatggtgggttatccttaatgccaaggtcatttaagagaatgactccctacatttcccgaaatgttctgagtgaagatagtcctgatgggaatgactctctgggatgtttggggacccttctcagctaggttaccatgtagatttgagaaacattaaaagacaggcagtgtggatgttgggggaggtggagacagtggtatcaatgaagttggggtaaatcatgctgtaataacaagtgatccccaaattgtgtccttataaatgatgcgggcaccatttctgctgattgcatctattttggatccaccaagacccgtgctgtcttaactccaagactcagactggcagaagactcgctgtctgagcatcacagccccaacaaagacaaagagatactgactgtagtccatggcacatcggcccttaaaacaaccaacactgctgccacaatggccaagacaagtccagaggctcctggactcccaagagcccaagagtaggatgcacaaaccttcctccaggcccagacagagaggacactgaatattgcctgtactccagagtaggtgacaacgctctaggggttccatgacaattttgccaacacacacacacactgtgtaatcaatctaagactaagcaataattatatagaaactcaacaaagtttccctctcatggtgatatcaatgactgaaaaatacattgaagtctcaaggaaggagtgttttagtttggctgctgccaagtgacacagacatcatttattttgtatgtccatgtggccccgaagtgaccctactcaggagtggcctcgggctttgagggtgggaagctgcatgaggaaggggaattctggaagattctggcattactagactgtggcaaaaataaggactgtgcagaagaaggtgtctctattgccaaatccaaagtgaccgttggaactaagtcatggctgtgaatgttctttttgttggtaggaagaagggtaattgatatgttttcttctctgtctaggggaagatgaggaagaaaccaacgtgattgtgctcagttacccccagtactgtcggtaccggtccatgcttaaacggatccaggataagccatcgtccatcctcacggaccagttcgcattagccctggggggcatcgcagtggtcagcagaaacccccagatcctgtactgccgggatacctttgatcaccccactctgatagaaaacgagagtgtgtgtgatgagttcggtgagtgcttctcttttactctgtttgaaactcgtcccaatgagtcgctgttctcaattcacggcgtgagcagtgctggggagcagggcttagtgtgaccacctacccccactcagaccccatggtttggcaacataaggtgtcttcttcactttcttggcggcctcagtttaccgcaggtgaacgatgattattttgtgttcgttgttcaatatatgcaattggaaggtacttggttgatcttgaaggtggactttgtgattggaagttgtcatattctttctttgagaccttgggttacttaaatatatatatatatatatatatatttatatattttccaattttataaggtactataagaatgcacaaattataaccattcaataccataaggtggagagagagaatagatgatcaatggattgttacatacatacatacatacatacatacatacatacatgaatggtagatgtgccgactcctttaaattttcacacatacagaatcctggcctagctgactagtcttgtgccttcttatctttggaaatctgtactgtacagtgcagtgcacaatgtgcagaaagctagctaagacatgatcatcttataccatgccttcttgagaagacattggatcatgtcagtgcttctccatcgatggtatgatggtaccctgctcaatttatcatgaggaccaaggaagagaagaggttaagacccccatggcctggaaagtacacacactgactttcttcaagcaggtttactggctgattctgtggtcttaagttgttcccaagaaaacctcatttgcagaatattcaaatccagattgtcccagttagctctaagacatctctacatggttttgtgcatctactgtggcctttcagatttgacgatccatgcctttgggagccctttggctatgacaaaggactgtgtaagtataagatttaagctcactggagtccaaaggcagagacaatgtgaacatgcgtgtgttaattttccttctacactgaagcaaatattgtcatgtttttaatagtccaatggccttttcattgtggcagatcaattatcaaatacaattattaaatataaatgccaatacaattattaaataccctttcctttcaggtaagcatttacaatacttttcaatacttgagaaaaaaaaaattcacccacattccttgctcccaagccctgtgacctactactacctgattcgaaggtctctaaattcctaacacagtataaaactgagtgaatgttttcccctacttaagagtattcagagatactgtttaacagtgtaataaaatggaaaaaaaaatggtttaacctttttggctaatttaggggtcattagccattgcgtttcaaagctgttctgtctaaagttggcaataggtatgcctatccagagatgatcatggtagttgttggagcattcctaaaggagttttaaatattcttgcgaacagaagcatctctctgtgaatgtgcttctgatatgtcttctggcatccctccttttcaccctgcctttctcctctagcctctggaaacagacagcacttaaaggagcttctggaaggcaggttaaatgagaagttttcaccagacagttacaagttccagtcctcaaatggttcatccttttgaaagtagcccatgctgacacataaagcatgtggcttaccttgaccgtctgagcactttcactccatatgtgtcccccacctccttgggtacacatccagagttccagacaacaactttttaaccctccagctggtagtccgtgccagtgacatggcttaaagtgtttgttaaaaatgtggtattgggtttctccaaccgactaacagttggtggaagaacatagatttaattagtgagtggcattaaacaaatgttcctaataccaagggctgccagatgactaaaaagcttctttcagataacccagagtgccagggggcccacagatgaatcttctatgctgcacattcagtaacttgagtaattggtcaaatataatttaggtaacagtatgcctagactataaaaatgtttttattagtcatatcaccaggtggatggattgtggagctgatggcaaagaatttagagcacttaacaactatgtctttgatacaaggaattccaaatagccaaaaataaaagattaaaaaaatacctccgagtttcttttccaaaggatagtatctgattgtttaccactggtgatgtttaatttattaactgatctattgctttcttctttgatatggacaacagaggggaactcaaaagagaaacccaatctggtccttgcttattttgagggtcaaaaatctaaacagggaaaacaggattaacatacctggaagcctaactctgttacaagaaagtcaggggtgggtgtcacagaaaacgattccagtaggaacatggtagtagctgggggtagggtagcattgcatgcttgagatgacagtcaggatgtagggtcaagggaagccttgcattcgatatgtttttttctatgtgtgtgggtacacttttgcatgtgaggatgcacctgcatgtgtgtacatagagaagcccaccgacaaccttggtgccatttctcaaatgcctgtcacctttttttatttgagacggggtctctcatttgtccagaactttgtccaacaggctccgcttagccagtaggcaagctccagggacggtcttgtctccgcccccttagctaggaacacaaactccactgtgctttgtgagccacatcacacgtgtgctgcatgtccaccaactgagtgctctccccatctcccttccttggtctagttctaaaatatggaggtatgtgttttagacatctgttagaagtaccatgattgttgttgattcaatccctgagtcgctactggctggggtctatgattggtttctcttaagtcattttgcccatagtgggggttgtaagaaaacttgaaagagagtggtcaccagagtgggaagaaaccagctttgaaataggaatgagctctttgagacagagatgagcccacgttttctctggggctcaccaacatggcttacctgcatggtcaaaattggtctctgaagtgaaactttgctttgtggagcagtcttccccattgtcgggcaggttttcccctccctgctatttttaatgttgtccaccgaataagagctttaattgaacaataaaagtgagccctttaaatctacaaccagtccctataaacaaattctctgtggaattttatgaagccgcttaatgaaaagtttgattagaaacgattaaagaaaaataaaaatggaggaaatttcatcatttaatccagtgttacagtagcgccattttaatttttatttacattgagatattcggaacggagtaaatatatcctggttttaattaactagcctccttacttggagaggttattttaggcttgaagggttttgataacatgccatctgccttcttgtctgtattatgcaagtccttctcttgcttgcagtgctgggtaatgtctaaacctatgatctgagcatattgaatcatattagtagtaggtgattgaacagcttcagccccgacatcctgcctgtattcgtccatcttgttggtgacacagctctaccgctgccctgtgctttcttagcacaaggtaattgactatttaaaaaaaacaacaacacgttagactccccattgaagcattatgaaaattcattgtatcgcacatgcaattaggaaatgggatttttaacaacaacaacaacaacaacggggagcgtgaagaaaatagcatttttttttcttctgaaaaatctttcccataagcatggttgctgcttccactgtcctgtgtccctcacagacattttcccaacagctccccttctgtctcttacctggttatgtaaatgagttctgttttgttaaatggcactctggcatttatattgtgtgtgctatagaggcaaaccactgggtgggggtggggcaaacattttgtctgtcctttgctgttagaaccataaaaggtccagcactttgtaatgagcagtgtttacaataccatcacgtcaattgatttcacatgtgtgaagggtggaccaactaatttcaaacagaggcgcacccagaacaacacaggaatgaggcgctagctttcaacagaggactgcaaaggtagccccatttaccccaatactgtggagacagtatttaagagtagggaggactaaatgtcttttgacgtggttcacttttacataaaagattttgtgtaaaatgcttgcgtgcgcatgtgtgttttgaattgccgagacgtaagaagcagaagtcgcgcttttttaaagttttttgtcagtttaggtatcttgtgtgtttctggacaagagtatggggcagggtgaagcgtggctttggtcaactgtgtgtgggacaaagagatgacatgggctgtcattaggtatttggtccttgtgtagacaccatgagctctggcctatagggagaaaaacttggctgcatttatgcttaggcagacgttccactggggatggcgtgtgggaaagggctacacactgaggtaaagagagtgctaaggcgcacctgcaaagagatcacgtgatcgcaaagagatcatgtgatcggggctcaaccatctgattcgctacagcaattgccatgaggtcccttacgtgttccatccttaaaaactggcattcccagccgtcttaccaggttcagataacagatgaaggttggagtgaggatcagtctcaggctgtattcatctgctccactgtgtgtgcctctgttgaatctggcttgctcacacttcacacatgtgaaaccaacctgcttctgcaggaatctcaggttagacagtgtgcgtgcgttcatgggacatcattgtgcttgctctctgaatcctaagggaatccgattcctagagctcctgggggcttcccgagggaatgacggtgtgtgtagttgtccacagctcacaggctgttttaaagatactcttctgagtctttaaagactcagatacttctgatactttcaagagtcttctgaattgaactttgccctttcccatttcctgttagttgcaatggtgatgttacagccaaaagaattaagagcaaagggaaaagacagagtaggagaggaaacgaaccttgattttttttattattattattattttaatttttaaaaattttaaaattatttattattcacgtacttattttttggtttttccaggctgtgcgcaaactcactctgtaaactaacctggtctcaaactcagagatccgcctgcctctgcctcccaagtgctgggcttaaaggtgtgccactgccactgcctggatgaagccttgaatttgggtggaaagcaattcaaaacatgcaaagtcattatgaatcagacgctgcctcttccccgcccccagatcacgtgatctgatcacatgctttgctggaaatgaagggaaggcagttgttgtcttaaggatcatggaaatttgcaagtaaactgtttttgcttccccccaccacccaccccctcttagtaaagtggctttcatggtcacatttcttggtcacagtggattctgatgatcaaatggttttgctccacgtttgggagttcaccgtctctggtggtcaccatctcccaaaggacaataaagcagtcatttgtctttaattgaaagtgattaggaaaagagggcttcaggcatgcagctgttgcacagaaggcctccaccttcaggaaccccctctgtgccctcctggaactttcctggagtctgtttatccctagagtacagttgtagcaagtcacccttctgctctgtgctctcagacaagaggcaaaagaaaatgtttacattctgatagcgaagcaaatccctgtaagtctgtgggtagaggcgcatctgacgcatcccacgtaatgatttaacacgtgggctccacccactgggctgtgggtaggaagggggcttgagaggggaccaccctggtcagagggactggtagcctggatcccaacccacttagggattcaggaaaagatattttatcttgctgctatgaattgatttagagtcaggtcttaaggaatgctgagaactaactcttgtctttttcttttgggagaacttaaaaggatatcttaaaacaactcggatggtttttgtagccgggaggactcagagagttactaaccagttaggactcacgggtgtgataaattcacctttaccccagaaggaagaggctgtctgtgttgactaacccttgacctagtatttcatctagaaagtaaccgattctccatgacaaaaccaagatccatatattccccactataaccagatttttttttaattaaaagggttgactaacccttgacctagtatttcatctagaaagtaaccgattctccatgacaaaaccaagatccatatattccccactataaccagatttttttttaattaaaaaaatcatacgtgtttgtgctgcaactcagttggtggcatacttgaagctctgggtcagtctgtagccgcacattgtctgggaatagtgacacttgcctctgattccagaatttggaagctagacgtccaaggaccaggagttcaaagtcacccttggctaccttgcaagtttgaagccagcttgggatatattataccttgttaattacacacacacacacacacacacacacacacacacaagacctattgttaatacattatgaaaagtgagggtataggaatgagtttcaatataaagctttctttgctctgtttaaaattcttcttggagagccgggcatggtggagcacgcctttaatctcagcactcaggaggcagaggcaggtggatttctgagttcgaggccagcctggtctacaaagtgagttccaggacagccagggctatacagagaaaccctgtctcaaaaaaacaaacaaacaaacaaaaattcttcttgaagggctggagagatggctccgtggttaagaacattggctgccttttgcagggaatccacattcagttcccagcatccacaaggcagcttatctataattccagttctaggggacccgatgcccttttctgatctccatggcacacagatggtatacctacatacatgcaggcaagacacacatgcacataaagtaataaaaacatttttaatcttacttttaaagatttgttttgtttttaatcatgtgtacagtttgtgtctttgtgtaggccacatgcgcgtgcatgtaagtgttcttaggatctctctttgacaatgggactgaagtcaggtcctctgaaccctgcttttaatcaatgaatcaccaccaccaccaccaccacaacaacaacaagaaaaggctttctgatccatggagatactcactggtgtaactcatggtgccctgtcaggggaaattgattcattgattttagttttccccttgttgctgagactatttggagacacttaaatcctagcttcagtgagtgatgtatggcacaatcccacccactcattcagggggtctcgttcttattttgccaaacatagttctgtttctggtaaatgatcaagaccaacccccggcccccacccccaggtctcacactgttcaccctggagtctatatggacaggaaaatggcaagctatagcgtatcttagtcatagcatagtagttatggacgacaccttattggagtagacctcctagattgccgtgaagatgaatgcatacctacagaactcttccttgtcactagaaccttctacgccacccaaacacaaccacagccacttactggagtctaggtgaaaagacccacaaaattgttttatttctgtggcaactccttgggaaaatgagctaggaggtggtactaaaggtcatttaacatctgttctagcaagaaatactcgtttgcctgtctgtctggaatgtgtgtcgcccccaggcaccatgagtctcctcatcgtcactcaggcctctgacctactgtctcctccccagagagacagaatctggccttccctcttccacaagtccagctcaatcccttcatccagcatgttattatcttcccacaactcatcattatctaaaattactcctataattgtttatttacagatttaccggctgtcttcccactctctatacacactaatataagcccttcctcacggacgcaacaccgtttctgtctcattcgtagctcagggaccaggagagcggttacatgcagtcactgtgtaataaactctgtgtaataataaaatgagtgaacagacacacaagctctgtggacactgttcttccgcagcttatgaataaagccatcggagtagggcaatgaaacccagccagcaagtgggtagaccgggatttgaacctaggttgcttgactctggtcctgtggtgtgatctttccccctcccacctgactgcctaagagtccagactctggtgagaaacagtgtgccaaccacttgactttgggacaactggaagcagatagctgaccaccatgtttctacacaagggatttccagtggtgtccgtggctttaagtgcagagattgagagaagtgggactaggtagaaaacgagggatctggaggattcagaatccgaacagcattggtttaggatcaagccatggcaccaactactaccctgtcccccaggtgatcgcctctgtccctgcctcagctcatgctatcccctggtctctgccacacactgcccagtgtttcctctccctgacagaggcctcagaactcccttgccaccggagaagctgcaatgtaaggaccctttaagagatggagcagtttgcagttcagaggttgcaggagggagggggagcattagagccctgtattctcctggactctgggccccagactgccaggctaccagggcttgccccatacacctctctgtaattttctgcttagagcacctcggctttcccaacttggcaccattctttaatgaaaaaattataggcctaattgaaagaaagagagaaagaaagaaagaaagaaagaaagaaagaaagatagaaagaaagaaagaaagaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgggtttgcctattcaggctgccttctcattggtggctggctgggccacagttcctctatctgggctctctactctctttagaagctgcacagaaacagcttccccaaacagccatttttctctcacagtctccattcctttccagtggtcgtcttggaggactggagaacaggcaagatggacagaaaaaacaaaaaacaaaaaacccagggtgttctctgggtccttgttgctcatccattctctcactgagcaccagctgggttcaaaggaaaactctgggcattggtgagataccaggctctatttgcaaagcatttaaaacttaggttatgtcacgtgagacacagagtgatggctcactgcaaatactgctttggatccccttgttagactcacattctacctctgagtggcctcagagactgagcaattttcacagggtcacaggcccagtactgacgtagctttgttgaccattctcaaccggcacacagaccgataacatggagtctcctgtccagtcagccccagccaacacccacactcaggcctgttcaccctcaacacacatgcacacacacactcacacacacacactcacacacacacacatgtctgccaacacattttggctatagaacaagaaattgtgaagagactcttccctttgagggccaaaggagatgacatgagcaaagttggctgagtggaaacttttgaccagacagcaagcaacctttgcaagatattctgctgggtaaatggaagaccttctatcagatccacagtatacctgaagcagggcctctggtgttcatgtagcctcttggggaggcggatctctaatgggacctggatagatgctgttgcagaggaggaactggaaaggacactagacttgaagctcaaagagttgttttctctactgcttttagcttttagtcacaactaaaagcatcccccacaagcaaacttttcccactaaaagatgtcgtcttcccctgagaagaacatgtgcctcctgagtctctctctgagaccccattgtggttaaggcctctgagaggcctcttacaagaaaccctgacctgcttcttactaacttgggtccttcctcagatctctaagaaaggatgggagggaggctgctgggttaattggctctcttggtgtactgcctcctcaaagggaggattccaggcgggacaatgacttcagagtaattatttctatcattgtactctatgtcctctgttccttgttactcaacactttcccaatgctttttagttttaatttgagtgcccccactgtgtgcacatgagtacagacgtacctctgtgtctgtgccttgtacatgcatgtgaagacctgaagcaaacctcaactgttctttaggagccatgcaccgtattttctgagagagcgtctcttcttgacataggtttctcacagtcggctaggctggtggactagtgaactccaggggtccacctgtctccaccccggacccccagctgtagaatcgtaagagcacaccattctccttagcttcttacttgagtactggggatcaaacagcgcttgagagcccactcccctctttgttaaaaataaaacactacatattgacttgtggaaaggcgtacacatgcccctacccaagtgcgtggttagaggacaactatcaagaagccctttctccttgtatcatgtaggttctggaaccatgtggaactgagggtggtagtgcatggctttacccatgtcaaaaaccatctccttgggccacccactcccattaaacgtttggcttgttaaaattatcaggcttacgtgtctttcccccccccccccccccgttggattctaaggtcctccaaggagttagaatcaagtctactgtgtttggaacaacatgtttgttgaaatgatagagaaatcactactggattccagatggtttcagacctccattcattcttatctcctttcttagataagtcaagtatttatggtcctcactctttcaacttaagctcctggtggactgaattctcaagggaaaatgttggctctaagggatttccctccccctcagcatttatttatcttttcaaagcccagaagtgttctccacaagttgactgctgtctttcactgagggttgtctgtttgcaatgatgtttagagaccctgtcctttcccagcactggcagtgtgctcttgtctgttttgacagggtattactatgaaacccacactagccttgaactagtaattctctggtcttaacttcagtgctaggattttacctgtgagccaccatatctaacttcagcctgtacccttaatgtcagccccaactctcgcctcagggtttgagggcatgccatggtcaacacagtggccatatcttacggagcaaaccagagttcccccctaacagataacccccctttctctcatctccatatcataataacttagtgaggaaaagaaaaagagaggaaaacagcttagacacctttcaaactgtttttcctcactacggaaaactatttctattatgagaaagaactaacataataacaacagttgccagtcctctgtgagtacgcgccatatgcgggtctctatgctaaggcctctccacgtatctgatgacctaatccgtacagcttcactctaaggaaactcccactaagcccttcaaagtgggggaagacgccagttacgaaaagttaagaagtggtcaggctggattctgactcatcaaagctcccacgttcttgcctttataaatgtcatttacgatcccatcagtatctcaatcccgcttcccaaaagtcatcaatagcccccagatgtcaccatttgtgtatagagttttcttttgttttggttctttggttggggtggtgggggttggaagtatttccagtaacttgagaacatcctgtatcccattttgccatctttaagttttccttattataaaataaacattcgccgcgttaaacacttggtgagtaccattttaatggtcgttcaatattgcgtaaaatgagtttattgaagttcacatgacctttctatttgaagtttcgatcccttcctctgtggctttggtagtattacgacgtgttatgtgcacttaacactgtcctgattatctttaagcataaaaacgtcaacattgagatgacttcctccggagagaccctcaggatttctactgccagggttactttcccataagcaaaggcatagatgtcagctactcagctatgggtttgggttttgtgtggctataaccttggacaagaaaatgagtgcaggcaaaaagcgatcatgtctcttagaatggcggctttcaaccctcaaatgcactgcctcggtgttgtgctgacccccaaccataaaactgcttttgttgctacttcataactataatgtctgtgctttccaaagatcttaggggactcttgtgaaagggttgtccaacatccattggggtcgagacccacaggttgagacccccacatggtagggcacctactagacctgtggttcttgagagtttatctttgaactctcagaatttggatgagtaatatcttggtaccaaaatgttttacacgtcaaagcgcaatatgcctgcgatgtagttattgtgagcaaagtgctgttttgaaaataggcattatggaagagctaaggcacattaacatatgcatttccttgtacacttaatttttttttcatgacaagaacatagctatctaccctcaacaagtttcagcaatgaaagaacagtcttcatagccagcgtgtctgtgataggtctcttgggcatggtcctcccatctgattgaaattctgtgttgatctgtatctcctagcttcccatccatccatccttggtccccatcatcctactcggcatttcttcacctagttttgttagattctgccaataagtggtgacaccatctgattgtgtttatttcacttagctcaatttcctccaagttcatccatgttgctgcaaatgagaggactttcttggtttttaaagtcgattagtattctcatgtttatgtacacacaccgcactttccattatccatccgccagctggtcgtcattgacaggtatcgcttatgtatcatacataatgtaacagggagcctgggagtgtgttaatgactcgattttctttggatagacccagtaatgggactgatggactccaccacagtcctgtttttaactttttttttttttttttaaagatttatttatttattatatgtaagtacactgtagctgtcttcagacactccagaagagggcgtcagatctccttacggatggttgtgagccaccatgtggttgctgggatttgaactccggaccttcggaagagcagtcgggtgctcttacccactgagccatctcaccagccctgtttttaacttttttgaggaaactcccacagtgtttctcctaccaactcgacaaacttacgtcccccttgtggctaacactttcatcacatcctctccctgcttaagaccgcggcatccctgtagaaacagctagggctctctgttcacaaagggaacagagaacagagctgacaaagccatcacctccttcctaactggcccctggtcggagacacggaagaggtgcagttttggtgagaatcggcattgggtagaatgtggcagtagaaactggaagagttcatttagcagctacaggttccgttaaacgttttattttcttggatattttctttatttacatttcaaatattttcccctttccagatctccccttcagaaaccctctatcccattcccctccccctgctccccactcaaccactcccatcctcccaccctggaattcccctacactggggcattgatcaccctcaggcctgagggcctctcctcccactgatgtccaacaaggccatcttctgccacatatgtggccagcgccataggttgctccatgtgtacactttggttggtggtccagtccctgggagccctggaggggtctggcctgttgacactgttgctccctccatggggttgcaaaccccctcagctccttcagtgccttctccatctccttcgttgatctctgagctcagtccaatggttggctgcaagcttcctcctctatatttgtcaggttctgcctctcaggagacagccatatcaggctcctgtcagcaagcacttcccggcatccacaatagtatctggctttggtggctgtatatggaatggatccccagatggggcagtctttgggtaacttttccttcagtctctgctccacactttgtctccatattccctcctgtgcatattttgttcacccttctaagaagcaccgaagcatcaacattttggtcttctttcttcttaggtttcatatagtctgtgaactgtatcttgggtattctgaacttttgggctaatatccactaatcagtgagtatgtgccatgtttgtttctttgtgactgagtcacctcactcaggatgatattcttaagttccatccatttgcctgtgaatttcatgaagtctgtttttaatggctgagttatactccattgtgtaaatgtaccacattttctgtatttatccctctgttgagggacatctgggttgtttccagtttctggctgttataagatttttttccctgggtacacttttagagccatgaccatggagacctcaaaactatgtttgtaattaccgagaagtttagaaaaagctacaatggaccagagaggacacttctctgtatattcaatatgaaggtaccaaacaaggagcctgatcaactccgtttgctattttacatctccatatctcatctagagaatgaaatgttagacatgtttttaatggttttggagacctccggtccttctgagactctgatagaagcttcaagtcatctcctaaaaatattcatgccagcataattattacaataatggctttgaacaaggttatttgcagaaattaatgcaacaagcaaatgtagaccatcctgggtgatcttttcataactgaaggagtgtatgacacccaagatgataaacccctgatcttccatacctcacacacctgcttgctattggtgaaacaacaacaggcctttctaataactctccataaaatctcaacaccattagattggttggctcatttcctgagaattctgattaattaaaacagaatgataatgacagtatctcatacctcttattgaaagtttaacacatgtcaggaactgaggtataggcttaataaagtttgtgtggtgtctgcctaagaaatggtgtgtatttaattagctgaacacttagcaaacccaaccttacttaacctttagttgagtacctactgtggccattacctttaatgagcacctactgtgctcattacctccattgattttcccagcagtcttagagagagagaaacaaacagacagtgttgttgaaggaagtcattccacatgctaataaactgggtgctgggattcatgctatcctgttccttttagtagtctgctaactactctcattcattaaacagtgagttcgagaacctgacttacacccatatagggaagccagaggtgttcttcatatgaacctgcatcccttcttctgacttcaaacctgatctatctttctcttaccctcgtctgacagctgagcatcggttggaggtgagaggctaagttggaagatgagaggatgataggacgtcttccattcactgagatccaccccctgtgtgctgaggggtcagtacatgagggaaaaactctcacccatggtctggtccagtttgcttgcagcttcatgttgagacataaccatacttaagggcttatatgttgttgttgttgttgttgttgttttccctcaaggatggctgacttagtgtggtccataggactgataatatttattctctgttctatcctggggactgaggggaggcatcagccctctcatgtagaccaatggagtgttatggttcattgatcctaacacctcttcctgtagagacatcattgttacatgtaccatctggctgatacaattgcattgtaattgtatcattgtaaatgtaaggatgaaacccattgattgttgcatcattgactctagagacaaaggggggaaaatgtgcattgaaattcagtatcttgttcggtgacctgctagaggcacttaaaggggggaggggactgtaaatatagcttaccccaaagacaattttctgtagttcataagttggttgacatttcaccaagcttaggacaggccatgtgacaggacccagtgaattagaaccatgctggattttggcatctgtcttcccagcgactgttaccaataacatgtagaaatattttggcattttccttgatactattttcaactcccgttagtataaatatttagggtgttttagagaggtggattgtacggcaggcacatcgttagctcttttatctcagggctggactgtttgaacagtgtgcctgttctctaaacgtgttaagaggctatatacaaaaggctttgtggaagtttgaaatggaagcttcatctctcagatgttacttatggccagattctcaccagtctacaaagtatgcctaattatacacaaaggctctgaggggaaagagcaaactcaatattacagtagaaacttcctccaaacaacagcaggactctgggtcaagggtagtggcaataatcatataacataaaacagcctgcatttcctgtgtacgcacgctggttagtatgtgtgcacacgtttctagaaattcagaaactgcccagggcgtgtacgtttgcaaaagtaaggcatgctgttcggttctttccctgatcccacctcctttcaaaaatagaaactccgaagttctgagtcaggctacagattatttggctggttcaactgtagagtaagttattaatgacacccagatgttgtttttagtgattggatgttttcggctgtgaaataatattttcttgtgtgtgtgtgtgtgtgtgtgtgtgtgtgtgtgtgtgtgtgtagtgtgtagtatgtgatgtggtatgtgtgtgtgcatgtacgcgcatgtgtgtgtgtgtgctcagagtgatgtttcttgctgtgatccacagcatgtggagaaaaagcccaatggcggaagcgtttgcatgtccaatggcgtcgctgataagtgactgcttcattctttatttttagctcgcactgccttttttcccatatgtctaaaaataagtatttgcaagctttgcattctgctgctcattgtaatacacaaaatatttgtgcacagagcgaaacgcactgatagcgctcaagatgagctatttcaagaaaggaaggcttgttgtgctaagaggagataaaatacatttttatgagtggtaatgtcagagaaagccatccatcttattttgaaatagttttaaaggagtggctagatagttgacctctgaaatgatttaaatagattcaatggggtgggaggaaggattccatgtctaaaatagtatgctctgctatatattggctattgtaagtcatcatccaaagatggcacttagtgcctggtcatctgggacagaggcccctctgtgtaggatcacccaagctgtcaacttccagaagacctattctccagtctttgagtctattccagctcgttaacacctctatcccaaggctggcagagaaaagtagaggaagaggaaaaaaaaaaaaaagaatcacgttagttgctcttaatagcctttgcaaaggccagctcatggctgagatagaagccagtggtgggaagaaaatgtaagatttttctgctttctgttgtaggctccctttcctgcctcggcacagctaatcaatatttgacttaaagacgtttcaacgaacttgacgctggaaggccttgctgacataatcgtgtattatgtcttcccgttaaactcccagaaatagggtgagcaccggagagttaaatggtgtcctgcctccccatatctgagggagactctctcctgggctattgctcctaatcaggggttccacagcaggtgacaacttttaattcaccttcagagctagccatctctgtgacaactctgtggtatgatcacgccttctggccctgacctggtgacattcggtattaatgagattggcaggttgggctgtgactgtgtttacgtctttgtgtgttgctatacttacagttcacccagaacaatctggggccaaggtttgctcttatcaggataggtggctggttgacaccacctcacagattctattacaagggacaatagagtcattcttcagtgtgggcagtccttagccacccttgctgatatgtattctttaaagcaccctggctatgccaccctcccatttcagccccacttttggaccaaccatgcagctcagagatttggggctttgtcttggaagctcctccatcaatcagaattccaaattgacactgttaaggtccccagaggtgttgagggtctggattcagcaattatggtgaataaaaaccttgcagctagcaagggcaaatgccagaattccaactactaacagtggaaaagggaagtggtttatgttagactatggtcacactcttctgattaaacccactcaaaaaaaaaaaaaaaagaaagaaagaaagaaagacaacactgtaatattttccaatgactgtttatcatgaattacgtcagccttcatttaagttgctattatttctccttaatgcttctctggtgcctacataattcaccacactggcagccttgggactatgaaataagctttcacagtgtccatacaaggcgtgggttttttttttttttttggttgttgttgttaattattataaaactcctttaactttttacaaagtggcataaaatattgttgaggtatttatggctcaaacgacatggctctattttgctcctggctagttcttaactaaagcaatcatttgtggttattagagctgccagagatattatgtcagaactggtttaagactattatgtatcacatgtcagtacttgaggctgcctttcaaaaaaaaaaaaaaaaccaaaaaaaacaaaagcgtgattttcatttgcgttcttccagggatcaatgatttataagctaactggagttcattccaaggtgtacccatcacctgggagcctgtctcaaacctcccatcatccacttggagtctctttcctgtggatctaaaaaaaatctctccaaagcaaacgttggcaaagattgagttccaagcgaagatttgtttctagggagtcatggaattagctggaactgcttaatggcccgtggctaggctagttctgagtccctgagtgtgtaggttttttctgtgtagatttcctaagtgttgagaccaatggttatgaccttctgaagggggggagggggaacagtccccactcatgggtgagcctgcctcagatgctcaaacagcctaccccagctttgtaaagacagttcttgggtgaaggacagtatggagaaaggcaaagaaccaggtctggggttccacaaagctgctcttccaagcaaactttctattaatatggtgctctgctgagctgcaaatactgtgtgttccctcctcgcttatttaaagcaagaaaggaagggcgtgccagaacattctacaaagaacgaaaacacattaatgactcatgtgaacaattactgatttttcttaacatataatttcttaattactgtcaaccaaaataatttgcatgataatatcctcaagcccctccccccaagtggtgtttcatagttttagcttggggatcaaagagtctgtttgatcaataatcagggaaatttaactccttccttctgactggatccacaggaagctgacaggagatatcttcacaataattacttccaacacaatggggggaaaaaaaagaaaaaaagagctctccagtaaagtaaacagctctggaaagggctgcaggcggtttctttagcttgaattcaaggaggaaattgtgacttttgtgaaacttgcataaatttacatgtatcctgtcagagttttaaaattagacaacatgcctgagtgccctggaaatgagtctgccatccagatttagagagcttttagcttttttaattaaaggcatttcacaagccaacaccagagacacgaagaaaattacgtattacataagaacacagcaaccttggagatttagtgagtgaatattttggatttaggaaggagataaaaggtgtgaagggagcagttatggggaatttttttaggtgttaaaaaaaaaatttttttttttcagagaagcgaaaaggccaaactgccacttgctgtagccctggttctggaactggttcaaagctcacagaactgactgtgagtttgtggtggttgttaatgagcacttgtggcagtgagctgggatnnnnnnnnnnnnnnnnnnnnnnnnnnnnnnnnnnnnnnnnnnnnnnnnnnnnnnnnnnnnnnnnnnnnnnnnnnnnnnccacagcagattatgaaaaccccaaacagtatggttatcattgtgataactatatttatccgctgctctgcctcatatcccacaacccctctttctgaatgccttaataatgcctgataatgaaatactgttattggccatgttaaaccatttaaagaaacttagactaaatactgtcagctcgtgtttgctttcctggcgtgctcatttattgagaaatttggaatgaatgttaaacatctgggcatagcttggtgcacgcaagccatctttaaaatgtgtatatttcagaacttctttagtgtatttatttagaaatctgggagaactctgtaaacatgttggaggatatgggtaacatttgaatatgaaagagaaagtcggtgtaattgaaaacctaaatttcattttctataactattactctgttgggaaggacgacttctagggtgagagaaatccaggctatggtcagggatgtttatggagcagtacctccccatgtcttgtaccatatatatgaaccagaaaagcccccattctggccccttctgggtatgagatatgatgtttatttctttaaaaaaaataaagaattggttatttcagcactttaagatatggttggagttgcacttgccagctgcgtagataaactggagtacagccaggcctacacactgcagtgctaactgcctttggttctagacaattaacacatatgttttaaagatctttttaactttatatatatatttatatgtgtgtatgtgccccccctccctctccctctctccctctcactttccctctcgctctctagctctgtgtgcgcatgtgccatgtggatatagatgcctgttgaggccagaagaggttatcagaccttctaggtctagatgaccagtgactatcagctgcccagtgtgggtgctaggaactgaagtagggttctcttgcatgtgttcctaaccattgagccaaccctccatcctatagtctgtatactttgtagcccagcctttaagacactgatcccattgacacaattgtggtatttgggagatggtacagtgtaggaatcagaaagacaaagttattaatgtatcacaaatgcgctccactggagaagtacaaagaagaatgactataatggcagagttttcaggtctaaattttccattgtgtgtgtctctcctggtagcgggtctgaggacccagggctacctgtagactggaagcccactctgaattgttcattgtgatgtgattcattgtgaatctagctttgcagcatagaccaggctggactccaaaagttttaatatcttccagacaaggtgcagctgagatctaaagaccctgattataggaacagccatctcttggggcacagaggttttgtggtggggacagttttggtccatggtggttgcttcagagttagggcaggttttattattactattactattattattattattattattattattattttgttttaaaactacaatttaattacattactttcctctttccattttcttcctccggcccttcccgtgtatccccaactcccaatggctctgtctcagattcacggcccatgcctcctcactgggccacattaacattgtggggggaagcatggcggacccaactccaagcaaagaactaggagcatctaaagaacactgagagaggaaaacttcagtcttctccagagaagagcaccacccccacccccattagccatcgaataccgagtggtcagccctgaacatttacattcattttatttttaaaatttattggaaggagtgtgtgagtgccacagcacgggtgtgggagccagagcccgagttggtggaattggttctgtccttcctccaccttcacgtgggttctagggagccagccaggattcaacatgggttatgaggcttgaatgacaagcacctttgctctggcgagtcattctgctggcccatcacgccatccttggtccctagccttttgcttatggcttccataagtgctcatttaccattatataattaggaggctgtcatcaacaaagataaaaattgatgtattctccttgggcagatatcccctgggccttctaaagaactgaaacatggtaggtctggagagatactttactgggtaaatgggtttttttcttccaaattgtggagatctgatgttggatacccagtatgaaagcccttgacatgtctcagaaaatgaggtagagggtctgtaaggtgaataaggagaggagggtccttcccttcagacctggcaactgagtttgctcacccgaacccatgtgctaaaagctgggaactgattcctgatagttatgcaagttgacttctgatgtctgtccacaccatgttgtggcctatgcacatgtatacacacacacacacacacacacacagaagtgcatgcacccacacacagatgcacatacacacacaataaataagtgaatgaatgaatgaatgaatgaatgaataaggaatatgtatatgaatttttaaagaaaaaaaaggaggctggcgagccgtgaagaaagacctctggagttgacttctggcttctgcgcatacacatgtacacacagcgggtaaggggccaagggaactgaaatgacagaaaagaactaaaactatgctacctggcatggaaattgaggggaatgtaaactgtaagtaactgatttcaaaggagaacccccacatgtacagcccacaaggatctaaaactgcaattctgagggtcagtttgttcaataacccatagagccagagtgttaccccatctattacttattgattgatccattgattagttgcaacttgatgaggcttctggaacaataagatactagaaagaagtgaaaaaagatgagcctctgtctctttctctagtgtgggctaccgtagcccgaggtcagtctcctgtcctttccctcaacacgcaaagtgtggcagatatgcttagtggttggaagcccttgatgtggccaagtcttttttttttaagatttatttatttattattatatgtaaatacactgtagctgtcttcagacacaccagaagagagcatcagatctcattacagatggttgtgagccaccatgtggttgtgggatttgaactcaggacctctggaaaagcaatcagtgctcttaacctctgagccatctctgcagccccttttcttaattttttttgtttgttttatttttgttttttcaagacagggtttctctgtgtagccctggctgtcctggaactcactctatagaccaggctggcctcgaactcagaaatccgcctgcctctgcctctggagtgctgggactaaaggcgtgcgcctccaaagcctggtgtgacgtggccaagtcttacctattcactacattatcatcattttttggatgacccagtgcatctaaccttcctaaggctgagacctttttaatacagctcctcgtgttatggtgacaaacacacccccaactataaaattatttttgttgctacttcataacagtaattttgctgcagctaagaatcataatgtaaatagttctggaggtagaggtttgccaaagtgggtgggagaagggtctaggcctgcagattgagaaccactgggctaacccttgctcacaaacaatcagacttttgaaaataacaagctctcagaattgcacgcctttcttccttaactgtaagtttggagtgcctttctctctattgcttgtagcacccaccatccatagtgtgttattcacgtgccctgcaaagagaacccctttcttcagagttgcatgcagagtgacgtatgttcacgtgttgagttgtagtctgagatcagaagaatatatacctcaacactgaaagggtcttccaacttaaagtagattggagaaggcaccaggccagggatgtaacgcagctgatcgaatcagaaaaacaacagaacaaaaaaaaaaaaaaaatgcactcttgatcacatccagaaagaaagaggaaataaagaggaaataaatagctaccactctgaagatgacaagtggggatatcaatcaagttcccgaagccctacctgtacaattaagaagagtaattctggagaaagataagtttgtttctagcctcccaccacagtcacagatatctaacaaacacaggctgttccctgaaggatgcttggacacattaaaggatgtagccagctagctaagtcaatctcaggactggttccttatatacattttgtgtaatgacgaatgacattatatagctgatcaaagataatgccaatgtccacactagttagggcagcttcccggagggctttatctttgaggaggacagggaggattcacactgagtaggtgcattttggtgtgagtagctttaaccctgacaaaccttcctcaggaaagtgcccttcatcctcacaggttataggataaaggagccctgaggtaaaatgttctccctaacactgtggccagaacttcggttggggatcacgaagctctgtgggcagttttcatttgccagtgccctgatcctgttcacatgaccacagcagcattgaactggcaagcgtggttcacctccttcctctaagagcctcttaaacggtaggaggggaaaaccaagaggccattatgattggacacaaaactgttgatggaactcggggagttaaatcccatggaaaaatctggaacgcaccagcattgacttgaaccactggccctctttgagcattgcaatgggatgctgcgtgttagccttcccttaccattagaagcaggtcttcctatcaaggatgccattgtagactcaaagagggggcacctacctggtgctgtaattcatctcaggctacactaccatttgctccccttccttgtttgtgctgctcattctaagttgcttcactttttcaagttctcttatcttgcacagaacagtcgaaacacctgcttcccatggccaagattatatagcatgtgggaaatcctgcacggagtcacactttcgccctgtggtctcttaaatgagaaagctccattcgtgcgcaaagccagagggttgaaaactagccccgtactctctcctgtttctgcccttctgactctagagttttcgataaacaggagaggatatttactatctttttaaaaattgttttatatatttaagcttttttttaatttaaagatttatttatttttatttatatgagtacactgtagctgtcacacacaccagaagagggcataggatcccattacagatgtgagccaccatgtggttgctgggaattgaactcaggacctctggaagagcagtcagtgctcttaaccactgagccatctctccagcccgcatttttttttttaaatatagggaagacaccaatttcagtggcaacctggctacactaacgctttacttcttaaccttggttcccttaggagaagcccttcagtgtggactcccccgtcggttcacccaagtccacgtgcttcgtctatctatcaatgtctaaggcgtacttagtatagagcagatacctcggtagcccccaattcaaccaaaccaaatccaatagacttaaaatcatgaattctagattctgagtttgtgcagaataagcagttaaataaatacacaggtatgtgtgtgtgtatgtgtgtgtgtgtgtgcatttgtatgtatgtatgtatgtatgtatgtatgtacatgagtgtgtatacaagtgtgtgtatgtttgtgggggtgttgggggcagatgtgtgttacatgagtgtgtacgggtgaatgtgcagtgtttgttttgtgtaagcgtgtgtgtgtgtgtgtgtgtgtgtgtgtgtgtgtgtgtgtgtgtgtggtgtttttaggaggcaaagggctgagaacagttcaacccatctgacgagtacgccacctgttgtctttgtggaaagagtcacatatgctctgtggctgactttaatgtcgggtttaatggtggcgcctctggtcctttcctttttgagacttatttcagaaagcagggtagaaggaacctttctgttgagtttataatagcaattacaagctgataagagcagaccattcatcaagcccccatacctccggacttttatctctttgggtcaaatgtttcctgattgatattgactcccatatcttaagcagctctgaacagataagaggcaagcgaagaaattcctttgaaggagatttgacaaaattatgttttctgattttttccccttttgagagagagagagattaacttctcattgttcttattagagagtacaaaagctaccaaacagttgaattgaagaaaatctagaagtttcctcgggtagatattgactccgtccccactgcatgcaaataagcactaagtaccttgcatccctttttctgaaaccatttgaacagagcttttaatacacttagcatggccctgtaccaacacacttaggaatacacagtgcctgaagaacaggcaggcacttggtataaataaaggtcctgcaggaaactgctgttggaaccttgttttaaagggcgagagcacaggttttggcatgcaagataacagctttccattgcagtgaccatgagtgttgttatgaatcaagtatggagacaattagagagtgtataattacactcggaacagtaaacaccttccgaaagggtatataaatcaattaaacgggccatacagtggccggtcacataaaattatattgaataaaatgtgtcatccaacagtattttctacacacgtccctcgactttacatcacgtgactcattcccgctgtgccttttcctccccaatctgatggtaaagggaccacttgttatcctagctgaattcagtggcactgtcctggacagattcacatggctatctttaaaaggggtttgaaatggggtagatttggggtcatttttctaatggctctttagggaaaggggatccagatttgtctgcctgccttgattcattttcggtttctccacaagcctggtcattaggactgttcaagcccattggtgtctgctgcctaaaatgagctaggtgacctgcatcgccatgtctcctgcaagagcagccggatattacaacagaggagtaattaaaagaacataccaaagacagatgtctctcatgcatgccactacatgctacgaaacggaggagccacaccacagctcccgtatttacacaaagccctgaagttgtctgtgtctaaggaaacaagccaactcatgcaggctgacccccaggggccatcagagctaaagtccatgggaagcttatttgcatttaaatggcaaattggaaacatttttcgaagatagttgataaacatattccaaaatggctttcattaaataggagcccaagatgtgaatttgcatagatggtgctggccttgtaaattctcccgtgctccttgggaaaaaaacagctgagaagcaacaagttggctgcctaataaggcccctaacggacttccttctcaggactttagagaggtatagacgctagctggctcatttacctcttgctgcgtctttcctccatcccccaaccgagcctatggaccacctggccaggcagaacaccaaagagagtggcccaaggctttcctctccctcacgaattgagcatatgacttgtgagtcaatacaggtgacaaggtcagtttgtctgtccactcacacataatccaattgagatttatgggttatcagctatgtccttgtgtggaatcctacataaggaaatgaaccagcgggccgtagtacaataaagaacacaaccccgtgctacttccaggggctcgcattccagggtggggacttgcaaattacagtgcgaactgtgaataaataccatcccggagcaaagtgaatccttcctgtcagcttcggcagacagagaagatagttttaacttttgttttttattttccccttgcatattttactggaactcacgtaacagggcctggcacattttacccagtgactaatatattaatcccactctcctcttagccgtgtgggaatgtcagttgagtcagggtttaaaaatgggacttggggagatttgctctagatctgttgactaatatcaattaaaccccagaacatcacacacaaattgaagatgtctttttcactcttcttaaagacccaaagatgcacctagctaataacctgttccacatccttaataaagaccaggctaattaaaaattgtttgccgcctgaaaatgaataaatgaagaaccatatattaaaatcagcaacttcctttggcagaagacgctgaatgtgggctagggggaatgaaagaaataattgtgagctttttatcatctacgatgacgcatacaaatgaggggttgtgtcaccctgacaaggcacagggggaaggagactcttggcagaattggcagccagggttagtatctgcagtacagaagcaaaaaggatcagagtcagtgtgttatgttttaaatctgaaatgccgcctcccaccccccagccccagagattcatgcttggattaattgttcccacatggtggcgctattcttcaagtgtcatggagcccttgggagatggaacctagcgagcggaaattggtcactgggggtgggtctctgaaggtcttgctctccgctctgcttgctgacctgtcctaatgtaaacatttctatcatatagcccagtccccatgaactaacctgctcccacagtgatgatgggattccagtccttctgaaactgggaaccagaagaagcctttcctacctgagtagccagggcgctgagtttcttcttctttctgtcccccacttttctaggctgtacaccaagctacatcttgctccaacccttatctgtcatcttgagtctcccttctgtaggcctgtgatatgaggctcctcactagctgatgtgtttatcttgcagtaagaggacagaggtgcctcccttgggttctgtagagcctggaaagttgggacctctgtttagatcttaatgtatgttgtcctccatcaggctagaacctgtacatgcatgcttcctaaaaaagaaactcactcatctgacccaccagactggtggcgacttctttcttcctgcagactttaattggagcatagctcttcctagatctcttcccctatgactccatgaggtcagtgtctctgtgacactccaagaacccttactggtccctttatacaactctcacaatctcactagagatatattgggatgcttgctatgtagctcactgatccaagctagctgagcttaatctatcttaaattcacggagcaactgtataggaagtatacgccagttgcccttgcggtctgctttaaataaggccccgcttgcttgcatatcaagccaggctgctgtgtagagtgaagaagcacagagcgagagctgaagaagacgcatacatacctttaatcccagcttttgtgaggtagaggcaggaggatcactttaagtttgaggcacgttccaggctggctagggacctagcaaaaccttgtctcaaagccagaaaagaataaagaggaagatggcagagccaaggcagtaactgatgactgcttgtgggtctgaggtgggttcactgaccattgcctcttgctcctagtgtctgtgtctcgggttcctcctctttagcattattaaccatggcaattggcaatacccagctaccgagcatactacaagaggacttagatggcgaagtgcctaacatccgacacctacagaggattacaacgcctcccatgtttggcatggacagagagggcgagggtctatctttccagaatattccagagctcggatgctctcacctccagtgtaattccttcttcccctcagccctccccaatccttacacacagactgttctctattccagggaacccatggcctctctcactctctgtggctgtcacaagcaatagtgaaattgaagattatacttctttatgcatgatcttccccgataacttataacctcctgttgtgtgtcaggcttaattatcctcagtgtttttctccaaagtaatttctcagggaaagacaaaaccaagacaagagagtagtcgtgaacagtgtaaatggcgtgtaaggcctgaggcctaggagtcagaaaagcaaccagaagattggctagtgattatgtggctgacaccgatcggagccccgaatctcttgtacatgaggaaatgatcacccacgtgagcctgatagtaaaaaggatacgagattgatgagtcaagccaacccatcctccatggcttcaccacttaatattagcagatgactgagatctgcttgtcacagacccctggctttgctcggttttaaatacttggctttgatttatacaaggttttgtggccagtcatgacatcagaatgtaaaaaaaaaaaaaaagaaaagaaaagaaaagaaagaaagaaaggagaaagagaaaaaagaaaaaagaaaaagaaaacagtaagtgtatgggggggaggggcttgctgtaaaataaaatgtacatttactggtaagaagcagagaacatttggcatcagcggaaaagctgagtctttgatgtggaaaatagaaaagttctttttgtttccattcgggtcggagggagagatgatcgctctgtgataagtccagtgggttccgaagctcagtgtaacaattgatgagccacaagttgtcctgcccggaggatgtaccacgatgaaacacacatgtgtggacgaagtgtgggaagagaggcgccacgatgcaggaaaaacagagtggactcaataagaggagtccccctgcctctctgtatgaggctttgttttgtaacgaggctacttacgtgtgtatggtgtgtatgagcaaaggagctgaggagaaagacacagaggtggagaatggtcctttttttttttttctttgtgacttctattatcctgtgacagcctgcagccaccctattctggacggggatctaagaagtaaatgtcctattttaagtgtggtagggtcctcggttttaaacaatttctccctgtttggttttgttttaatgttcgcacaattaatgcctctcgcgtgtattcaacaatagttgcctagcaaccatcaagcagtctatttagaaggcaaagggtctaaaattgaatgaagagagaacatgactcaagctgcagcagaaacaaatgagtttctgataccagtttcaaatcgtagcccccagcagctgagcaaggggccatctggtctggcacctgtagaggagacacacgcaaatggcctgtatatcttggacacttgcagatgggaagatagacattaccagaaggttctctggatgtcagttggactatgttttcttccttcaagcaatctgcctatgtaatccctagtggatgggtgtgtgtgtacaattaaaactgtcatctccaaggggtctagaaccacctaagggacaaacattacaagatgaccatgatgactgtgaaggtgtttctgaattccgttagatgaggcgagaagaccaaccctaaatgcaggcacatcattccattccatgggctggggtcctaaactgtataaaaggggagtattcatctctctctgctacaatgtaaccaaatgcctaactcttgacacctggatagactatatccttcaactgggactggatgtaaaccctcccttgcttccctaagttacttttttttgttcactgcaagaggaaaagtcaccatcaaaggagctaagagtgttctagaaagctcctaagattgattccacagcttgtctgaaagataggtttaggatcttgcagccttgccctcactaggtaaggagcatgtatgaatcaaagagtgtccattcctgcaggaaagcttctatgtatcggggactgtcacagccacatggtaaaaaatggaaagaacctaagattccctagaggagcaagcataaacaaaggtggtcacaggcactggacagaagaggggcagagggaggaaacagaaaagggttcctgtcaccaagcctaggtcttcctgagtttgattcccaggacccacaaagtaggagagaattgatcctgacaagttctcatctgataccaatatgtgccatggcatgtgtgcccatccaaataaaaaaataagtgtaattttttttaattctaaaagaacatcaattaatccctgaattaacacacttgagatttttagaaaaaaaaaaagagagagagagacaaatcccatagttttcagttggcattggctctgtgtgtgtgtgggtgtggtgtatgtatgatgtgttgtatgggagtttgtctgtgtgtgtggtacatgtgtgatgtggtatggtatgggggttatgtctgtctgtatatatgtatgtgtttctgtctgtctctctgtatatgtgtgtgtctatgtctgtgtatgtctgtctctctgtgtatatgtgtgtctgtgtgtgtgtctatctctctgtgtgtgtctgtgtgtctatgtctgtgtgtgtgactgtttagtccagcaagtgagtgcttttctctcaaccttgctttttgaaatggtgtcttgctaaaactggagttgaccacttaactagactgactggcttagctcagagatctcctgtctccactcatctcaccacctagcactagggtttcggttgtgagcctcagtacccagtgctgggaatccacttggatttccatgtttgaatggctaacactttactaactgaatcattactcaggccctcaaatgacattctgtgtttaactgtgcaacacatataagcccactagacatgtttggtcaacgaatgaattccctttttgtttaatgaagttgtcacttccccagatatcagaacagaggcctggtgagtaggggatacttaaatcaaagccaataaaactaccatgactttgactacacacattcacgatgttcttttatcaccagctggaatagcacagtcagccataggctggcaatctaatccggtagacagtgattcagttaaagctggaactttcagaattgagtgttggattggtgaacagaaataaaggcccctttcttccttttctgccatgtgacttgtcctgacttgtcttctcttctaccatagacaagcttatgatgtgactagtaggaacgtaccagagaaagatcacagagaaatttgacccttaactggagttcagccttcctgaatgatctgcctctactaagattctgcagccaacagattgctcttcttggcccactctatttaagcctgttagatttgttgtctgtttattggtctcctgccatacgcagaaccttctgtgtggtgattccttccacaacacagtcttgtttagaggattcctcttccttagtgcagtcttattaaggcaatgcttacctacatgatcattcgtttccttcaccaaatacaatcaacctagtcttagaagtcctattttgtagacactataacattgcagcctccaggagggcctgttgatgctcatatcaaactataccatatctctctgttcttatttttaattcctgagctctgccaggtgctcacatctgctgagggctcagaagttgccagaacttccatgcctctcccttcagccagctcttggcttctgaactacttgatgtattacctccaacatgcctctgcatatcgctgtgataataacagcctctgccattcactggggcctcgagtgtgtggtccgctgtctagtattgtctcattcacattctttcaacatcataatctgtgagaatagagcaaccagccctcccttttagcaaatgggcaaacttcacccagagagagatgactgtttgctcttgattctacagttgtctgaactacacagggaatgcaaagccacctgtgcccatagctgccccctccttgctttcttgtgagactgggtagccaatggcaatcttcccaacaacaccagtgggagacacatgaaggaaaagatgatttaatttcaggaaagtagccttgcctgtgaacatcatcagatgtactttcctctcgtgtgtgtgtgtgtgtgtgtgtgtgtgtgtgtgtgtgtgtgtgtgtgttcataacattgggtgtggcagtctcttattataaaattaagatagcatggaacacacctgggatgggagccagatgaagcaaacagtgaatggttatataaggtttggggactgtatgtgacagaacacgggctcactgtactttcttttctcaattgtctactgtttgctaatgtttccttctcggcgtgattgcctcccgatttaatagtgcttgccatccaggctttacagtggcagacccagcataataccaggcccttctatgctaaacgcactgagtgtgtatagccaaccacagcccaacatgtttagctaatgggttactcgggagctatgcgcttacataattaagtgatgtatgtaattttgtgttaacacatttgcgatgtgtgtttctctggtgattgcgacgctttattccgtgtaaagcgtgacattttaattcccactgaacggttctctaccttgattcgccttgtttttttttttttttttttgttttttttttgtgacaggggattattttgcaatcaagataaaagcattatttaggaaatctctagactatccccattactgggaacttttaactgcagattagtctcctattttattgatcgctgttttcaaaatctttattggaaattcaatttcatttctatgttatcaatgggcccagattaacatccgcaagatttttttttaatgcagttttgtagggatggaggtctttaaaagccctcctggtataacatctcccctatgaaaacattttgctttcctttggtgttctggcttttcttgggctacaggctcgctagaccaataggtatctatgtagatgctactcccacttcccctaattaatggtgatcttgattgagggaaaatgctgtaggcacaaagataaggggtagaccagccacccttccctctctagaggtatatgtttgccccagcggagccagcaatctaggcagtttaacaaagcctcgctctatgctgagggaatggaaagatgattgtgtggtttaaaggtcctttctgctcttgcagaggacctgagttcagttcccagcacccattactggctaacaaccaactccaaaggatcccaatggcaccttctggcctatgagggcacacacacacacacacacacacacacacatatatacactcacacacataaacacacacatttgtggattcgagtcccgacacaaggtggaacttgaacccacaacacacacacacacacacacacacacacacatatgcacacaaaaatagtaaagaatttactaaatctcatattaagtgacaggcactggtttcaaaactcaatacagagttctgtgagttctatcaccgtacatcaagcacctaccatctctttaagagtctgctgaggagccgggcgtggtggcgcacgcctttaatcccagcactcgggaggcagaggcaggcggatttctgagttcgaggccagcctggtctacagagtgagttccaggacagccagggctacagaaaaaccctgtctcaaaaaaccaaaaaaaaaaaaaaaaaaaaagagtctgctgagacagacaatacgtgatgggtacaagaaacccgagagagtgtctgtggacaaaggcacccccacgcatctggagaagtgaccgaaggattgcagggtaggtcaggtctacaacgactacaccctactttttgactgatttccagagatctaaactcaggcctctgtgcttatatggcaaaccccttacaacctgaacgatctccccggctttttaagctgtggaatggaggtgctctgtaaattacccagaagaactcagcagtcacagagctatcaatattctagctcctcaccatggtcttctgttaccagttggtctgtcaagcgtggctccccatacttcatgtcttaccaggtctttctctgcattttagagcaaggtttacaagaaccctcaaacctagaacaaattgttctattggtcccaaagaatgacagctctcccgtggttctggttcgagcccccgtgccaagtgtcagttctcaattttaactctagcctctgtgagatcctagaacacaggcagcctagatctagttgtccatacctggagctatgtggcaaggtgtggcacctagaagctttgtattgtgtccaggccccgcccccaccctcacttccctgagcccaaagcaatgcttaagaatgccaaaagaatgttttcaaattgttccttctgttgatcccgaagaatgagagccttcacatggttctggttcaagacctgggccaggagtcaaattctaaatttaatcgtggcctctgtgaacgtttctttgctttccctgccaccatttaaagctgttcactcttcccatctgcaagagcagcagacatgtctgtctttctgccacacaagcttgttattctactgggggcagcgtgtcatatttcctatcataataggaattaaacaaaagccctttgagcaagagccctgtgtgtaaacgcctgtgctcacaagtagatgcgcatcagaggccagcaaataccacccctctatttattactattattgctgttattgttattattattatctttaaaagagaagcaaggctcactagagaattccttttggaattttctttttagtgagaggacacagaagaaagggcatgttcagctcgtaccacagcacacacagaaataagaaagcagtcatgtttggctaaagaaggcacagctgtttaattttatagtagagttactttaaggactttgtcaattcaaagacgaaaaccaaacaactgttgctacaaaaactggagttgaggccaagtcaagataaatctgttcctaaaaccatcttagaattacagaacatttgggttcacgctgggcggggaagcagctctatttaaaaagacttggagggccggtgcttggtgctttggctggaaatcggaggacagaggccttgctcttttgtgtcccgggctctgcagttttggatccctcagctcttttagccgctcagggtttgttttaattccaagtttgtttgcttttgggggggggggggacaggcccatacagcaagaaattatccaaaatcacaaagcagagattggaaatacaattttaaaaccaaattaaacaccaaattgcataattgattattgaatttggaagctagattttagaaatcatcatcatcatcattattattattattattactcttaaacatggaatgatgcagcctattcctttccttggtcttataaattccaactttctctatactgcctattgttagaaacaaatgaactggccctttttgtatttagtggtttttcttccatattagggagttattcaagacatctttcctcggttcctgtaattccaaaccagttggagtatcagcctatttttggttatgaaggaacttttaaaatgtgggcatgattttttttaacagttataaaattcgttaaactcaattgactacaaaatataacagctatggccatagatacagtgactccgttatgttcctgaaatacattgttctaaacttccatataaaggccccaccagcctgacctcacagcacctgacatcgtgaaggaggcctactaaatgtaaattatggtacatataaaaacagcctaacgttgtggttcacacttgtgtctctccctcagagatcagtgccttacctgtatttgagtaaactttcttgttagttcctgaggtttttgtggtcatccctgcgcatcaccctgatataccacaagagggcaatagagagtttgctaacaaagccagaaatggttctaataacaagctatgtgttttaacttgctaaggattttatttcttggcctttcaatcgccacacttgaagcctctgggtatcctgaacagtaaataatccaaataaatttcttctgagaggaaatacagagataccggggcagacaaggacttttacccaaataaggagtcttttttgtggtgaccccatgtgttagataactgtctactggcagttggacatgagtttataaggttggaggccgaaatatgtataccatgtgctataaaagagcttgggagaaagacaaaaacctctatggctatcaccaatatcccaggggcacatagtcagggtgtttcactgcaggctgaatccatcacaaacatgtcatttaaaatgatcaccttctaagtatcctgcagtaaaatatccatcttgtgttgtgttgatcctactgtgatcttgctcatccctcagcataaagccttaggtgttttagaggctcctctcgctgcctaacctggatttatttccgtagccaccactaccgctctcgtgtgttagggtcattttaaaataaaaggaagcagttcagtccaggaggggcgtagcttttgattcgttgctagctacagttctgtgcggccactgtcagagaaaccaaagctgaggagtcagagggaatggactctcatttcagaccctgtgattggttacgtagaagggcgagatactaggccgacctggttttagatagccactatcagaacaatgtccgacggtcttttattatatttattttatatcgagtgcatgtgcacgcacacacatgcacatgatgtgttatgggtatgaggacggagatcagagaacaactttgtagaatttggttctctccatagaccttgacatggatgggttccaggaatcaaacccctgtctccaggtgtgcacaacaaagtccctgttctgtcgccctgtcttcttgctggtcctttcgatactaaggatggtgataaagtccttgtctcctctacagtccccagaactgaaacctgtttctttcgtccaagttctctggacttattggcaatgcgttgtgtgaaactgtgggacccgacgcagctggactgtgccaggaaggtcatgttcttgccttgaaggctgactgcatctgacccctctacttactttcaaatgagatctcttaaaaggcaaacgcagttgggctgcaaactcattcggcaatttgtggtcagggcaacgtctacttgggattggccaaactcgctcaagttccattttctcatatcgtgtctgcactgaatgattgcagcgtcttacattacacacagttcatgtcgtcaacgcatcaaaatagctcatgaggagtcagagctcctctctccctctccctccctccttctctccctgtctccttccctctcaccctcccccaatctgtttttacttggtaccttagtgaaggatcttaatgtgctagcaaccacatcagggcatttagtagcctcgagtcaataattactagatttgaactttgcagagatcccagcatcagcagttttggggtactaacatctgtccgtgacagaaaatatcaccgcaaacaggactctacattgacattgtactggaactttcgagctgtgaccttggccaattgttctatcttcagacgttgatctgttttgcttgccctttgaatcgtgaccgagggcatacgtctctgatcctaacattacattgttgtccaaaccagcatcacccatccggaagataacaagagccatctgccgtttaaaaagggaaaacgtggaattcatttgaatgatatagtttatccaagccattatagccaaactgtcgttatcatctcaatatgtgcttgatttaaaatgctatcagtgagatcatttgctctctgccccacgtgttgaaaaccaatctgtgtaccaatctgttttatacgtaaagtacacctcagctcaggcttggcattccaagggctctgcagacgccggtgggcaccgagactgtattgggtgcagcaactttacacaggaagagaaatttttctcttaactgaccacgtggagcttcacccttctctatcattattatttattattactagtagtattatgagatccatggtgtggtttccactaacatctgccctgctgttctgctgtgacacaaactcttccttccaatgacggagcactcaagcttgtccagccagcccagttacaatcacttgtccctagtgaatgtatcactgttgggagttagggaccctgttgctgcctctgcacacacaccacaccacaggctcctttctcttctcctctggaccctccatcctgcattttctactctcttctatacagtcactgagagccatggtacagaaggattttgaagagcctttgcagtatgagctgctgctcaggtatagcaaatactttacaaactgagtcataggctgtcccctccttagttaaaaaaaaaaaaaaggtacatttttatttgtggggtcatgtaccaccaagcacttatggaagtcagaggccaattatttctttccacctggtgggtcctagggattggattcaggtcacccatcttggcactgtagctcagcaggaccctggactcttatttcggaggaaggaacaacattacatgttagattgtcctttcggacagcataaagaaattaataactgtattttcagcacaaactccttttgtatatcttcttaaataaattgggaccttattctattgtttttgttgtgtggatttaggaaccaaactgtttctcctaaagtattcatccatgtctgtaataagttagtatacacgctaatccatgtgtgcataagcaaccaaaccaaaaccataacaaccatttacttatatccagtgggaaacatttcctttatcaaattggaaaatcaattaccttcagagttgaaaatggacaatcttattcccgaacttggagagatggtagaacaaaaatggtgtgttttaatgtgagtctaaatgtgctgtttactgtttccttctgaagccatttgatgcatttgatgcaacaaataaacaacaacaacaaaaaatgtagctttcagttctctgcagttgttttcagtaggggcacctcagagggtatcaatcgtgggctggaaggagcgactttactggttgtcagagagagagagagagagagagagagagagagagagagagagagagagagagaaatatttgttctcagttcatgaggtcctgtttttatgaccttcagaaattgtggggattaaaatatccttcaaaaacacatccacagtggatacttaaacagccttaaacaataaacagacaataatgttaaattataattcatccttgttaatggtaacatgccaagacaagctaaatctgcatttgcttaatgtttttcagaagatgggcaagaactgacttcttagaaaaagtgcaaagcagagttgaaatagcatatttttctaactctgtgtgtgtgtgtgtgtgtgtgtgtgtgtgtgtgtgtgtgtgtgtgtgtgtgattttctcccctgggaaatccaggctgtcataggtctggaaatgccccaccagatccctggagggagggaaggacagttttgagtacatgtgattacataggttggagccacttgtgatactcttttgtcatggctgaaaaaccaacacgttgttcgtggtggaaaaccaagggcctgggtcacatccatccaggccttggtgaattacctgttacctgagagttgaatacatttcccaacatctatgggacatgcccaccacccctgaaagtgcccacagggtcctccaccaagagtctgatcctttcaaggacctctgactggccaatgcagatcagagggaggatgtgagaccatggtctggatttcaaatgcctttcctgtttccaaaaccttctttctaaagggcctatcctctaacagcccagaatctcttcctagctctatacccaggtagatctcagggcttctctggcttcctgtaaagatggtcagaagcttctaccatctctttcttcttcgactgtgtcctgtgagcatccttctatagagtacccttagggactggagaatccacactatgaatctaaatcatttcgggattgtatttgatcatttctgtctcccagggaaacaaggctagaaatcagcttatttcttatgataagccctgactaccgagaaggcttgcttgtttttaatgcaggagtacactggagtcacatgctctcaaaccaattagcaatacaaatgagcttggtgggggaagggccagagggaaataatctgtgtttttaagtgtttccgagaaatgaagacctcaaggcaaagagagacagagacagagacagagggagggagacagagggaggggagacagagggaggggaagagagagagagagagagagagagagagagagagagagagagagaaagaaagagggtgtatcaggaaagaactacacatattgcatgcctgtgaatttactaatccgttgatcagaggcattaacaatgccccagcattcaggagtgtgaaccaggagtgagtaagacgggcatgttttggatgatatcgcaagggtgtttatttacatggtttgttgagcagtcagttgaagtccacggctgtttgggatttgagctgcccattccacctagttagagggagcctggtcatatactctcattagtgacaggtagtaatcggagtgactttttgacacagccaaagtgatactgggtcgcataataccatcttcttatttnnnnnnnnnnnnnnnnnnnnnnnnnnnnnnnnnnnnnnnnnnnggtcgcataataccatcttcttatttatttatttatttatttacttatttatcaacctctttctaataaaagaactgcttgtcctttgggaaagcagaagagcatggatccgctgaggaacctgtggttcagtggaaatgctaaattgtagtgagtggtaccagaagcagcagaattggggcttgggctatagcacctaggaactcatagcccagttctccaggagaccagtaatgcttagtgtgaccacgtgacaattcatcctgggcatgtgacttgcagttgttcatcaaggtatgatattcgaggccagcctggtctacaaagtgagttccaggacagccagagctatacagagaaaccctgtctcgaaaaaccaaaaaaaaaaaaaaaaaaaaaaaaatctggccctagaatctgggtccttatctctgggttcctctttctaatacttttatttgagtgaatagatttctaagaggaattgtcagcgcaactaccaagtccttgcaaatgttgtgtggctgtacctactgctcgctgtccatcaattactgttagagtgcttccagaagaccaagttggacctgtcagtgaccctgggctctcacagatcaggcaatacatgtgcctctccaatgttttctgttgggtggggaggactgtttatagaaagacagaataaaaataaactcagagtcttaacttatgtgggaatcatgctttgtgaattcacagaaagcttcagccatgtaaatacatattggctacaaacatgccatcccggaccgacactgggttttgaatttaaaatctcagggaatcatttatgaattcttatgttaaaatgttggcttggtgcaaagccaccaaaagggctgagagcttttaggctgttttttggattttggggtttgtatttttttttacccccaagtatttaaaaactggaattctgtaagagattatctgcaaaatgcctttcttttattacacccataaattttaggagtggctttgatcaagccttctgccattctcactttgtaaatctttgactcatacattaataactaaaaacattcatcccattcttgctagacggaaagaggaagtttctaaatagtcaaaagggaaacattgaaaatagaacgtggtaaatgataactaaattagggtagatttcttttttctctctttctcccccccctcccccccccaaagaaagagcaatactccatgttgaaacatgccagggtattttaagattattgtctataaagaaaaattcccagaacttcactgtcctcagaggaaaggcattacagaaatgtaacctatcaccaggaacaaggggtttgctttctggctcatatttaaaatacacacagtttgaaaattcaatgacttaatgctccactcacctcctgtagacacacacacacacacacacacacacacacacacacacacacacacagtcaactcttaggaagatgatgtttgtttgttttttccatttctctatttccaggctctcccagcaagtaagaccctttatgttatcagtagacacaaagaacttctctaatggatatgtagcgtggtcgccagggagaagagacctctccaaaatgggaagaacgggttgtttgcttgccgatgagtcaatccagcttttagagctgtttgtctttgtaggatttccaagatcataaatggtattaaaaaataaataaataaaaatgatggccatgacaggaagagcccagcgggtgtgtgtgtgtgtgtgtgtgtgtgtgtaagcaacatttaagccaaaagcttgagccttgccagtaactagttacatttcctttgttgtattattatttctagaatctggactgagtctcccacacgtgagctgcctgactgagtaacttgtttgaacccatagctaagtggatacatacaaacgcctacttgtttttgtttgtttgtttgggtaaatagtccctttaagaaaaaaagagaaacagcaaactgtggccgctctgctgtagagaagatagactgtatccactgataagaaaatggtaacaatagaaaacaatggtctgaacatggaggtatagcatgcttcttagggagttaatgtctacgaatatagcagctgctttgcaaacgtgagcatgtgttggttggcagaggaagatggacagatggacaactgaagagaaaaaggttttgttttcattgcaaccagagaaatctctcactcatcagccaatagcttcccctgtaaaggggtctccggcataaagctttgaccaagtttaactatccttaaggccattgaacagaagtcctgttgctgactgctgagtcccaacctgaagaggagccctgctctggtgggtccagaagaggctgtgtgcatgctaggctcacagaagcacgtgatatttgagggtgttttggtttagtggaagctgggaagcttgttgtggactgctagaggggttgattggtatactcatcaagatgttatgtgactgggagtgggagtcgggtggctactcaggaagaccctggctaatcacaattgcccaggcagcaatcccattggcgataatcagttttgtggtctgagacagtctcagtttactgatctgtagaatggggaggataataacagtgctgaccacctgagtttgctgcgagctttagtgaagttattattggaagacagagccctggctggcacttaagacattcccaggaaggatgagacactattttcttccaagtgcaaagtggggaccagagagacagcgggtctgtggttaagaggtcttgctgttctaccagagaagcacccatgtgtaggtgtgtgagggagcacaagtgccctcagagaccaggagatggcatcagatgcccttgagctagaattagggttaggccattgggaatgggtgttgaggactggacttaagtcctctataagaagagtatgcactctttaactgttgagatgtctttccaacatcaaaataaaatatagaaggaagaggaggagtacagatgtaaggaggacttacatacgtactcacacactgaattctgagggcccaagactacactggcttgtgagttatgtgtacaagtgaaagtagccaaaattagaatagctttacaaagtcacttgatttttgtggggttttgtttattcatttgttttgtcttcttatttgtctttattttattctttttacttttttttcttctatttgaaagtagattctcttctcgtgcagtatcttgatgttggtttcctctccctctcttcctccccgttcctccctactttgcctcctgtccggatccacactccctttccgtctctccttagaaaagaacgggcttctaggagataacaactgaaagtgagataataaaatacgatacggggaagcaaaaaagccatcatattgaagtgggacgtggcaaatgagagaaggaaaggagccccaggagcatgcacaagagtgagagacccactcctcctcacagtcagggacgcataaacctactaagctaatagctatactatatagtcagaggaccttgtgcggacacacgtgggccccgcgcttgctgcttcaatctgtgtgagctcatttctatgctgcttagttgattcccggggccatgttctcctggtcccttctgactccctttttacctactcttccaagggattccctgaactctgagggggcaggatctgatggtgacctctaatgtagtctctgtgtgtgtgatgtctggctgtgggtcgctgcttctggcctgaggaagcctctctgatgacagagctgtcactggtgagagtagaccttggacccgagagatcactcttccctcaaagcaagactcgggaccttggatttgacacttgctttccaggagggaataagtagagtattcaggatggctggaaggtgaagggatgtttctcttatgagagaatgagcttcaaagtcctgctctacccagactactccaccgtggagcattcactttttaatcattggtatagagaacgatttgtttctctaccctggaggaaagtaggtataactcaggtgcggaatatttgttatccccccccaacccccatccccagtcacaaagctccactgagggtcttaggaaataggaaggtttcctgttgcattatggggttccggtcaccagttctttatggtcaccgcccctagcacactgacggttcggttcgtgactgatatggggtccaaggctgtggtgaaggcgaaggtttgacagtagtcaggaagccaaggcttctatcccttgtccccctgttacctcaagcttctagtttaggtcgccaaagcatcggaggtaaggtacaaaagttcccagcgtgacacatgtgtcacgtgatccaagttggcagcctccactttcttacaaggatgcgatgagttatgtgggtatttgtgtttccattagtcacattctttcattcaacaaattccggtgacacaaagctacctccctaatgttatgcaaatgagagtcaaagccaatggccccaccctcaaagatggtccattcaggtataacaatgctgtacccagccttccggacaaagaatacaaagactatgctgggtggggtgggggggctggggggaggggaatcctagttggaagtaaaagtcgggttttcatttgcagggccttggccaattaagaaccaaagactccatatttagagttgtgtgatcggtatgcttggtctcctccgttctaaccttggtagttcccagaatctgctgggtatctgggttctgaaaacagccccaaagatgaggaaatcaacccagtttcagggtggttctcgcaggttctcagaacttttgctttgctatttaaaactcagggttcagtgcaaggctctgtctttagacagggcctttgggctttgacagcttctctggaaataaaggccttttaggttttaagtgcttttcaaaaatgtgaggagggaaaagatggctttgacaagtctcagaacagaggccatattgttccgtttcggctgaggggatctctcagagctcctctctctagtcctgtctgcttctgcctgctcactgcagagctgttattttgataaggggacttgagagtaagtcctacccctagctcattaaagcctgagcacttgggtcattgtgaaaaagcttccgagctacacaaagtcctttaaacaaaacagtccacaccctggctccaggctgtggaccgtagcaagttctcggaactgggctctgagctcccaccaaagagccagaggtcaggagccaccaaacaggctgggcgcagtcaggaagcccgagccagggaggaggagaatgcagagtcttctctgccagtctggcagctcaatctaagtgctcagagcccatcccacacacccgtgctagtcactgcagtgtgtttacatgagtaatggagccgggggaggggacatgcgagcagcgctgagcctcctcgcagctaggaagccgatatccacaccaagaccagactcccagggatgcggctggggaaccgtcccctcccggagctttcctgagcacaggcatcgatcaggcagatgtttggcgactggaatgggtaacgtctgttttctcttcgcttgattttgcttgtgactttacgttaggaaaattccaggcaggttttctggagtggactttgagaccagtggtttttgagactggaatgagaatggcagttcgggaaggggagcctgagccttcagcttcattaacagcttcattaacccacactccctactttggaaagaaagtgttgccttagctgagtttcactccttaccgccgcagaaaaacaaactagtaggaagtcgtgtgtatgtaaattgagtccaacctaaaatgtcctaaaggcaccagcggctaaccctgtgtgtccagaggtaaataataattaagaggctccctggcggtcagacgtgagttttttttccccagtaactgtccctctaagtaataaacatatgtgctttgagagctctggagggcttgtttgggggcagacgggggctggggtgtggggaggcatttatctggagttggttaagggaagctcaatgagttggttggttttagattttttttttttctgggacttgaatgactgatgaagttgaatgagaaagctggtaggagagcagtcaggacaccccataaacaacccaagatcagtatcacctgtgtcgtttgtaactatggctttaataacacacacacacacacacacacacacacacacacacacacacaaaatcaacctccacaggagtcaggctaaccccagtgtaagctttggaatttattttaaataaccctcgagatcttcataaaaatatactgaggaggaaaaaaagaacatgctgactcaatgtcttggccagatttgctgagatttgagacatgctggccagagtattattcagaaaacgcgtgcagtggcagcttgttactgtgagcctttctctctcactcatccgggactgtgatttgagacaacactgctgtcttgaaaggcttcctaagagtgatgtttttagatgttactttactgtgatgacatcacaggctggctggtcctttgggtttctaaaaccaagaaaccaaacaaacaggaggactgatctccaagtctgaccaggggtacttctattctgacagcagtgatggggggagggagggagggtacacgagtgggagggcaggaggaggatttgtgttttccttatcatcctcattttatttctattaatcacacttgggaaagttgatactttatctttaagagcagagtacagaaagtctcgcacctaccaagatcccttcagagacagaagtatccaataagagttgatggctgacctgtgtttcagctgtcggagctgaacactgtatagtaagtaaggcttctgggtctgataatgattttccatttgttttcagcgccaaatcttaaaggcagaccgcgcaaaaagaaaacatgtccccagagaagagattccttcagtggctcaaaggaccccaacaataactgtgacggtaaagttatcagcaaggtaaggtgggttgtccactgagactcctcctgagtgaatgattgattgattgattgattgatgcttctgtggagttctccctttggcctttctgatatctgatgtcttggtgaccatgttcaattcagaatttgcttttggcttttgcacttctggacacttcctagtggcagggagtgggggtgtgggggactgggatctgctaggagggccagcattttgattagtcaacagaaagacttctcacctcccagtgattaagtgcgcacgtcacttgggttgagatcttataccagatgacacaatgacatagtttactctgctccggatcaaaaatagaacaactgaaccatcctctctctgagtggacacatctaaatatgcttcagagattaactggagatgaaattagaagtggctagaattaatcctttttggtcatgttttttttttctcccaaagtcacctctaattcatattagagatgcatggaaaagaatatgcatgcaaataaaagggtatgagggtttttgaagatctctctggatgcatgaaagaaagcatttatttggcccattttgaatgagcattctttgaaatctttgcagtgtgtgcactggaagtatttagtgaagtgtcacttcatatttttagacttgtcttttttgacttctgtgagcctgggtcacagttccacattccagctcttggatgtcggtgtctggtgtttgcttctaaggccaaagacagctctaatccatccagatcagattcgaagatcagattgggattgagaaaacatgtccaggtgtaagcgctaaagctctgaatgttgggggtggggcatgttgattattgatgaagattctgacataggaaaaacgatggcttgaacttatagagccggcctgctggtgcttggactgggtcctctctccccttcccggtgtgaacccagtgaaccatgagtttttatattctggcaaatcttatcttcaagtgtgactcttaaccacaaagatctgaaggttcttttgttaggaatttgtcatgctcccaagatttcaaagggttttttttttttgttttgttttgttttgttttgtttttaattttaaaatcaatctacagaagtgtggttggttttggtttgtttgtttgttttccccactttgctggctaaatgcaagcccagcattctccggcagggcttagcctctgttcacttaactctgtgtaagcaaactcacacggataccgtgaaacattttctcatgatttgagcaacttagccctggaaccactacccagggccttgctttctacggccttgagtgaagaaggcagcagggactcctctttccctcaagtgcatcctgagagtcccacaaggtaacatggaggaagctaaggttttacaatggcgacgctcaacagagaaagcagagcccatgctgtgtttcttccagaatattccaaatctgaggccactgggatgaagtgccaatcgatccttgttatttggaattactactaatgtgtgggatttacaaaactcaacctaggactcagagaccagaagaaaccaacagctactgaatacatggactgcgttcggtgtgcactgacttactctttttaatgagggatgacagccaagcctggggttctcttcacccctcttttcactaacgctgccactgaaaatggtcaccatgggacacacccccttccagtgttcccgtgctgtggtcagctcctgggaactggacggacgtcttagcttttggagccttggattacagtcttgcctcaagtattttctaatgggtctggagaaatcctctaactgggaaagatgaattttaaagcatggcgagtttatctgttggcacgtgtctagaaaatcctgcaggaggaacaaaccacgcttgggaccaggagagccacttaaaaagacacttgggtcttaaagtggtcttttgccacgaaatgttgcggtaaagatgtgaccgtctgcttattttgggaacttgaaccagtgttttatgtgccggtgagccacttggctctcagacctatgtgtgttctcagagtgcctcacacagaccgtttctaaccgtggatcaatgccagcctcctgcagctccacacagcaaaccttccagaagaggtgaacggggttttctgtggtcatgacatcaccttcgaaagtttgcaggctctcaatgttaacaggacagcatctttggagcatacggttttccttggagagagaattctgtggctttctgaagacagcacatgtctcatgagaagaaaaagtacccagccctaggaagggattgtgaataagatcagttccaatcccgttacagcagaaggtccatagcagaggcttggtcaactatcttagaggaaagatctttagtgatggaaagtaaatgattgtgtgtgtgtgtgtgtgtgtgtgtgtgtgtgtgtgtacacgcagcacaaatgcatgcatgtgcacatgcatgtgtgttaagcattttctaaagattagacatgtaacaggtggtttccatgttgaaaggagcatagaaaggcaaagtatgctacgctgggtgtcctcttatgtcacatccttttgtggtaagcgtgttgcaatggtgatgcttgcattagttttcagtaccattcatctcattcgtcctccaaactgggagtgatcattcttgttttcccaagaagctgagggtttcatctcaagttgttgaccatgtctggattagaagtacagcctgtttgttactggttcagcccggctggcttgccctgctgatggagagagtggttataactcagttgtgtagacgaatgtgattagtgtcaaataggtatgcagcttcgttgagaacatgaaacattgcttctctaattagcatgctgtcagtcactctgaaaatcccagtgctcttggtgagttcagcaggtgtgtatggctcaggtcaggaacctaactgccaccattaaaaggtcatactctctcaaggtcaacatgagcactagatgctatttccattttaatacttgaattataataattaagtagactaaaatactgggaatgttttttgagtaaattgggtgacacacacacacacacacacacacacacacaaacttgactgagtcttacggggaacagaaagctcgcttgtactgagaaacatatcaagctagcctgagatgcaagccaccacccacttgttaccatcttgctgagcatccttcatcctgttagaggatcccctaggatacaggatggagttcagcaggtggcagcatggtcttacttgaagcctttgtcattaacagagagggttggttagctacttcagcacccccccacctcgcttccaccccaaaggttttctttccatttccaggatttctcttcttgaacacacaagcagagggtggcacatctgtctatctgcaaaactcatagtcccctaatggagatggctctgttctaataacagtgatagtcaacatgttatcactgcaaacttacgcctcggcctgttttatacccagcgtttagcctttcttccctgagcacagttgaggcttgaaagcagttgaaagcagttagacctgagctccagacttaggtgttgtgaatgaggcagctcacaggcaccgcatcaagatctccagcctcagtgagcttcagtctttttctcctataacatgggtctaatcagtcaccttttgtagttcctgtagatggcctagcgtgggtgaagcatataaggttgcatcgttcattgaaggcaatcacgggtatagggttctttctcttcattggctgggtacccagtagaagcaaagaagccctttagatttgtcaaccacctggttttggtttttgtgtgacttgataaatcacatttctcagtcagtagaagatgctgtgatgcctgtattacatatacctatgaccaaccgtatttctcagccatagatgttgtcatacctgcaaataagatgtgaatcttttaacttgaaactttgttttgactaccggatttcacatttttattaagtccaccttacacacttaaacacatgtattcctgctgcttgtgcctcagtttctacattcttcggacaacaatgacctacctcatgacaggcgtgcacataaaatttagggagatagcccaggtgtttaaaatgcttgtcctgtaagtatgaagatctcagttcaatctagagaatgcatgttaacaaagctgacatggttgcacatgcttataaccccagtgctgggtaggtggagagagacaagcggttccttggaccttgctggcaagcctgctgatgtaacctagtctgcaagggtggccaatgagagactgaaacaacctgtcagtgagctctacaacagcacttgggtaccaatgtaaaccaccaaggcgatacggatgaaaactaggatgcttagatgatttccgatgccaataaactatggtgtgcataagtttaggcttatcaacctagtacttggcagggaatattggtgatggtgtaaaaaagtcagaggctctctttcttcctgcgatgtcacagagggcaaacttttgaggacattgtcattaaaaaaatgttatgtggaaaaaatgtctttaccctacttcctcagccccttagaaattacgagtcatctctggcgaccccgctgaggtgcccagacagtgttattcttgtgagaccagtctgaagcaatgaaagcagtgtgcttgtctgagagaatgagcagtaacaaatccctcttagaggggatgtgtttcccccttcaataaataaacagaaaccttctcatgtgcttagagctcagaaggatctgtggaggctgacaaattggaaagagagaacggtgtagaatctgtgggacatttttattcccaacgtttcccggcccttaccctcttcctgcccgatgtcagccaggagatgtaaagaatattggaatgtacacactccctgtgggggcatttgaactccaaggctgaccctttgtacttcccccttttacaattaaaataactcagcaacttagcgttatatttaacaaccatcaaaggccgctgtacaacatggctgcgagcagggaacattaggttagccaaacaccaaagcctgcctgtggggtagaaggaagaaccatgaagtatatgcctccctttatgtcttagttgggggggggggaagaagagggttccatttgttctatttggggttttaactgttctctactctttcttttctggcaaggaaacatgtcctatcccattctaagctgatggaaaagccatcaagtcctcatcaaaaaaatctgcttttttagtacactggtcaatgttgtatgcagccatcaaccacagataacacatgacaatgacccagcatggagagctcctccaggtgtctagaaagagaaagaggataaatgcatacaaagaaataaacctctctcttttatataaaatatacagtattgggctattgttatggaaaccgagtttaatcaaggaccttaatggtggtgccctttgggggaataaaatgtatcaaggggaaaatcagccttctttccagatattaacactatttttttctggtttgacatgaatgtactgtgaagaagacaaaggaccgtggcacaacctggccaactgtggccctctggacacctgtttgtcaataaagttttattgacattcatgtcacacccttgctagacttgagtacttgcatcaagtccacagagcacaaaagcctgccatgtgctcttttatagagctttatttccatcctctagaagcatcctcactcaatggtgtcttctgtggaaagtgtcacttagagatgtcttttcaagccttccgagacttgatttgatatactgttattattacttttttttccaggtgaaaggagaggccaggtcagccttgaccaagccgaagaataaccacaataactgtaaaaaaacctcaaatgaagaaaagccaaagctgtctattggcgaagaatgcagggcagatgaacaagccttcttagtggccctgtataaatacatgaaagaaagaaaaacgcccatcgagcgaattccctacttgggtttcaaacagagtaagtatccttgcttttgtttctgaaagatcagaattgctaagattctttgaaattgcaaggcggcgggcgggggttagggagcggggagtggaaaaaatgttgttgttgggttttttttttttttccttttcttttctactagtgattatgttgaaatcctaatctaggcagggtgttttctgtttatagtagatccacaaattgtccaagccaagaattttctccctgcctctttccgctgcattgttgccttctgggacaattgcagagatatttataggcagaagtccgaggactgtgactggaaatagacgtgctgaaagcttcttgttttctgttttgtcaatctggagtgtctgcaactcctttcttatgagataatgataatgatgatgatgttgccttatcaggcacagatgttgcctgttcagagacaacttctaaaagaaagatgtttaaaagtagaccaaacagccataaagagggggaaaatccctttagttttaaacctgttgttttcttaaagtctgaattcaaatcaaatatgaaataaaaagttgaagagaaatcccagtttgtagcaactttgagctggctgtgcgtctaggtgtcttcatgcatagacaaggaaactcatagcttgtgcaaacttccattgtaaatgaaaaagaaaacccagatcttgccccccctcgcaccctggagttcacagccaagtatattttgctatctggatttcctggtgcacaaagctatgggcccctctggcttgaaatagtattttctccaaatgcgtctccctagattaaagccatgtgtcattctgatgaagagtcaaacctgtatgttttacataacaatttacatagctaatagcagctggcaccgattacaagagatcactcgaagtcattataaacttatataatggcacatgattacaatgtttgtctgaaaactggctgctcaaatagaagtaaaatcaatgttctatgaagagctctgtcccgttatcagtgtttccgaagagaacaaggccaaggcagggctcttttagccttgacacagtacaaggttcactatggctttgcaagcatgttgtgtcagagtcttttgacattttaattccccatttggttcaaatcctgcaccaaaggattacttgaagtccaatattctcacattccaaggtatctggtacaaaacgaacaaccaaaaatatctcaatactggtttgaggcaagcttgtttggcagcataaccaggcaaaccctaaactccggatttttttttttttttttttttttaagttacagtgtttcctaacatcacacagctatccaggcccagttaaggagttaagtgtgcttatgactccatttctctgtgaatgactatctccccttactgtgtgactcaagtcaggcatgtgacctgtctgttttctactctcacgtgccagccacatgttggcaaaaatacagccaagatcctttactatggccttgttatcaaacagtgtaagaaggtaatcatatagtaaagtgactgtttactgatcacagagaaatcttatctggaggaagtgtgactgtcctagcaaggccttctctcagagaactgagcaagccccacacccctcttctgaattcccacacattcctcaaggttctttgaacatcttctcttcctctgcagatgataagacagacaagactatgctgtttgtccttaaagtccaacaggcactctagtgttgcaactctctctcaagaaatactttttaagggttaaacatagtagatcctataatgttgaactctcctcgagtgaattatttcctagaaatttagctctctggggtgcagacaattgggtttttgttgttgttattcttgttgatagaggtgattgggttttttgttattattttttctttctctttctcattgaaaaacaaaacaaaaatgtttgaattgacgtttcttggaagtgtgttaatgcaatgcttatctaaatacttattgtccctctaacagttaacctttggactatgtttcaagctgctcaaaaactgggaggatatgaaacagtaagtgtttaagcaacttaaatgaaataatttcacattctaaactcccccccaccccacccccatcccctctgtctctggccaaaatggaggaaaactgaaaagcaagcacgccatcattggctgcctttcccaatggctcttacactttggggggtttattgggccagttttggaaatggtcccaattagttccaggtttggcaaaactgtaaacttgtcgtaaaacactacaagtggaaaacatatgtaactctcccctgtcagggaaattagttgggtctgtaattttttcccatgttgagaaaggtctatgactgtccgacaagccaagattgcataaaagaaatctcccttggcaacctacctgacatctgttcatgtctaatatgggaaatgtattaaaggctttcagaagtcatcaggattggccattaaggaatagaatagagcacagcctcctctcattctagggcaaagaagctttattagacaagggtcactgctgcataaacaggaagttatcaaatttattcagaacaggctctgacattctttatcagctaattctaactgacaggagtgagttatttttagcccacgggaaaatttgatggccatggatttttacagcatgtatttctgagccaataaaatatcagagggacaaacggagattaagatcttgaaatactgaggggggcggggagagctgcattaacgtagcacagagagacgccatctgtaataaaatgaattgacatagtaagatggcgtcactgggagtgtttttctctcccacacgataatctgattaagttgtatggttcctctggcaattgagtgggaaattatttcttttcttcctttaagaagtaatctgagagacctctgtactatagtaaaatgaaagcaacagacacaaagtcaagaaaagtatatttatcttaccccaacccccacaaaaccagtggtccttgccatataacatatattgttccagaaactaatagaatgttttgatgtaggagtctgggcacaggaaacgatagaaagtgctatttgagtcagataatctgattatttaccgtcgaggtacctgctagtaattctgactaaaaagtgtttgacatgcatatgtgaacttataaactgcttgatatatgggagcatatgtgtttacacagaaacctagcacatgaacacatgtaaaaatattcgtttcatggatgcaactttatttgagaggtttgttttataaaagtaccctgtgcaaaaataaatatatttttttaaacttggctaaatctgttgatggactaggatatggactccctgcctcagctcatggttctgcaaaatcttgagctaattataggtctcttctctgtgaaaagacggaaacttagtgtcctgagctcaacagacagcctctcagcctcgacttgtaagctgatcttatggtgtgaagactatgaggttttactttggtgaactgtgaccacagctggttacacaatatttgcaaagcattatgaaatgtcattttccaactctggtgcttcatgccatgaactgataggaggagtccaacagatttcacagaatcagtgtttcctactttcacatctgtgtctttctaagacaccaagttggtgtggaacaaatagaagaaacttctgataaatttgggagcacatttgcagcacttttggactaatagaactgattgatgaatgcatgaccataaatcagcagattagatgaccatatatttacaggccatcatatgcatatgagacatatgttagacaccacgggagaaaggaaaaatttgggttagccatcctgatctttaagggacttaatttaaagagaatcagtcattaaattatgggtgaaaaaatttaaaagaccattgccctgtagaaacaaagagctttccccagtagaattgaaggaaggagtcttcaaggctcagagttactgatgtgacctgcaggataggtgctttggactaaagatgccctgagctgaccttcagatgcaggtgaggggttagatccagatacaaattctcatgactttcttagggagaacatgtttccaacatggaggtagggtaaacttgagtacattgcggtcaggcaacatagagtgaccagtgcctgggacaagaggctcagtagagagttcttgataggtaaaggcaagaaaacgagtccaggagagatggatgctgagctcagggactgttcagtaggctgaggaaggaagctagtataaaagatgtcaccccatttaagagtgagtttctcttctttctcttactgtgaaaaggtaccttttccaggagcaatctgtaccaatgacagatgggtaaggaagagtggggactcttcttgtgtttgttctcaattaccttcagctcaaatccttatgtccaagtagcgtgtgtgggagatgcctatcctgggggatatatgaagggcccaatgggtatcttcccccatctacttacaaagagaattttaaaagaaatccccctcccttcctctctccctagcttcttgcttccagcttcctgtagccctgttggcacctaactttgtttctactatctacacctaagcttttggttctgctaggtacacaatacatttttttttcttggagaattttgactggtaaatcttagatttttcagtgaagatttagttttgcagcctagaacatcctagaatatcagtcttcccttggctcaagaacagcacagcgtttctggtattttcatgctatgaaaagttcctgtaaatctggatgtagctcagagctatttccattttcagtaaaggggattgtagcaccttgacagattaatttttttttcatgacttgaccttggcgtggaaaagaatccctgttctgttagtttatgtcctttgtcatacaaacacagaaacataagcaaagtttctaagaccatggcgatcttcaggttgtagcttgctggtaatccccatcttatctttcagattttagctcgctggcattccccaccgtggtattcttcataatcttgcttgctggaaatccccaatatgctatctctgcctctgtagtagtataggtgagaggggagacactcataaattgctgtctcttgtgccttccattcctggcagtttctcatatagctaggatattttcttcatattagcagtgatgttgagaggaaagaatctattcaccttgctttgttgacatcatctttcagcccatacataccaggtctaacattttcccaaacggaacttgtcttcaattatgtcctctatcaaaatcacatatcaaagactggaaatgtgtccttgagttagtttttgttgtttgcatcatggcttatgaattcctgtactgtagtattgagatacatccccagccctttcaagtagtaccccatatatctgtcagagtactaatgtttcctagtaaccaaccaattacaacatgagataatgtctccttgaggggaaaaaatgtaagaatttaggagaaaggtttaaatggacaggtgatgtaaatactagatatgtaaatattaggtaatataaatactcaggaccagtccaaaacgcaagcatcaaatttgtagacgtgttactgtatgtctgtccaaagccaggtctctggagttctctctggctatgaacaagaacatcttaattggcttgtttttgtttgtggttataaactattccaaaccttctggtttgaattgtggattatggattgtttcattttggttcttcgtgatcttcccatttaaatttaaaagagagagacagagacagagagatggagacagagagagagagagagagagagagagagagagagagagagagagagagagaagcagaagtttcattttaagtctggaatgttgactgaccactgcacaattctatgagccccttctgcctttactggaaatatagcaagtgttgtatctaacaaatttgagtccctaaaacactgcatcttgagtgttttttattggctgctagtaatggctcactctttgcagacttccagctagacattcctctacccaatcttttctttccaatccagaaaaggataatgctttgcccctgagctagggtccttcctgagcatctaaggaaacagtaactgccagaggagtctctgaagcatgagggggcatgtcagctatagtttattatgataatttcacttccctggccacctggtagaaagccccagtcagtattctgagagaaagtgatattagcagagtgggtgcccagagaaacttatcaagacacagaagttggtgctcctacagcgtggtgcctccagcagcatagtgctcccccagccacttctagtctcaccaacgaggcagcgccatgatgtgttcatctgggagaaatcacttggcttcctgccggattatgctctgacatcagactctggctctgacatcaatttgaagacatcctctctgactctatccctaacatttctggacataacaaagcatttggcttacttcagaatggtccaggccaaagatgatgtcatgtagttttgaacggcttcagttcctggagtactaccaggaataaaaaagtcatcttccttgaattcagccctcaaggtgtccagaccaagctctgtttcccaggcatcctgagccacgctaggcacaagcacatacatcctttgactttgtgttgagttcccattctcaatccactggaaaaactcaagttcacagaagtccctggttccatcggcttcactgctttactagacccccagataccagcatgatttcatccttgtaacctaaagagtagagaaattaaaggccccaaggctttaaagtggctgtcctgaaattgcacgcatatgcatgggtgtcctcaggtgccctgcttcttattttcaaagagaatatcatttatttactctctcatacagtctcagacatggacatgatgtgtcatgatgtatccaccctcaacttccacttcccacaggtgccccctacatgcctccttccctccctccttcatgtcttctgttttattttgctttggtttgctttgttctgctggtggtaacttgtaacttgctgagtccagtgagctgtctgcaggaacactggcagatactgctgaatagtcttggctgggtcttaggctggacctggagctcctgaatgagagcaatggccaaatttatgaccagatgattggctgtttgtccttgagtgttctgagggatctcattgttgcttcgttttggagacatggcctctctttggccttggtatcaccaagtaggttagactggctggccagtaaactccccaaaagccacccatctctatgttctcagtgttggagttccaagcataagctaccagagctgtggccttttccttcaaagttctgagatggaacttggatcctcaggtttattagcaagtgtcctactgagttccatctctgtataccaccacctcccggaaatacttttgaagcaactggatagtttcatcaatgaaactacggagggaataggtttcctttccgctccttagccctgttttcttatacaaacagtggtgtcgacaactcgttttcgaagcacctctaaaatgtcatctggattctaaaggtcacttggaaaaactcctgtgcttgaaagccaagagcacacgtgcatgctggatctaatgggcatggtgtggtttttcggagaccctttggttttacctatgctagggaagaagggattctcagtgatcttcagagtgagattgtcacaggtatccagattggttcttgcacccgagtgtcgtgtgctcggtctttgtagttgtctgaagccagatgccctttcagctaggaaccttgaaatgcttctctctctcaatcttacctgagctctgacctccgccctcctcctccttcccacctccttcactctctgtacccaactctgtcctaaaatgagatgacgtgtaagtagatggccatgtcctgaaactctagcatcttatatgagttactagaaggggtgacaggggaatataacccaagaaaaagggctccatggtgaacagtagagcccctttgctctatcgggagagataaggggttggcacagaagaaccctttagcttcagaaggtgagagaccgacagatcagaaagcactttttgctttaccctctgagtcttgctggcccaaacccaaaggctgagaactcagaggggaaaaaacaagccttcatggccagcatggcctgtattttcagaccaatctgaatgcgaggtagctttgataacagcacaaagacctcagctctgggaaccaggaggcaactgtgtggatgtgggtttactactgttctgtgtccttagataagtgatgggcccttccctatgcttgcagtcccaacactggtctgtctcgtgagacatggccagagtcaactgaagtacaagctgtctaatagaaaatagaacatgccgtttgtgtagatggccagagtgggaaccacttctgaaatgcttacagggatatacttagctgttcctgtagtcctactgtgtgccttgtgccctccccttatctaaatgaagaccttggtgggagatgtccaaaggaaccttggtattaggcatctggtgtttttgaggggaaaaattgtgttttttttttttttgattgacagcctattaatagatcaacccaagttagactcatttacaaactggatgaagattacaattacatatgacaattactgtgtttatagtgtcatgagaggagtttgagtcttaacacacataagaattgtatgtcgttgtcccgtctggtatgtgcagcaggcatctctatgtaagaagacttcatgacaaactggacagtttgagactccatattggatggagaccttccttgggccttcagcagggtttaaggacaaagaatttcttttactaaaaatgacaaaagttgccctttcaccaccatttcctcttccttcgatcagaactgataagcacagcctacattgtggactgaagtttttctccactcatgcatgtgcgccctgtgaactccgctgacagtgagcggtgtggtatttttaaaacgaagctgtcctaccctgattgtcttgaacacccctggcaacttgccaacaccctgtcctctacacatcctgtaacagcatagatagcatcctccctagactgtttagaaatgtgtacacggacctcagaacttgtcctgtcctctaacatgctcaggtgtagctacatgctaacatgtaggtgagctatgtgatttcccacaccaccacaccccaaataatcaatggccaagtcttagcatctgtcattttgcaaaatccaatctatgtacaacagtaaaatttatgaataaaaataaaaagagactgtgttgtacagggcaggatattgcttgttgtttggatattatgcacccaactcgagaatgtacacagtgaacattttaccttgggaataggtgtgtttccatgggattcgattaatattgcatttccctggtgtatgtaaatagaaacaaacagatttgatagacacacctccaactcaggctttgtcttagtgatgatagaatgtcagggtagctataaattcttctatccttctatctatacggttggtttattagtgtcttgctttgttttaaagcagaaaacacattgtatggctcaaaggatcagaagatgcataaacatgtttgaggggaaaaaatattttctttaagtagtatggctggctacccatctcctcctgcttcaggcagccagtgtcaactatggtgcttttaagctggggaattagcatgtagttcagtggaaatgtgactttattttgtattgtatcatttaacatagaaggagcgggggtagggagtggggtgtgtgtttgggacctagggggcaaatatctgtatgaatagctagggaggtggtgccttagatgaagttagccaagggtggcacgtagcacctgaagtcggaagccatactttattgtgaagtgagagatcttgtgttagatcttatgttaaagccattacctcccctcttcagctcactgcaccctctgtttctgggcatccagagcagtctgttctcttctgaatgttgcatagaatgaatgaccctggtcccgcggctcacaagcgatgctagattgaatctctccttgccgtcttttcagataacagcccgccgtcagtggaaacatatttatgacgagttaggtggtaatcctgggagcaccagtgcggccacctgtactcgcagacactacgaaaggtaagacgccatctcctgcaaaaaaaaaatcctcgcttaattaaagctgtgttagttggaagatggttctgggcaaagacaggataggggaaatctaaaggattgttgggaagacaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcacttaccatgagctctttgggcttctggaaaacaaagatgggaaatgttgtcaggaggttaacgtgtgacagagccctggaaaccaggcattccttagcccaacagcatggcggcctcagattatgtctgtgtgctattcttttccataccttgtgaggacttcttcacctatagacatgctttctttcaactgaggaaatctcgagccaaattctgttcagcttggggtttctaataagctccacctgtttcagaaaaggactgatgatataaccaagaaagaatatatcagagcctctggggaaggcgctgtggacaggagtcatgaccattccatctgtccacttccggtgtgcctcccctcacattgcattaaggactgtgtgcctacactgactgtgtgcctagactgactgactgtgtgcctacactgactgtgtgcctagactgactgactgtgtgcctacactgactgtgtgcctagactgactgactgtgtgcctagactgactgtgtgcctagactgactgactgtgtgcctagactgactgactgtgtgcctatgctgctgagaaatggcagcaaattcatgagtggtacgtgctttgtgtaatgagtccatatgtaatgtttaggttgtaccagcttcgttacagctggtgctgccctatagaagtggagagggggttcataatggtgtgtgtacatgcctgtgtgcgtcaagagtacacacgcatgcatgtatgctgttggtatgaaatccagaggcctgtttagaattaatcctctactgtgcttagttactgttcttgttgctgtgataaagcatcctgaccaagaaacatacgtgaggaaaagtgtatatgactcgggaagttgggtggcttcaaatccagggctggagagttcaaatagaaagaggagagagggaaaaggagggagggagggagggagagacaaagagagactatgtgtatatgtatgcatgcatgcttttcatatgcatgtgtatgcacatgcatgcatatgttttaatagtgtccatacacacactgaaatcaggatacaccaagttagtggaacaaagcattcaggtaaaaaaaaaaaaggttaaaatgctaatattcactgattacttttctcatagtccatcggtaatccaactctgacctacatttatgacaaccacggtgggtcgtagacagtatccttcatatctcttgacatagtaggtgttcattacgttcccttgaagttcaagggcatgtttatcagtatctcatttttgactgtgtggccagttaacaaagttataatgtttgtttgggaataattgaagtaaattgagttgggtttagtaccttgtgaaaaattccctttgagcattcccaagagattgccctggccctattgtaatctggaaagattcttaaacatcaataatagatgttcaaattaccactcttggtagcactgtttcatatatatataaatataactgtgatttctctcagtacttaacatcaaagctcacacattcctgttacccgctgtaccaggcagctgatccccaatacaatgcctcctgggtgagggctttgcccacagtgctggaggctaccataacctacttatctttggcttaggagcctctaatcaaatcatggcatgagagacataaaaacatactctctcctctccaaaagttcccagcacccgaaccattaatcttaaggggacccaatgacagataaaactggcaaaaggactcacatagctgcagctagcccacttcctcgacaaatgggcatagtcattaactacattttacaacacagcatatgatcaagagcaggcaagaactgagttagagagaaggattgagaaggatcgaatgaatataggatgtgtgtatgtgtgtgtgtgtgtgtgtgtgtgtgtgtgtgtgtgtgtgtgtggtgtttcatttttctttaatgaggtgcatgggtactttgcctcttacatgtgtggaggagcctacagaggccagaagatggagttagatcccctagaacaggagttatggatagttaagagtgaccacgtgattgccggccactgaacaacttctggaagagcaactggtgtttttaaatgctgcgctgtgtctccagcccttgggtgtgttttcctccagagttttgtcagtgaaacagtcttgactggaatgctcagatactctggttgtacctcgatgaatgacctccctttcctaaggtgcagtagattcctgaatgatgtaaaactgttcatttggaaagccctagcaaccgcagcccattgcgaaatgttttaaatgtttcttttcattttctgaatttgtagcatcagactagacattctgtaaagttttggtctcccattggattacatttttcaagaggtataaaatattcttccagttctggaacttcttaggtcagcgtttgagttaggagactgtgagtggtagactggaagccatgttgaattgtcagcagggagaattcccagtaggccctgtcttgagcagaagggggtggcttcagtagttgaggggtggcttcaagtgctagtatgaagcatcggggaacactggtgttggtctatgcagatttcctgggtttccatgagaaagaagtcattcaggctctgcccacaagttgcaggggtgtgcctggaagagttgggagtttaagggagccttttgaaaagcacagtacttttgacatcagggaggatctctgtggggctgactctgcgtgctcatgggtttctgggaccgatgaaagaaactggagcctagaacaaatggctctgctattatccagtgacactgtatccgaccacaccagtaggtgtgtgcagagcctgcagccagggatagttctgcactgataacgagcctttcttttgctatctagactgctgcagccttctgatcagaatgctatgaacaattagtaattaataatcattagctaccagtatttgaagatcatgtttctcttttaaaccagtcatgattgaacaggttgattttttttttttttttttggcaacatgacgcaggttaggtatctaaggaaagggggatctcttttgaagacttgccctcggtaggttttccatgagcagatctgtagggcattttctttatgactgactgatgtggaggacccaggcccacctctagggagggagccccaagctgtataaaagctatgtaaaggaacaagcaagcgtcacagaacaagccaggaagccatactactccacacctctgcttcagttcctgcttccaatttcctgcctggagttcccaccttggcttcccaggatgatggagtatgatggaaatgtgccaggcaaatggactcttttctccccaggttgcttttaatcaggactttttaatcacagcaatagaaagcaaactatagcaatgtccgttaagggactcaccaataatcccaagagccagagtatgggaaagaggcggggccatagttctttgaatgtctgctctttcactggatctcccaaaagacagggcactctgatcagttcagggactccaaccaaagaagaggctggcctcttgctaaaggcataccatcaggttcattcattcttttcagtaacaagtcgtgtggccacacagaaaatggctggctgttttggtgaacagccaccattttcaagaagcttgggaagttgagagagagatcagaactttgtggtgacttttctaaagccttccagagatgggtcagaactactgaaacccttcttcctctgcagctgtgcgacgtcctctcatttcttagtgtgtgtgtgtgtgtgtgtgtgtgtgtgttgcatgcacatgagtgagtgcatacatgcctgcatgcatccgtgcacacactcttgtgcaaatatgacatgtgtgcgtgtgtaaagttcagaggacaattttttgggattgaactcaggacaccagggttgctggcaagtggtagccttccctgctgagccatctccctggcccctacattattctttgaagcacggtcttttcatccatctggttcagctggctagccagccaactccaaggatctgtctctgacccacagtgccgtggtgaatagcacactgccgctactactgggttttacatggtgctgggtttcaaactcaggtcctgacacttgctgagccatctccccagctgcttccctgtgggaagaatagtattcttacccttctaatacagggagtactgtttcccaacccctcccttttgctttgcttccctggacaatgatggaggagtgagggctctacatcgcgttatctaccgctgatgtatttttttatgcagtgcggttcgtggttccagtaaatgtttttgttttactacaagaaaaggaaaaaaaaaaaaagcatccccagttcctcattaaatgttacttgtatgttattagttgggcactttgggtttattaatgagtgcaataataaaagtaggagccatagaaatgaatcaatgggtgtttttatttaaggcagagcagagaccgtacttacagtggctgtgaatgtctcgctgtcgctgagggccctgctcgtccaaacctgtctctgattggtttaaataaaataggtccaagcacttcataaaaatgtctttgtcagccctggttttgcttctaaaccgattcatctctgtcagtgtttaatattagtgccaggctcctggccatagtccattagtactgtatttaattgttcatgttacagatgattaccaatataaaaagccttcgtgttttcccagagcgaggctgttgctatgtagacgtctcaaactcagcaaagcttatgaaatagggttgctttcaacatttcttgctgagatttatagattaagttactgttgatgagaacgccaagaaatgtctgtgttctccctggcaaagggctcttctgaggaccacattttctttcttatccaaccctgaagatgccctgaattattatcctttttttttttttaaatcgggtaagaaacaaaaacaaaatggctacttctgtggactttttttaatagcttgatttttttttttttctggagtagtaattcattttaaaggctttgttttcatatgtaaattttcttgtttttttatgtttttgaagcacaaaaaagggggatctttacacaaaatactagattactggttttaattttcttgaatgaattacatgctctgtttgtgtggagcacatgaagttgttattagggattttaaaaaggagcagcatcagggctaaagcgctttgtggtgtgcttttctgagtatttaggaaatcagaatccgaagcaaatgtatttgtttgtgagggaaatgagcgtttacacttcatcttcttgcgtgcataatgtccaatttcaaattctaaccttctgctttttccggaagagttcctttggttaagactccaatggctctggctgcttactgccgagtggcttagggtgagccacacccaacccagaggcaggggcgtggggggtggcggggtgggggggcagaaactgaatgacagtcatctcacagggtctgcctgcttttcagaaggtggtgggcaggatgtgggggggggggttggtgccactgagtaatacaagtactgtgctcaaaatcagacccccaaatctttgaggttcataactgggcaaaaagtcaagagaaaggaagtcaaggtgagatcccattccattcgtgtctaggacacaagtccatgtatccttgacacccttcaagctaataaacacacagttgagaaagtcacaggcaggaccccttcatattcatatgaactattgttatcagcccataaaaaggcttagtgaatgaggacagctacaggtaaactttgtgaactcactttgaattggagcacagtaattttattttcactgagtgtaatgaaagaaagaaagaaagaaagaaagaaagaaagaaagaaagaaagaaagaaagaaagaaagaaagaaagagaaaataatcagggcttgcatttgtgtgtgtcttttgaacttctattttccttaataactcatttttagtatattttaccaaagtggcagaagggaacacgttgggcagttaggagagtagccctttcctctggtcgttggatatgtgctgtttcccatcgtggtcacagactcgggtggctttgatacgttggtgcactgggagcagagattgctgaggaaggcacagcgtctggtccctcactggatagcagcctccaggaaccactgctggctcatgaaagctgcagaaagtcccggtttatctaacttatcaagatgcctgactcagggatgccacttaggtagtcaatcaaggctttagaaatcagatgtgtaatagatagaaagacaaagaggcagcagagaagagaggcaggaggtttccacccacagtgagacatcttcctgtaggctctagaatttgagctggatcttaaagaggtaaggttagaacttgagtccatcatcaaacagagaaggaaactggttttagggccgggaaggtatgacatcacctcccttgaaatttcccgtagttcccaattctgtgccatggatatgatgattaaaatgaatttaaattttataggaaaggcagtcccctttcgaacatgcctgtaaaggagtggaaagtgagattatgatttctaaggccttggtttcccaagcctgtgactcagaggcaggtaatgatgcttggtcctcactccctccagagagtatatccagcaggtagattactccatccctcatccagagtggagttgccagtcaggaattatatctgcttcctggctaacatcttgttcataggaattcatgtgggcagactctttttctctttctgcaacaccgccaccaannnnnnnnnnnnnnnnnnnntagctctccttgtcccctcaatactagtaggtccagctgtcccttactgacacacagtagctggaaaagccaaactcatctcgctgctgtgttagcatagctgctcttggcctgcctgtatccctaccccacccccaccccacccccaggcttgctccctggacggaccagaatctggtcactgtccacctccctctcgctggagtgaccttttaccatccgtaaagaacctctgcacagaggccagtcagtaattccaacccaagagcctcactctttaagcatgcctaaaatgttctgggaacttcccaatgcctggatatttcaagaaactcaaacaagactctagccagagctcatagtttgtaagcattagcaacagcatctgaaaaaaaaaatctctatttaaaaattcttaaatttgcctctgggtttgagctgtaatgactagaagttggagtttacgctgttgagtgtagaaacagcccgaggcgcacactcttcaagcttgtctgtctgctgtgctgagagccatggcaggttccttttctgcccgccccctctggaaaagctcgccaacccgcactttttccatgcccaagtcttttcttgtctccttcctgtccatttattgtctcctttacccacctccctgccgtttggacttggaaaactctacaggtccacccacccaaactttcctgcgagttctcatcaagcatgaatttaaatttgagaatagattatgtgccttagcctctttccttttttttttttttaaatgataaacaagaggcttatggtttctctctcctccggattttatcattaagattaagtaaccgcattctcaggcttgccactgtacaaacatcttttcagttgtgagaggaacagacgcacatcttcttcacaaaggatctattgaaaaatcagaaagcatgcttccaagagagaaagctggggagtgctggggggcggggagaggggagggaggctcagatgataaaatgaatgtaattgtttacccttaaaatatatctttagcttggccactgaaaaatctcttggaacattgtgttttggtacaagttgttacagagtttgtccaaagtcatgagttgctggagaaggtttcagaagccctggcaatgggtggtggcttctagtgtgactgggagttggtgtgatagccttcactgggagttggtgtgatagctctcattaggagttggtgtgatagctctcattgggagttggtgtgatagctctcatatggactcccacctgccatcacttctgggatacatatgatgctgagaatttcagtgatgcttatagactcacgaaaatggtgtcccccgcccttgaaatagatccatgcaactccagtcagagctagtcgtcgagaagaatcatttctacccatctattgtctggcactgtggagggttgggagctctctatggtcagtccatcttctgcaatgagagtgtattatctctggggcatggagttaaccaacctcctaacccgttctaggttgcttcagcatggtcttcatttgagaggcatgggaatgacatcagtctaggcagagaaatcctcagaagtagtgaacaagcatcgcaaagctaagctgagaagaactccaatagagagatcgtggtaaactatggccccgctaacattaagtgatggagggaaaatttctcggagaagccattcttcagtatctcttaatggttatagcagattgggccccataaacaaggccaacccatcctggagcatcctggcacacctgttgtggtggtgtacatcagagaagaaatgtgcccttcttgcaggctgtggggttgcctctgatgtgaggtgtagaccctttcttggatgaccctgtggattccatgagcctgttacctctgagaagagaaggctcacactgatctctcagacaatctcatagaagcctagaactttcttaacttgggcaggtgcgatcaattagggtacctcctaacaagattatgtctcaatctatgaagatggccacctagatgctggggcaggaagctctgcctagcacacctgggttgaattccaattccaggactcaatagctgtgtgccaccatctagttgatggttgtccaacccaatgacggtacaacatgaccttgttatctgcaagtatgttggggcacattcctagttatcctggcatgtatattatccatgacccacaggtcagacaccttgattcagttgtgatcctaatttttgctacccataaaatgaagtcaaaataatattcgtgtggctagctctctttataagtgttgaagggaagacatgcaaatccctggtattaatagtgacttaatatggtggctgctattgctattataatgcctaagcaatatatgatgataacctgtgcctgggtataacttggtggaacagcacttactagtatggataaggtcctgggttccacagatacatagcataactgattttctctctgcctttctacccttcctctacctgcctcaagtccttataaccctacttcagagcacccgtcatctttatctacctcttccacacgaggtcaccttgatagaagccaagccatcctcttgctgggtctctgaataaaacaccttttcatcttctgctcactgtgcctcacacgcactgtccaggatgatgcagagggtactgtaaataacagtagcccccaaaacaaagctctctcactcattgttccaggagagacaggagagtcccagcaagccctctcattctggtctttcccaggaaaaagaccctttctgaaagaatgctaatgttttgtccaggaagataatggactctgtgtcttttatggtgtcttggtgtggagcatagtctggtcacctgtatagacgtcccttttagccagtgcagcgcagtccactcttagtaactcttaggcacactccctcaggtactctgggttgtattcccgttcatctccccactcgattgagttctacccgggactgaacgctccactgcttggatggatgctcagtatgtgccactgtgccattgccttttctggtactggcctctctccccaaggtcaatggcttctgcagtttcacttcaagcccctcctcccacactaacttttttctttcttaccaaaattaacaccataatatgaaaatcttggtcagaacctgattgttcctcaagcatcttgtcccccatcaaagggatgatctccattctccacaaggtcacagagcacacgagtatacatctggtttctggtctgtttctctggtgcctaaatgctgttttggcattttcgctggtgtggtctcatttctggaaaggtgggcagcctgtgcagccagctcttctgtactcttgtgcgccttagcaagtatgcaccttctctcctcacaaagggaaaaaggcaattctcccagtccatatttgatgaaagattgcttcccatacttcacagggaagttatattttcaatttctggctcagaagggaaatgtctggccaaggcttagaatttatcaagcccggaatcaactcagagatgtaatgaggccatttggggtcagctcaggtccaaagccccagtggaacaaacatgttatttcttttctattgccacaaagaagccctgctaatggaagaataacggtaatgtctttaaccgaccgtacacgccagccttattatctctgccccttacctgttctgctccaacatttatagaaaatttttttacacttgaatttttaaagatggtttaataccgggagcatgcctctaagccagccagggaaggtttgagatgcagacacaccctaaagtctccctgctcccttccttaattctcaaaattgaatcagttccggacattattataatatcctcctcagagctctctataaatagatggatcatcatttatttctcctcttaagcaccatttgctaaatgttttggcccaaaagttcagtccttccatattaatatgcaccaattcaggggacgttatggctactcattaggatgagacagggcaggcattgttttttttcccctctgctgacagggaagggagggcgtgtcacttaataaatatgagggccctttcttcttttgtgcaaagtgtaaatgacaaggcctgcgatatatatttctctgatgccagcctgctgcttttggtcttgagaaagagaggcgaggccccagggaggattgcagacttggtaaatataaaattatctacctcagttttttttaaaaaaataataataataaaaagggagagagagttggcgagttgccagattccttacattacagtaatagatttgctgacccctggcttccgctgtagagaaatgtattgaatattttataatatcagaccgaggcacatctaaaaacctagtgttctgagcgtcattattcaactagagatttagcaatgccacagttattttccagcaggcaatttcttgtacgatgataatttgccagctcagacagtaataaatcaaggttataatgtcattgatttgttaattttaacttgggtagatttttaagtctcccttattttttttttctttcttttaaaggaagaaggacaaggggtggggggaatcgtgttttcacagtgactgaatttaataaggatctctgtgatagcaaaaggctcccctactgtttctgctttgaggtggaaaaatgttattcttgtattattcctggggaaaaaaataaaataaaatctcatgctgctccaaatcttatgcctaggaaaagctgggattttttttccccccttaatatgtgatggcttacctagttcacatccattagtgacatcgtaaataagcagtttgctaatctgaaataggaaatctggacaagaagaaagacccatttatctccacagccttccatctctaacctcaatgcagacgggaggtaggggtttgggggggatctggacagatttactaatgagtatatttcttctctttctctctgcttctacccacccaagactcagcctacattcttttgagttgcagcacaatgaaaatatttcttctgtgtaatggatacatttttcacggtgggggtggggtcatacatgtttgcttttcatctataccatctcgaagctgattaaaatcttctctgccctacaaatatttgagaatcaatcctctgagaggcacaggcatgttacattacactacatccttttataggatacaggcctacatggcttcctgtattgggcaacgctgatctgagagaacgctaatctgtttttaacgatgacatgtgtgcatggaacattgaaacgttcagaaaccgatcgtagcttttgtcctctggtgctgtagagaaaagttctaataatcagatgataaagatcacatcctgtgggggtaattgggctgcaccgggacaaaacttacaaaaaaaaaaaaaagacactcaaggaagtcacaagcggaagtcgctgtacgaaacagggcttgtttatgtactgtgtgggaatgtgccctgttcctcaaagctcgtatttcaattatttttctgtttcactgctgcctttcttgttttattttgggagcctttctctctccttctgagcaactctaattatatttcaatgatttagaagtggggaaaaaccactcacttagttgacctacacacacacacacacacacacacacacacacacacatgcacgcacactctctggaagccttgaacaagcagagcttgtatttggattgagttttacccttagtcatgcctcttcccagatacaagaaacatttaattcctgatttcctgccttctggcttcaggcctctgaccagtaaagtaaagatatattttgtactattggaggcttgcccgctgctaagttgagtcaaaatgagaaaagatgatagggggcaggcggggggtggggtgggaatgaaaatactgcccagcctcatgaacttgcaaaattgtaagataacttccagggatccctgggtgactccccaacctgttctctgtgttccttcctcctcctcctcctcctcctcctcctcctcctcctcctcctcaagaaagagagtctctcgtgatgtcaccatctccattagacaagggagccagggggagggaggcaccacaaatggcaaacgttggaataccagggcttctgagctccttggttcccatggtaacaaaacaaaagcacaacaaacctatctgtcccaacaataaaatgtgttttcattaaaatcaatttaaaatatttttccagctcaaaatattcaatgcatttttgctcctggttggggaaaaaaaaatcccttactttctgatattgaaaaggggatcaagtctcaggctgaacaatgcagaaaagagaggaattggtgtatgttgggggctgggagggaggagttggtgacttcagagatgagacaaaatagattcaagtatgaacaagactgctttttttccctctctctcttctgcctagttatgcttttcattatataaacacgtactataatattatggtgggaagcaggtatttggcaaccatatattattttagtaagtctacatgaagagagccgtttccagttttagcagctgtaacgtgtttaaacttgggctgtaatgggatctgaagataactctcccccatgggttgtgttgatcttcgtgactggctgagtgccacacagaggcctccacagtattacccatgcctctttgcacatgccatgtctgtgcatgctcgctaaacagacctgggccctaagattccataaatccacatttgactttttctacaatgtgcttgcttttgttggtggtgtctcagatgtctccaagtcttaactgagaaccccagaacagtgagtggtatgtatttaagtagctaatagacaaattgcataatcagaaacaaattttaagatactcaacaaatattccaaatcaagattcttgggggcggggtggagtggggagaagaggttcgggtatcttagcttcaaaataaaggattcccaatatttgaacagattgctgtttcttctaagccaagtacattttcttcattgagtcaacttgtcgtatttaaaacaaattatgtttgctgtattaaggttcacattttgaaggccgagccttgtattaatcccacagtgagtcattaatcataccaaatgcattagaaaaactttaatcactggattgtaatgcaacccgtgccttttaattacatcagctctttcctggttcagatcaagagctgcattgcaaagggaacagattaaaaacagagctgtttgatgtctccctttttagagcaattttatgcactttgtttttaaaagttatgtaattaaaatgttcggaatttttcagtgctctgattttccttgctgtggtggttagctggcttccttctggctaaggccctttctgacttggcacccaccccccccccccaaaaaaaaaaaaaaccagaccttctcctggatgggattgcctgtcccatcagggctacagaatacatctgtcttggccaaactgagcatgcctcctcttgacctttgacctccagtgctggtcttcaaggtatagcagtggagaggtgtcaaagccagtattatatattgtatttttttccccattggttaatatttattgaatgtggggttgggtttcgtgaaagtaattcctatctactgggccatgcatggcaagtctacatgttgaggtaaataaaaatgataactctgaccagagatgcaagcacattcaaattccaggtctaacaactgctgtgacccttaggctcattgcttaatcttgggaatggtggtgatggtggtcatgctggtggtggtcgttgtggtgatgatgatgatggtgatgacaataatccgagaacatgtggcatagattatatggaatgatttttaccgtctacctagcctgtcttagaatagaagctggatgaggtcagaggctcagaatatttggttcatggctgtatttcagtatctggagcagtgcctggcacagggtggatacttgataagcatttaacttaactgtaagtgaacagcagctgtcactattttcctgatgtcaccggcaatcggccaagtgctagcggccattgtgacaatgtcaatcttggctccctccattggtgttcttaatgcatcagctcgcagaaccaaaaggacagaagtcttccagagaagtatttaggagaccagataagcaagtttcactagtagagtagattacatcgagtgagtctctagggtgtatacatgacacatggatgtggccattcaactagttacttatgcatggcttggctttgcctggtttcagcaacccatggtcagccatcattgaaagacaatattcatcttatctgttggagagttatgtgttagtaacttttactattgtagtaggttgttctaattgttctatttcattaattatagctactaacctcttactctacttaatttataaattaagctttatcagatattgaaccatagggaaagactaggatacggagagagcttggtactaacaacagtcagcatctacgaggagccttagaatgcattgctatagatcgaggatggggctactatgtaagaggaaacaaactccataccaatgatgtcactaagctccataccaatgacgtcaccagaattggccaaccgatgacacatctcatctgccttccatttaggttaatcctgccatacgaaagatttattaagggagaagaagataagcctctgccgccaatcaaacctcggaaacaggaaaacaatacgcaggaaaatgagaataaaacaaaagtctcgggaaacaaacgtatcaaacaggaaatggccaaaaacaagaaagaaaaagagaacacccccaaaccccaagatacatctgaggtgagttgctgcaccccttggtggtgccaaccctagggaacacacttggtgatttcatagccaggtttttaaggtgtgacttgggggaactggggagaggggagggaacaggtgtcagagagaacaagggttaaaatctctgggttcctccttgggattttttctctaaaattttagggacattcacttctcattcaacagccttggattaagatcaatttatcaacatctttggtctatattggttatagggagagtacaaagtgattccacagaaaccgttaatatctctcattttaatagatagtttctggacctttgaagtgaagcttcaaccctcgtttctcaatagaaagcatgcctggtagcatccagccaaccaagcaggctgatctgggctctgtttcaacatgaataatcaaaaatccagctgcccatttgaaaaaaaaaaaaaaaagacaaaacaaaacagcagttacattcagagacagcatgttctaggattcaacccctgagggaatttgggtaccgatcttcagacttacaatgaacatgtaagagagagcttcattaaataccagtttaagacacagtcccatacacacagaaagagacacaaactcccagacggttccttctttaaaagatgatattaatacctggctttgctggagactaaaccttgaacctcaggttttgcacatactagtgtagtgttctactggtgagctgcaatcctgcacagttgttcacttttgggtgaaagacagggtctccataagttgttgaacctggccttgaactcatcctgcagcacaggcagaacttgaactcacatcctccagtctcagcctgagccaggctgaattttactaagtttcatgaattttaagttctacatattctaaaaggaataaaatacacgatgctgcagacttgcaaacatttgcaagtttgcaacaacaacacaaatggcccaaaagcaaggaaattccatgttaaggctcacattccattcctcttgactctggtgatttatcacggggctttggattgctgagctctattagataccagatgcacagcacagccaaagcaccggcggatgcttggaggaccgtgaggccggctgacttttgaacggctccaactgggtgggcaaactgtaaaactgagtttgtaaactgcagcaaggatccttagtccactcccggagccccttagctcaggaggtgacaatttccaagagcagagtgggcagcctggctacaaagagtccttcggatctccaaaagctgtggctctccctgttctcagcaaggaaattattccagtgccagtggtgcccttccctggagtgggctctgggcatctggagcatccaagtctgtcatgtgaagtcttgacatctccacctctttgaaatcatatatacagtaagaaccaggcccaccgactccacagatctctattataaattcaacatacctgtgagccaggtttaggagttgcatttaatgccatattataggttttgatgttttctacctgacaactgaaggcagtggagaagagggaaggagtctagtcaaatccactctcctcggggattacaaagtacagagtgagacccaggtagttcagaaagcacaatctttagaggaaagaaataaatgctttttcttttattggcctaactttcaaatccctccctaaaccaggtttatagacagatatgcaagactccgagatagctgaaggccaaggtcaaagaaactttgttgagttgagcagtttgccttttacactctcctatttttatgtctcttaatgtataagcttaagaatggaatttgagccgggcgtggtggcacacgcctttaatccctgcactggggaggcagaggcaggcgaatttttgagttcgaggccagcctagtttacagagtgagttccaggacagccagggatatacagagaaaccctgtctcgaaaacccaaaaaaaaaaaaaaaaaaaaaaaagaatggaatctgtgcttaaaaaggcagttactatgcgagaagagggtcagactgttgggtatcacatatgcttggcaagcagggttatcttcatgtacatttgagaaaaaacatccacaaaatgggtatgagtccttgaaagtactttttccaaatatcccccaatccaacatttgaaagtactttttccaaatatcccccaatccaacattttaaaatcttcctcaaaggtatgatttactctgtagttttgtcacagcagaaaaggtactagtgatgtgactgggccaaaggaggggggaccaactcaataatgtttcgtgccattattattatgcaaaggcttgtccatcagctgtctcacaacacttataaagtcaatgcttttatgactcgatagtaaatggcttaaattatgtcccaatctactaccaaaaaaaaaaaaagtagccattccactgactgatttatttcaataagtagaaaagctgtgttggaggcaacaattctacctgaattatgtgaattatttcatttgtggctttgatagcaatgagtttggtgtgccatagaaggacttagactatcctctaactctggatgcacggatttccatctgcttatgtctttggtattttaacaagaccaacaccttgtattgttctacgaaacaactagtaatgtaactatagctggtttccaggggatcccactgaactccttagaaggggaggttcttaaggaaaccaaggaataaacctgtttgttactggcatggggttggttcaattttttgagagatgttaccaaaaaaaaaaaaaaaaaaaaaaaaaaaacctttctaggaagcatcacaaagtgcaagtgcaacatgtaatttaaaacctatttggataattgactgatttgacaagaagacaaccttaaaattaaactaagtatcaaaacggaacgatctgctatgtcaggacgtcactctgctgttttgataggtgtctcataaggggctgaagcgaacacgcttatttccctgaatgtctctgtaatttagatttctttgtttagagccgtgattggggagtaataaaaccttacagaaacttggtgagttgattgacaagcctggcttcaaggataactgctgtgtgtgatactctgtttcctaatgaagtgtgtcggcgtgcatggttctcttctaactgtctcctacgttgtttttccaggtttcatcagagcaaagggaggaagaagagacgttaagccacaaaagcgcccccgagcctctccctgctcctgaagtaaaggggaaaccagaagggcacaaggatcttggagcgagggccccagtgtccagagcagacccagaaaaggccaatgaaactgaccaaggttccaacagcgagaaagaggccgaggagatgggagataagggccttgcccctctgcttccaagccctcccttgcctcctgaaaaagattcagctcccacccctggggctggcaaacagccccttgcctctcccagcacccagatggactcaaagcaagaagccaaaccctgctgctttacagagagccctgagaaggacctccaaggagcacccttctccagcttctctgccaccaagccaccactgacaagccagaacgaggcagaggaagagcagcttcctgccaccgccaactacattgccaactgcactgtgaaggtggaccagctgggcagtgacgacatccacactgctctcaagcagaccccgaaggtccttgtggtccaatcatttgacatgttcaaagacaaagacttgaccggccccatgaatgagaaccacggacttaactacacgcccctgctttactcccggggcaaccctggtatcatgtccccattggctaagaaaaagcttttgtctcaggtgagtggggccagcctctccagcagctatccctatggctccccgccccctttgatcagcaaaaagaaactcattgccagggaagacctgtgctcgggtttgtcccagggccaccacagccaaagctctgaccacacggccgtcagccggccatccgtaatccaacatgttcagagcttcaaaaacaaggcctctgaagacagaaagagcatcaacgacatcttcaagcacgacaaactgagccggtccgatgctcatcgatgtggcttctccaagcaccagctcggctccctggcagactcctacatcctcaaacaagagacgcaggagggcaaagataaactgttagagaagagagccgtctcccacgcccatgtgcccagtttcctggccgacttctactcatccccgcatctccatagcctctaccggcacacagagcaccatcttcacaacgaacagtcctccaagtatgccgctagggacgcgtaccaggaatccgaaaacggcgcctttctttctcacaagcacccggagaagatccacgtcaattatctcgcatctctccacctgcaagataagaaggtggcagcggcagaagcctctaccgatgatcaacccacagatctgagccttcccaagaacccacataaactaaccagcaaagtcctgggcctggcccactctgcctcggggtcccaggagatcaaaggcgcctcccagttccaggtcgtcagcaaccagagtcgagactgtcatcccaaagcctgccgggtatcgcccatgaccatgtcgggccctaagaaataccctgagtcacttgcaaggtcaggaaagcctcaccaggtgagactggagaacttcaggaaaatggaaggcatggtccatcccatcctgcaccggaagatgagcccgcagaacattggagctgcgcgccccataaagcgcagcctggaggatttagatctggtgatcgccgggaaaaaggccagggctgtgtctcccttggacccagccaaggaggcttctgggaaagaaaaggcctccgaacaggagagcgagggcaacaaaagcgcctacggtgggcattctggggctgcctcagaagggcacaagctccctctctccacccctatcttcccgggtttgtattctgggagcctgtgtaattcaggcctcaactccaggctcccggccgggtactcccattctctgcagtacttgaagaaccagacggtgctttctcctctcatgcaacccctggctttccactcgctcgtgatgcagagaggaatttttacatcgccgacaaattctcagcagctgtacagacacttggccgcagccacccctgtaggaagttcctacggggacctgttgcacaacagcatctacccattagctggtatcaaccctcaggctgccttcccatcttctcagctgtcatctgtacaccccagcacaaaactgtaagcctcgatttgcccagcatccccaaatggtgtggtccattgcaccaactcttggaggggctggcttgcaaagttggaagtcagtattccttctgatctggtttcgccccagccatagaggtgtacatacctgccttttccgggacaaccctagcctgactggccagttgtgacctctcccttccaacacagatggcctagggcctgggggtcattgtcttttcacgttggtcctgtgaaggtatctgtggtctatcctagaagaacgcagaggaccccatctgagtttggatggtaaggaagcaacttgagcataaagttctggggtgggggaggcaggcttttcaaaggcaagggcaagaaagactggcatggaatagccaggggatgcccgtctttttcatcaaactcaccaagttcaatcaatgcaatgtatagtaaaacttaaagagacctttcattctgacactattaaacaatccagagaaggaaacactgttaaactgtatatattcgcttcttaaagctacccgtatcactgttggctcacctaatttatatacaggtagttgtgtttccctcccggttccttcttgttcctgccctgggttttttttgtttgtttgtttttgtttttgttttttttggtttgtgtatctgtttgtttgtttgtttgtttgttttttaattaaacagcatcccttctgtttgtaggtcttttgatttgttttgttctgtttgtaaggctgactgattcttctagttgtcaatgtgtattctatcaaccccaccccaggccccgcccccgtccccaccacatcttcttttgagcagctttgggtggtcaagttattgtttacaaattgaagcaactgattttagtggaacagactgtaaagaaacccccccccccggagaacacaagctagcttaaagcctgtgcctttgtgggtctgcgcctggaggatgctgcccctcttaagtgggatggctatctgaaagagtttagatactgcttcccccggccaaatgctttgctttgaagtattggattatgtgaaaatgttaagcattgcactcaccttatctaggctgtgaacccgtcctacataccagagaattcagaaaacaaaaaacttgttggtgaaaagccactgagtggaccccacttcatgggctgaggagaggtttcaggaatttcaaaacttaggacaagagccagggtaactcatgccagtgctggaacagcacctttcaaatggtctgcagaaaggggacttgggaaagggtagtgtgtaactcccaaggtctgaccattgggctacccagccaggccttggcccatcaagggacagggtgattgccatcatcagatggcttcttgggtttcctagtaagattctcccaaggagacatctttgaggaataattggatgacctgtttgtgaaagaaagccatcttcttgggtgtctagggcctgggtttgatgagtatttgtccccgtaaagtggtttgtatcaagtttttcaccacgtggccatgctatctgctttggaggtcttttgactggcactctttgccaacgattccatttgctcccaaagcacaaaatttgctccgtgtagcacgtgcatccttagaatggattctcgttcccatccgcacccaaccctgatgaaagcttctttgatgaagtccgcagcccactgccctcttctccactaacgccagtagactataggaccatagttaactctctctctcttttttttacctctgacatatttaagtctatgaaacttgatgacggttttcaacatctctgaataggtaactgaactacaaaaataatcaaaaccagtgaccgtgaatctacggctcttaacgcaaagccatgcatgccattcgttcttattgaaatgtcctcatgatatgaagccaaatagtccatgtagtaacatgctatccaaaggtggaaacaaaagaatgtagcgacccagtgttaagagttccattcgcttcaattaattatttaccttcctgtggaataatatatataaatatatattatatatttaataggaccatagatagattagtataacttagctcataaatgtgcacatgcagaatattctgctgttgttgcacaagaaaaagggtgtgtgtgttgggggtgggtctcaattccagccagcatgatactggccaggacacagtatgaaaaagtgacgctagattgaatagccacagaatcagaagaggagaaaaggaaccagggattctatagcagacatgggctggatccatacacggtccctgtgagttcatttctcaatgcaaaacggcgatgtctgtccccacacaaaaaaacccaccaccaccacaagctcacccatttgtaagatggggcgactgatttcctcagtgcggtgatttgtgatgtgttcgccaagtaggaattcaatcacgccattttcaaacaatgtcaacatatccagctattttttttttctcatctcttctgagaggagactcactatttctgttgtagggagctcggaccctccgtgaaacatcaggaccaatgcaaagacctgggggccggggagggggggttactctcccagtagaagtagtgtgttatttgttttcaaactccaaacggagatcttggagatctttcaaaaagaccattgaatttctcattggctgagaaggacattttttaaaagtcttaaatctggctttgtttgcattgtttgagttcaaggggccttattattgaatggcattgcacaagcctttcttttttgcaagcaaaccattgttattagttgttctgtaaaggaaattgtggaatccaattggcactggagtcctaaatccatttaccaagtgtggcttccgagaaatgttgtaattcaaaatgtatcaagcccgtgaatttgttggggatttggagattctaaataatatttaaaaagatgtcatctctaggcaacttcgggggtctcacttttggaaattcaacttaaaaataaagtagaaagtaaaaataaaaataccacaacagcccaaccaagtgttaagcttaaagtatttttttcttagtaactgattcaaacatgtagcgtttgccacaggtcagactggttcatttcctagctagaagctcccggctttacttgttcaacaggacatcgacagaagggtttgtctcagtgttgagctcacacagctttgccctctggtgcatgactccttgggtcctgtatttcactgtgtcggtgtgtctgatggaagtttcaaggtggtcccacgaaatatattttatgtagtgtgccttcaaagagaaccatttatctctcttctcgtgttgtcccactaagtcacatttggtggtggccagccaagtcccgtgtggtctagtctgacttattatcccgggctgagaaaggaacgggaatggttttgccccagtgagacccacaccgctggagcagggactttgagcatctccgctccggtgttgactgttgatgtatttgatattctgcttatctcccaatggcggaaagaactctgaaaaaaaaaatagcagcgtaatctcttggctgtttatacttttttaaacttccctgtgttgtaaatattgtacactctgagtaaccccagctatgtaaccttgatgctctgtaaggtgatatttgtatatagcaacctggcccagtgatgttatataatttcccaatggagaggttattgagtagccttggcctctagttttaaacactaccagaagaatgctgagccaactataaacactcaatttttgtatgttttccaaattgtacttattaccgcttttgatactgtattctgtctgtgccaatggtttcccaatcacatagcaggcaagagatattttgtactttttgatccactgtaatatttaataaaaaatgttactatctgtttcctttgggagtgtctgtctcttattcctggggagctttgtggccagagcaaaggacttccagtctctgctttccaaattggagatggtaatgttgataatgagcgtagcttattggggacctactagaagcttccttcgcctatgaatggttatggctgatttactaatgagaaaattatagtttagaaaggttttcacttgccaaagagtgtctgactaacaaatgatagagtcaagatttgaacttggcaagggagggtggaggagggacaggaggaggagggcaggcaggctgctaaatgtctcccatttcctaagctgccaggtcacataaagttactgtttgttgagttagtcaacaaatgtacctagatacctccattgccagggctttgctgtttggaactgggaacacaatggaaatggaaagaggctcccagtggagcctaaaagtctcactggaaagaagtcatttacccttataaggttaacagcccaaggtgacctcgttctgggggaggagtctgatgactaatgtgatacctaagaggaagtcaccactgaacggataagcgtgcgttagctagagtggactgggagagggtaatttaagcatcagagagcacatatttaaaggccccgaagcaggaatgagttgaatttacagtaattgaacagggtctgagggtgatagcttacagggcgtgattaacagacaacaatgaatgaatgtggttaggtgaggttaaagtatggtggagaccatctaagtaggccagattgagcctctggtcattgtcctgaccaaaagaagaggtttaagcagggagaccaccgagttaggttgtccacactgacatcattcacaaagagctgccgagtggagacaggcagagtgcagcctaacatagaagtggcggacgttttgcctggggtggtagactggatggccacatccctgagggacttggaagaaagagcacaggggttgaaaatgcaggaacttgacggtatcaatagcgtccattgggtagagatgataaagatgttgggtctttccccgaaagcctgtgggctcgcccctggcccaactcaacttgccagcagtcgaaatgaggcatccgtgacacagaccgacggattcctttcctgaggagtctcggagataaggcaggaagggcaggaatggggtcaggggaggattccggtgacagttgaggcttgaggccatatcacatcatcgggataggctttgagtagaccggagaaatcaatttggaggcaagcatgcatgccactacaacaatggacgtgtgggacaggggcttggggggagcatccatttagataaaaagataatccaggaccccttttctcattagaatagactctccaatggactacaaggccagcaagagtcgtgacaacatagctgtgcttcccaccctctcctccctgactgccatcccttttctaacgggaaggacccttagccccatggtcctctgaccatgactttgacccacgtctatctcatcctgtactgtggcttggttgcatacagcagaaggatatctatccctctgcaccacactgagcctctgtagatgagattcaagcacaacaggaaacgtcatgatttttttttttttaaatcaggcttgcttggtaaatgttgtcagaacgggacaatacctttggtaaagattcacttggggcacaaaagcaatgaaaatacctaatgatacattccaggaaaacggccaaagagaacaaatgttttacagctgatagcgatcagggtctgagtggttatttacagtaagcctaagtggagaggaagagctggaaatgaccagtggtcaggagtggggtaagagaagagagagccataaggttgatctacaaaaataaaaataaataaataaataaataaataaataaatagatagataaatgaattgcattaatttgtgctacatggattcagaattcctgaattcaaggacctctgggcaagttatcagaattaacattgtgaagcatctgttgaaatagcagactatttttaatcatgtttttccagggccacaggcatccagccagctgctcgtgtataggtcagaaccacaggcgttcagccagccacctcgtggtcactcaggtctcttctcagaatccccattgcattcattgttactgactcgctgtgggatccaactgtccagtataacttcccgggggtgggggtggtagaaatgtttatggaagtcttttccaatatcatgtctcacggccagtgtggtgactgagcccctaaaatgtgcccactgtgacaagggaactgagtgctgaattctgtccgttacatttgaggagccacatgtagcgggatatcaaatgggacaatgaagatctagaaaagccagatggccaatctgtctttggctacactaactgcagatattccgtgtctccccaacacagtaaagcaatgacactgtgcctctccttccccatcccccccaaaaaagaaagaagaaattaattcatgaatggtgatgctctatttcattgtggatttacacactgcaggagttaaattctcacttaaggagtaagtcagtcactgaacaagcaaccactaggaggtgctcacgggtatggcctctggctccagcccgacttttttggttaaatctaatgatgggaagaataaactcagttttcagaaagtctgtaacgtgctagatacagtcacattcaagtcaccctacttcattctatggcagcttatcattcactgtagagccgagagaaccgccaacatgagatagattgcccggtagcaaggccctcggggtggggcacagcatcttgtatagttaagtctactgacaaccatgttttggtgtttttttcaagcctgggcctgtcacttcactgatgcagtgacgactggagtaattaatgatctgaccatgcacactacccgcactgcataaaacgttgctttggtttggtttggttttggattgggggaggggcagaggtctccattcatcattagccctcatagaaatccacgacataagtacgatacttatttccacaaaaatgaaaagtaaacaaatggtaaacatgacatgcattcgtacttgacaactgtgaaaaaaacaaggcattattgagatcttgctaacctgtcaggatgagacatgcggccctgtcgtggtggctaagccttcatccggtcattttgtctagactcttctccatcatccccctcttcagccctaaaattccccaactgaatcctcccaaaacctccaagtctcagccttgtaaggcaatttgagaattaatgagacaaaaaagaggaaaaacaatacaaggagaggttctcaataaatagtgttagcaaagaaaacagagccaacgggatggtttaatttattagaatcaagcttagagaactgggatttttaaaacatattttttttcctaaggtggggaaaaaaactaacaaaatgttctgaagcccatagaattaaagatttgcttggcacgcaaatattttcctgtccaaaaagcaccaggtttgtatagttttagaaccgtttcaaagaactgaagactaggaatgggtagaccgttctttatgagttctctgtcatcttattgccaagatgcagaaagattagtaagatcccagctataaaggcagatgttttcacaggtatatacattcagacagatgcactcatgtttacataaatagatgaaattatatacacaaattatttattcaaactatattaaaataatattaaaccgtgcccaagaagagcttattccagacatatcaggatagcaggaactaaattttttactaacgaaataatatacagaataaaatcccatctggaataaaattaggttgagcccatatgtcaagcaatggacagatgaactcttagtggaatttctggctgaaaagattttaaagaaaacactaggataaattcctaactctcctaggggaaaaggcaccctaaccactactcaggatttccatgctgtaccggcttgctccatacagtctccatttggaaaagcaaattccaagtgttcatttgattgggaaaataagtgcttgggccttcacccaaggcttcatttcatttacaaagcgcctctagggaatcaccaaggaagcaggcagaggtgataagaagtacagacatagagcattgcaactgaatgagtttggacaaatatattcacctacatagacccacccctccaggtccccaggggattgtttttagaacctcctccaccccaggatgctcaaactgacagataatcaggagtctagtacaaacagctcagtatttgtaaatcactacatatgccctcctgcacacttgaaataatcactaagtgactttttaaaatgtattcatttttaactctgtgtatgtgtgtgtgaagggtgtttacatgtgagtgccagtacccacggaggccagaggagggcatccggttcccctggagctggagtcagtcttagaatctacccgacctgggtgctgggaagtaatcacaagtgctgttcttaattgctgagccatcttgccagcccatctagattacttataatatcaaatataacataatgctatgtaaaattgccacttctccgtgttgctttaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 854 - DNA, 2432 bp, Mus musculus
cagtgggtcggctcaccgtgtggcttgcacggaccttatattttttataaggcttttcaattccaccttgaaggcaaaccaagaatcttgtcccttggcgactttttctttgtaagatgtacgccaaaggatccgatttgcatagcggagctccagctgttgtgggaagaaaggaccagccggcaacttttatccagctcgaaactttatttcctccccgaagacactccccagggcagaaatagcgaccatggcgaggatgaggtcatcgctgtctctgaaaaggtgattgttaaattagaggaccttgtcaaatgggcgcattctgatttctccaagtggaggtgtgggctccgagccactccagtgaaaactgaggccttcgggagaaacggacagaaggaggctctgctcaggtacaggcagtcaaccctcaacagtgggctcaacttcaaagacgttctcaaggaaaaagctgatctcggggaagatgaggaagaaaccaacgtgattgtgctcagttacccccagtactgtcggtaccggtccatgcttaaacggatccaggataagccatcgtccatcctcacggaccagttcgcattagccctggggggcatcgcagtggtcagcagaaacccccagatcctgtactgccgggatacctttgatcaccccactctgatagaaaacgagagtgtgtgtgatgagttcgcgccaaatcttaaaggcagaccgcgcaaaaagaaaacatgtccccagagaagagattccttcagtggctcaaaggaccccaacaataactgtgacggtaaagttatcagcaaggtgaaaggagaggccaggtcagccttgaccaagccgaagaataaccacaataactgtaaaaaaacctcaaatgaagaaaagccaaagctgtctattggcgaagaatgcagggcagatgaacaagccttcttagtggccctgtataaatacatgaaagaaagaaaaacgcccatcgagcgaattccctacttgggtttcaaacagattaacctttggactatgtttcaagctgctcaaaaactgggaggatatgaaacaataacagcccgccgtcagtggaaacatatttatgacgagttaggtggtaatcctgggagcaccagtgcggccacctgtactcgcagacactacgaaaggttaatcctgccatacgaaagatttattaagggagaagaagataagcctctgccgccaatcaaacctcggaaacaggaaaacaatacgcaggaaaatgagaataaaacaaaagtctcgggaaacaaacgtatcaaacaggaaatggccaaaaacaagaaagaaaaagagaacacccccaaaccccaagatacatctgaggtttcatcagagcaaagggaggaagaagagacgttaagccacaaaagcgcccccgagcctctccctgctcctgaagtaaaggggaaaccagaagggcacaaggatcttggagcgagggccccagtgtccagagcagacccagaaaaggccaatgaaactgaccaaggttccaacagcgagaaagaggccgaggagatgggagataagggccttgcccctctgcttccaagccctcccttgcctcctgaaaaagattcagctcccacccctggggctggcaaacagccccttgcctctcccagcacccagatggactcaaagcaagaagccaaaccctgctgctttacagagagccctgagaaggacctccaaggagcacccttctccagcttctctgccaccaagccaccactgacaagccagaacgaggcagaggaagagcagcttcctgccaccgccaactacattgccaactgcactgtgaaggtggaccagctgggcagtgacgacatccacactgctctcaagcagaccccgaaggtccttgtggtccaatcatttgacatgttcaaagacaaagacttgaccggccccatgaatgagaaccacggacttaactacacgcccctgctttactcccggggcaaccctggtatcatgtccccattggctaagaaaaagcttttgtctcaggtgagtggggccagcctctccagcagctatccctatggctccccgccccctttgatcagcaaaaagaaactcattgccagggaagacctgtgctcgggtttgtcccagggccaccacagccaaagctctgaccacacggccgtcagccggccatccgtaatccaacatgttcagagcttcaaaaacaaggcctctgaagacagaaagagcatcaacgacatcttcaagcacgacaaactgagccggtccgatgctcatcgatgtggcttctccaagcaccagctcggctccctggcagactcctacatcctcaaacaagagacgcaggagggcaaagataaactgttagagaagag

SEQ ID NO: 855 - protein, 811 aa, Mus musculus
  VARIANT (1)...(811): Xaa = Any Amino Acid
QWVGSPCGLHGPYIFYKAFQFHLEGKPRILSLGDFFFVRCTPKDPICIAELQLLWEERTSRQLLSSSKLYFLPEDTPQGRNSDHGEDEVIAVSEKVIVKLEDLVKWAHSDFSKWRCGLRATPVKTEAFGRNGQKEALLRYRQSTLNSGLNFKDVLKEKADLGEDEEETNVIVLSYPQYCRYRSMLKRIQDKPSSILTDQFALALGGIAVVSRNPQILYCRDTFDHPTLIENESVCDEFAPNLKGRPRKKKTCPQRRDSFSGSKDPNNNCDGKVISKVKGEARSALTKPKNNHNNCKKTSNEEKPKLSIGEECRADEQAFLVALYKYMKERKTPIERIPYLGFKQINLWTMFQAAQKLGGYETITARRQWKHIYDELGGNPGSTSAATCTRRHYERLILPYERFIKGEEDKPLPPIKPRKQENNTQENENKTKVSGNKRIKQEMAKNKKEKENTPKPQDTSEVSSEQREEEETLSHKSAPEPLPAPEVKGKPEGHKDLGARAPVSRADPEKANETDQGSNSEKEAEEMGDKGLAPLLPSPPLPPEKDSAPTPGAGKQPLASPSTQMDSKQEAKPCCFTESPEKDLQGAPFSSFSATKPPLTSQNEAEEEQLPATANYIANCTVKVDQLGSDDIHTALKQTPKVLVVQSFDMFKDKDLTGPMNENHGLNYTPLLYSRGNPGIMSPLAKKKLLSQVSGASLSSSYPYGSPPPLISKKKLIAREDLCSGLSQGHHSQSSDHTAVSRPSVIQHVQSFKNKASEDRKSINDIFKHDKLSRSDAHRCGFSKHQLGSLADSYILKQETQEGKDKLLEKX

SEQ ID NO: 856 - DNA, 213040 bp, Homo sapiens
  misc_feature (1)...(213040): n = A,T,C or G
taatattaaatgtatatatatccaccacaaacaaaagctctttgcagtcctcaataatttttaagtgaaaaggggacctgtgaccactggtgtaaaggcataaaattgcatgacatgttcaaggaataaatgaataagtgtagttagctacctccagttctttttggaagtagacagagtataaattataaatatatacatcacacattcatacacaatgaatgtgattatcatatcctctcagcctatgaataacagataaaatataccagaatgctgagagggttaatctgaatgtatgcgtgattttgagaaaggacgagggagcagatttagttaatccagtgaaagtcatcgcatacaaatttgcaaactaaaatactccctgggctgaggtcatgtgtttaattttagcaagtagggtgaatacgtttgggtaggtatttatactaagcagtggactgagctggagatgggtttgacagtggaaacagtgatacaacctttattattttcaatgcaaaaaaaatgaactattaatgtgatgttctggttgaaaatttaaactctcaaaaaatctggaaattcaaagtcatggtacccatagcaaccataactctgcccccttgcatgcccagtgtggagtattttgtattgcagtacatgctgtgaaatctatgcctaaatgtgctatatagcagagttacagttgctgtgggaactgtaactttgaattgcctgccttttgtgtcattaaactttcagctgaagtattgcattaaaggaggttttttttcctctactgcgtttcctcatttaaaaaaaaattgattgggcaccttttttaaaaaaggatgtaaatgatgttagattcaaatagcaggataatgcattctagcttcccagatacatgcactgatatagcattagtgaattaccacatttacatatttcaacctgcaataacaagtcataaaataatcctctatttatatagcacctttaatcctgaagggtcccatcacacacacagacacacagtaaccgaaccactctggacaagaaaactcaataaatatttaacagcgcccaacaaaatcatacagtgctttaggacaagcagtaaggaagaaaggcactgtcatgcagtggtcagaatacaaaccaaggagtgagaattctcatgctccactcttacttttatgatggcatgggctctccccgtgaccttgtcaatgatttgactgcctcacaaaaactctgagtattcctttttttttttctatctgtttaccaaggaagtatttctaggaccaaaggcaagaaaagacttcaaaaggtcatttggttgagttgactactcccaaccaagggatgtatctccatattctagaacaggagtcagcaaatttctactacaaagggcaagacagttaaatattttaggctttgagggccatacggtctctgtcacaactactcaattctgctgttttagcgcgaaagcagccatagacaatacataaatgaaaaagcatggctgtgttccaataacatttatttacggacactgaaatttgaattgcatataatttttatatgtcacaaaatattattcttctactgatttttctgagccatttaaaaatgtaaaacatgttcttggcctgggtgctatagaaaagcaggtggtaggctgtagtttgctggcccctgctctagaagtctgaattgtatatcatgttcaaagatacctatacaatgtggtgtgctttcaaatctttaacaattagttcctcacccccaaaaaggtatgtatgttttatttaaatatatacaaagatctagatctagatatatagatctatatatgtatatatgtaggtcaagttatgcacatatatgtgtgcaattttattatatattttgcagatatacaggaagtatagcagaaatgtgcaaataataattatacacactcttcattgtgaattccagatagctaatttattctcatagaatgcttctgttcctgtttgctgaactctgctatccatacctaatctatggttgcaattaataaataagtgtagctctaactttaatgttgattgatattttcacttatattaaggagtacaataaaagagaaaaaacagagatgtatcccagaacttccctctttcatcaatgacatgaacaccttctttgctggtatcaaataatagttttcaaaatatttcctcaattgtgctttcacaatatgattggctacaggcttgacacacttttaagttaaacctaagtcagagttctccagaaaaacagaataaggtgtgtgtgtgtgtgtgtgtgtgtgtgtgttgtgtggagtatgtgtagagaaagagagagaaagacagggacagattaatttattatgaagaattggctcacatgattgattatggaggctaagaagtcccaagatctgtaatcaccaagctggagacccaggagagctgatgtgtacttccaatctgagtccaaaggtctgaaaaccaggaaaacagatgtttcagttcaaatctgaaggccggaaaagaccaatatcccaggtcaagcagacagtcgagaggagttccctcttactcagcctttttgttctagtcaggccttcaactgattggatgatgcccacccacgagggggtttactttgcatatcatttgtctgcattactcagtctagtgattcaaacgttaatctcatccaaaaacactcccccagatatacctagaaaaatgtttgaccaaatatgtgggcaccccatggcccactcaagttcacacataaaattaatcatcacaatctgcagtattaacattgtcttcatcactttctcaagtccaatcaacaaaacaatgaatcaagctctgatttgtaatgtttgctgaattccacggtataaataccccaccatggcctatttcaagctaccaatgggatgtcaatggatgtgaattgggaagagatggggagtagcacacccttatatagtagagttggccctccatatccacaagttctgcatctgaggattcaaccaactgcagatttaaaatattcagaaaggccaggcatggtgcctcacgcctataaccccagcaatttgggaggccgaggcaggtggatcacttgaggtcgggagtttgagaccagcctgactgacatgttggaaccctgcctctaccaaaaaatacaaaaattagccaggtgtggtggcgcacgcctgtagtcccaactactcgggatgctgaggtgggagaaccgctgcaacccaggaggcggaggttgcaatgaccagagatttcaccactaccctccagcctgagcaacacaatgagactgtctcaaaaaaatacaaataaataaataaatataaaaataagtgaaaaatataaataagtgaaataagtgaaaaataaaaataagtgaaaaataaaacaatataacaactgtttacatagcatttacatcatattagttattacaatatgatgatttaaagtataagggggatgtgagtaggtgatattcaaatactatgccatcttatataagggacttgagcatccacagattttggtatctgccaggagtcctggaaccagtcctctgaggatactgtattgcggccacaaaaatacaaaagacataaataacctccagagtatagataacagttaaatatagtaaaacaattagagtgttgagggtatattaccattgttttctaatataatttatttgagagcttatataatttaatgttcaatagtggatgtgtttgacatctgacttgcaaaatttctgaaaatgtaatcatcagctctagggagtctgcgggaactagtgccagcacatctctagaagggcgttgtttaagccctgagggaaattcatctggtcccctactatctttgttgaaagcccacccaattttattttggccaaagcttattggaaatgaaaacagaaccaacctcactgtttttcttggtattatttttcttctgaagtacacagatctccttatacccttagtgaattaccacgtttacatatttcaacctgcaataacaagtcataaaattatcagtctgtgacatggcaaaatgtaggtggaggcggtcaagggacttgccggcacttccatgggtctgaatgactccccagcaagggcagctgcctctatacagatgaccagcctggataattctgccacaataactgagaaattccgacaaagccagaattagggtttgagtcctgcagataattatagtcatggacatggagacacagcaaatcagagaagaatgatccccttgactttcagtctagtgatttacctaccgtacccactctgcttctaggtaatgagttacttaatgcttgtcaagtaattataagttgtaaatcaccaaatacaaggcatcattaatgtccgtttgaaactgcacagagaaattttagtaggcaatatatgagtgccccattggagccaagactccatgtctgtacattttttcttgtctcctttaaaaaaaaatcaggtatggcaagatgttttcataacctcagatggttgggacctctgttttgagtatgacctatgataggtgttcccaggaatttctttaataccatgctggggggaaatttgatcaaattatttattaatatgtggatcacaaatgagtctgaaagcctgagtcaccactaccctttcctccagcaccctgccatttgagatggaatgccgtggcattctgaatagaggggcaagattacaatttagccaaacgtcatatatgtaccccgcagtgcaggcaattaaaaaaaaaaaaagcttagttatttctatactaagtaacccataaatgtcaagggcacttgaaggcaatgaaattgttaaaattaaggggtgttagggtgtatttgtgattggggtgagggaatgggacttggctttaatttacaaacaaattagaaaaaataaacagactcagcattgctattgtaactggaaaggcttgagcaaatttaatccaacttcctgcataatatttgattaatctcagactcgggaggaaaatcaagatgagataggaagtctccatctgtatcgagggcaggggaacttggggcttccagtgcccacaaagggcatcacatgacccttcccaggggatcacttgctccgagttccctgtgtctctcttggctccggctccaagttcatgagaaatctgtccccatacccatccttctgaagcttccagcctttaccacctggacctgggccggagtcccacccccaccacagctcttgagacaggcgacgaatagacccaaatttgagatgtagctcaacctttgaccactagaggtctcctggaaagcaatgacccgtataacccggttgatcctccttcaaaccaatagacttgttgcactaaggcttggcgagcctgctctgctcaaggcctccttattaataacgccacccgcccccgccgctcacgatggcgccaggcatagagggggatgggaccaggcggtggctgaccctcagacagtgctggttctttacgaatcagtctgcagactccagggctaccccttcgaaccccacttactgaccaagcaagagcaggagagcgtgcctaactcgaggtccccaggtgggcagcgtggagccccacagacttccaaccagcgatggactgggcaagggacccacgttcagaatcacctagcatcaggtccgccaacaggccagaatccactcgcccctcgcttcgtccccctaattcctcgtccccattaccccccttcaccgcctccgttttgcctccggatcgcaaaagtgacccgagctttaaccagtggagagagatcagggaacaattcactgtccctattctcatccatgtggtattttctgggaaaattagtggcttctagctggaagaggaaagaaaaggggtgggggggtggatggctgagggggagcaagaaaggaaacagccaggttgaattcccagtctttatcaagcaattcgctcaccaatgagagaaagctgcagtggcagattcgagccacatgcggtagtgtgtagcaattagtagataaaatgctgactaaagtgctaaaacatgaagtattattgtagccaaggtcaaaaatgcttcagttgtcttttgcaatttgggggaggggaggcccaggggtacgcagagaggtttgcattttcgaaatggtcgccttctttcttcaaactgtacttttccttttttttctttttttatgatcctgtttattatagtccaagctgcctaattatgtcactgctggtttttgcaactaacttaatcctcctgatcctttatgaagcgattcacagacactgaataatgtctactgctctcccatccccttgaggggcaagaatgatttttaattttttaccgtgtaaatacacgagattaacttagagagttggatttttggctagtaaagcagcaagaatataggtgtgtgggtaccggattctgtgtttcagtacaagaaagagcccagaaatagtgggtcatataaacatatactactctccctcccaccttttatacacagcaagttccagctacaagcttttttatagataaataaagcagttgctttcatgattataactgtcctgaatggattgtcttcttacaacattcaatctgtttatgagtatttactttacattagcccagggaccctgcactgcaggagtttgcctctattcccctgggtgtcggtgtctcaagtcttacatctgctctgtgattgatggagccttgaatccacgttattactctctcacaagcagaaatcaaacaggctattaactacattacttcaaagaactgtttcaatacaatctccttatcttaattgaaactttctttgtatggatatttgctacacagataatttacaggtgcctatcaaacatcacattaaagaagaggtaaaattgagggatttttgggggggaggggtaaacactattgtgatctgtaattttaaaaggcattcacagtattggtttgatttattagatttattatgttcacggggggtgggggcagtgctgtaaaaagagggggaaagatacccctgtgattcggttttgaaatttagcattcatctgattacaaggctgcggatattcaaaaatattcagacccagatccctgcaattgttaacatctcagaaaccttatcggagagataaggcagcatgcatcctagttcagtgcctaccttgaagagctgaagaaacagggtttctaattagatgaagttcgttacacacttaaagacttacagcaccaaagacagtagaagtagcttagatgctgtaaagagctgtataattttttaagaaagagatttaatatacaattgagggataccctcaggcattctgttgaggtttcctgcataaatgctgctgcattggtcatacaggaaactgactcagagtcgatctcaaatacgatcttgtcaaaatactgcaactcaagtttttttaatataggatttcttgaactggatgtatatatttacgctaacacgacagagactaacagaagctttaggcatatctatttttaaaaaagacatgtaaaatgcccctcagtcaagtccattcatatgttaaaaatgaacaaaatgggcgattctaatcaaacgtctgcagtatgcattataaagttaaaaagagagagagaaagcgcaggagagctataatttctctttgtaacccatgtttataaaatagaaagatcagatgaaatttcaagagataattaaagagtgatgtgcaagtcataatttggctaatgttaaagatgggagactgcgaattgtagtcctccatggtgcagagttgtgatattactttaaattattaaaatagttttcgacagctttcagaataccggctctttggcatgggcttttattatttattgtaattagaggatctgccattttctttcgtttatctctgtgtgtatagaaacgagatagattttgccttttattacttccccatattctgaatcaaaaatgtggtttagataatgttaagtgccctaattcttactgcagcggacgcagacgttatgaaaaggcataaaaatacacacagagggtctttccacctcaagtcactgaatatgaggcatttgtgctctgccgggtgtattaacttcagccatgtgaatataattttcattaaagtaatcctgtttcaactagatgctgtgactagaggtgaaacgttgcgaaagcgttaaaaatagcttactagtaatttcaacatcctgtaattttatcacagatcaagtttcaactgtcatactatacagaccttattccccatatagtacatgtttacttttttagcatgccagacccactttggaaagattggtgccaatataataaaagctggagggggggtgtgctggaaggagtgggaggagagcggggaagggggtgggggaacgtgggggaagcgagtacaccattttaaatcaacactgcgaaaatgcaatctagcctggcggaggaccggcagctgggtcggagcttgcgagggctttgcagtctctgcctgttccttgttctgtcgctcttaagtttctctgtgtttgcataatagccgtgcatgcaaacctcgcaatgctccagggctccagaacaataaatatacacatttaaagcctttattgtcttacggttcatgcccccggttttcaacagcttaatttctggttgtatttaactagtttgcaaatggattttttcagtttcaaactattattgaggaagctcccctcccttttttggcgggggaggggatgggggtggggtaggagtcggtatattattcctgtagcgctgggttatataaacacattatcatttgagagcgcccttggcgtccatcagcattgtaaacacgtactagtgtatatacttcaaaattaaagaatgcacacgcagaaccgggagcctgaattcatattctgagcagactcgcttctcgcatttattgatttatcatgcatcgtttattgttccagtccctaaatgcagtcgctgtccgttcaatattgtttgcgaaatcctaagatgtgtgtgcactgctcacttgtctcttttttttttgctgagtatttttttgcgaagcgaacaaatgcattaatatttatatgtttatataatcgataacccacttttcccttccatgtaaataggcatcaaaagataatttaacagattagttctcgaaaacatggcagtgaggaagcgtaatttaactatcaaacaaatctacatgtctaataacagcaaatctgctaagaagcattagaaagaggagcagcgccccggaatctctgcaggaaatgttctttatattagacatatacaagcaggtcctgtcagatgcacagtggagctcgctacccctcctctcctccaaaaatctcatcagacgatatcccagacaggagcggttagagagagaggaatcacatctccacacagttttagggtgctttttatttttacaaatcttcttgtgtgttttttgccttgatccatcctcttcccgccgagatcgtatggcgcctttctctcgattatgaatttgatcaatccatctttggaagaaaacccacatagttttttcaggagctgaaaattgagtcgttatagaaatattaggacatattttcaatcatttcggtgcccgaagggaggcaagagctcagttttatattgagacattacgccggctgaaggcagagaatgcgtttccctgccaggacctgatgcaatccattcaagccaacaagtttggagagaatgttgagttcaatcaattcagaacgtcgagatggagcccaactcactccaggtatttcgctctcctccgctcctccgatcccggcaccccccggcaccccccaaccccccagctcacccacacctctgcacccacccacaccccccacaaacttttcaccaaacttttaccctctgcatcccccaaaatcatttttattgtttaaaaaaatccctgcactgatcatacatacataatgtaattttaccgcctcaaatggggaggtgggtagaagtggcggtggggggccctgagtttttttttttttttttttagggaagcagaaaatttgtgggtgctattatttttccacccagcgttatatctgttgggtcgtctgtattaagagagtggatgtctgtgtgtaaatgtgtctgggaatagatgtttgtgctctgatggctacattatttatttggtgtttttttccccccctgcagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggagctccagctgttgtgggaagagaggaccagccggcaacttttatccagctctaaactttatttcctcccagaagacactccccagggcagaaatagcgaccatggcgaggtggtaaacctgtctgtccccctcttctttctttattatttttccccctagtaatgcttattacagggcaagcttgaaaatactgtattcacttctgcaggcaagcaggatcgactccttttttaaaggggtagcgccactagctggggctcgagtattttgccattgtcagagtttggctgtcagctttacaaagaggatccaactgctgattttagtcaagatcaaataacttgttcgagaagggttttgttcaaggatgtgtgtgtgtgtgtgtgtgtgtgtatgtatgtgtgtgtgtgtgttcatttgctctcctgctattgcctcttgaacatcacatgctttttatattttttgccttttgaaaatttaccttcgtgtctggctcggtcgtgtctgggtggatttctttcggtgggtttcgatattgttcttttttcaaagtaagtatttgatatgtttaagagggcggaaattacgaaatggaggcagaatgagatcaaaagctattgagttggcaaagacgtgttgaataaagtgataaatgacaggtactggaataatacattcaaataacttgcagatctgcccgggcggatttcaaagcggtggtgtaacaggcacaaacacgttaagcattaacaactatctctcgcccactccccctccccccggacaagccatttgatgttctagtttgcaattactccacgcaaagtggacgtcctcctgcgcgatctttgggggtgtgtgggacgggggcgggggaggggagggcagaggggtgtgtgctcgcccactggccctgcgggtccagcgttctccgtgcccagacggcgctcccggggagggcggggaggggacagagcctccccggcacgtttctgggcggccgcgggggcgctcgccgcgctcccgggaggacgccggaggtgagcccgctgtcactgggcgccggggcggccgcctcccttcggctctgtcatttcatgtgtgaccgcagttctgcgggctcccctcctcagctgaccgacctcagcgccgtggtacctaccgaggggaactattttggggagtctgtgcccacggcgcagcggggagggagggcgtcttccaccacggggctggaaggacccgcactcnnnnnnnnnnnnnnnnnnnntaaaaaaaaagaaagaagctaactatagataatacaatacatgtggacacagttgaagggctcacatcatcatcaaacaagacatcagcgcatggtacataaccgaggggaaaatatttatggagagtctgtgaaccacggcgacagacagagagggagggcgcactgccgcctggcgaggatatgtgttgccaaagcgagagcagggtaatcaaacagacttttgagggcagatagtgctgtgaccaggctactcgagctttcgaggtaggtgtaaggattaaggatctttttgttaaatgaatggtttacccgtttaactcatccacggggctcggaactagccagtccttccagaattcctcggtttgatcgagttgatagtacttttggcatagctagttcactccctctcccaacaggatcgaattactcgtcagtggtctatgaccggttaattactggagttcgtcgaaacgttcgccctcgaatctgccttttcggaaataagcccctcccacctccccgctcacctcccccctccaccctccccggccagctttggtttttaaatgttcatatttcccgacgtccgcctgcaattttaaaaaggtgttgtttggaaatactgtgaaaaatcctgcaacctaccaacaggttgagctctttccccctcccaaggtctggctcggccccctcccccgacccaactttcctgcgcagctgtcttcctccccctccctctccccctcctgatttcttattatttgcttttcaaatttattacttcaacatggcctgtgatctggaaaagggaaggattaaatatccagaaaagaactggtgcttaacagacttctgactaagtccaggaggaaattattcagtgttttatgggatattttgtggtcactcttttttggggggcggggaattgaaattgggatgttttttaaagaccctgagttgaccccacttggtacagttttaatttttgttggtgtaattaaatggtgaattctgatttaagaataaaggctatatttgccaaacgttgcatctgctagaagtgttgacagtgaatagatatatttttaaatacacgatttctttttaattgttcattatggggaattgaaagggaaccattgtaatgatctgtgcatttcgtcactgctatatgagccatacctgagaaaattaatcttgccatttaaaagtaaactctagggggtttgcggagggagatggctctatttataatcctcagctgcatatacattgtctaatattatgcatgatttgttttttaatgctaacacggctggtaattagctgtatgattatacttgtatatttcattaggactttggctgatgtcattgtgaattattcagccatattaaaacaattttcaattgagataatgacacgcctcaaaattatgcaaatgcagactgcattgtgcaaaataattatgacaaatgtaaagcaggtagaaagtttcccaatgcagatcggttttccaccctggtgatgtcatttcccccctggcctaagttagtcattcattagcagaatagcagcagcagtcttctctggaggagagccttacagaaaccagcatttactgctggcacctagagggggcaacagggccctctcattaagaaatttgctttgttttcacttattccattaacttgtttatatacatttaaatgatttttattattgattttaaatagttttgaatgatgcatttgccatttgcaatgtgtaactgaaagagaaaggtttcttggtgatatgcactgttacttggagaaaatgttcagcacatttaatcagccagtacagtttattttaagtaaccaaatggagattaataatttcttgattgagctgacatcagcatccatttcgaaaggacagccaggactcagtatgctttttttggtttaagagaatcattctgcctttttatgatttcttgaaatgtaaagacgtcagttctaaaagcagaaaaatgatcattgtgcaagattagaaatagcgtccctgtgtggtttgctgtgatttgcagagggtttttttttttttggaatattttctcatgatttttgtaataaattgtgggaggctggataaggcaggactttgtacacccattttacagatggggacatagactcggaaaggttatgtggtttgtcaaaggtcaccaggctagaacccaggcctccttgaaattcaaggttatcttttctccccagtgaaacctacccttgaaagcagagcttgaattcatcatattacattctagaagtgtgtactaatgtgaacagtccctcagacattttagaattgtaactagttaatcagttttgccaaaggtcaccagatgtctaggtagcaaaactatccttatcctgtaaagttaagctaattctaatcagtggtatataatgataacagttatattttaatagttattaatgagcattaacaacttactattcattttaatgatgatggtgatgatttatatgcttatatacaccaatgccttcatatataatacttccagtgttcgcaactggtgttgaggaaaagcattcaagaaagtcacattttgattctgcagcttgctatttgcttaatcttgaacaaccataagtacttggaacctcagtttcttcagctgcaaaatgggaacaaagtagggatgactatagattgttggtgaagatcaagaggatttataggcaaaagagctttatatactataaagtacttaaataaatagaaaataattatgattatagtgacctttgttctagatattcttaattttataaacaataaaaaaaaaacttgtgtctgtgtggaggttcttggacctaaaaatgataccatcttaaattaccatgaaaatgaatagcagggccatgtgcaaggagttaagtgtctttagtaattacttagaattgccacattcagccactagctcttcagaggaggaaaatggcaaagtaggcgggtaattggttctgttactggataacttctgattacattcattttccaattgccaagtgcttaatctattggcagtataccctcttaaaatgggtggatatgcaagcttggatttcagcctgaccagccatcgctgggattttataagaaggtttgctggtcacctccaactgtgcttgtggatggctaagctaatgatgtccaggagtcaagatcaggcatacctggatgttacagattctagcatgcattccagatttctaaaagtgattcagttatcaccagcctcactactgaattaaaaaatgctaaaaatccatgttctggggcccctattgaagtctcctcaaatagaatctctagagttgggtccaggagtctgaattttaaatatttaaacagtctcagtctagctgtgttatcttgggcaagttctaaactctctgtgcctccgttttctcatctgtaaagtggaaatacggtccttatttcctaggattattttaaggattaaataagttaatatatgtaaaatgcatatgcccaaagttgacacatagtagatacttcaataatggttgactgttgttattatcattaatattagcattaatctcactgaggtttgaaaccactaccatggagcttactgaaaagtttttccgtgtgagggaatggcacctaggtgagtttgctaggacatgtgggcttccaaatcctaccgaatcaggctatctttcatctccatgttggctttagctgtgtcaccaaaataaaaagtgtcttaaggatttacattttagtgcagaagtaaactgtcaactggatcagcaggattttttttttcaaaagattgcctgatttggtcatatctggagttagacagacacattctggaatttagaaggtgctggattagtcttgctcttctctttggatagctcctcagtcttggtctatatccataaggtaattttttagagatttctgagacctcttaaatgaccacactggccttagacaattgttttaacttttttaagcctctgtttcttcctctgtaaaatggatttaatggcctcaactgtgctgggaatcagagataataatgaaaagggtctggaatctagcatagtatagtacctacacatgagagttcaatgaatagtggttgcacttataatagttattatttatttttagtaatcatcttaagctaagaaaaggatttatctttactctctaccaagcaggccttttagaacaaagataagaatgtaaagaattacatggagagaaattactggactgtgacaagagtcagccaagtaaggcctgaaggccaaatctggcccactgtctgtttttgtgaataaagttttattggaatgtggccatgctaatttgtttatggctgctctcaggctccaacagcagagttgagttgttttgacagttaccagatcgctgacaaagtagaaatatttattatctggctttgttaagaaaaacgttgctgacccctggcctatgcggttgatctgcaataaggtagatgattgtgtacctatttttctttcttgagttttggccattaaccagtaatagcagaaatataagaaacttaagtaatataagaaattgtacttcaatattatatcattaacgtttacatatccaatccaatttcaccattggttctaggacattaaaatttgagaatgagtgaaataatattaaattatattttgtatggttaagagcgaaactttagccaatattagtattgtctattttgagttaataaaaaactactcgtgaagttctatgtgctcagtactctgctaggtgaagagacagatgcaaaatagtttgcgatgtgaccctttttctgaataaatttatcagtcttgataaggagatgagatcaacatgtctaaaaatgtaaaagcaatatgagtcacaacacatcagtaaattgtgctgataatacatgtcataggcatccaaaggaaggctcccaaccatcatgttttttggaaaaagaattcattaaatttctcagatgttgattgaaaacctactgtgtgctggcacttggatacaagagattaaggagaatggcctcggccaggcatagtggctcacgcctgtaatcccagcactttgagaggccgaggcaggcagatcacgagattgagaacatcctggctaacatggtgaaaccccgtctctactaaaaatacaaaaaaattagctgggcgtggtggtgggcacctgtagtcccagctacttgggaggctgaggcaggagaatggcgtgaacccgggaggcagagcttgcagtgagccaagattgcaccactgcactccagcctgggcaacagagcaagactccatctcaaaaaaaaaaaaaaaaaaaaaaagaagaagaagaatggcctctgccctcaaggagttcccaaactgcctttgtagacagacagtgatcacagaaaaggccatcagactctttccatctgtgttccttagtttaagttgagacgaactgagatcactatttatttgtagcatttcttaatctttccggaaattagaaagtactgtcttcatctttgaattattacttcctggacacatatttgtagagcacctattatgtgccagatcctattctaggccctggggatgcagcatgaacaagacagacaaaaatcactgctcccagggagcttatagtccagtggttggttgtaacctgtcgtgcactttataccttgtgccttatagttatctgtgttcttttcctttaccttgtcacctgaccctatgctccccccaccatagtgctgttctcaggagcaggcagttgtgccttattcacctctgggtcctctgcaatatttagtgctattcagtgagtttttttttttttttttttttttttgagacggagtctcgctctgtcgcccaggctggagtgcagtggcgcgatctcggctcactgccagctccgcctcccgggttcacgccattctcctgcctcagcctccagagtagctgggactacaggcgccagccaccgcggccggctaattttttgtatttttagtaaagacggggtttcaccatgttggccaggatggtcccgatctcctgacctcgtgatccacccgccttggcctcccaaagtgctgggattacaggcgtcagccaccgcgcctggccttcagtgagtattttctgagtgactgaacgacataattaaaatgccttcttgcacacagtctaccttttttaagctttacccagtttctttctggcagatgaccagtgaccagtcattcacatgtgggccagatccacgaccccatctcacacttcttctttctcttccaaagtctgtagtcattttgcactgtagaatgtgaaaacatgggaagtggttttttcacaggggcactcaccaaagaaacaagcaaatatttgaaagattagactggaggcagcatctctgtttcgttgttaattttccagtctcagcagtcaacccataaaaagtcagggctttggggtggcaacctatgaaaagactagacttcaggaaagaagattcactcctcgcctggtgttggttggcagttcatacgagccagcatgtttttcaggctgatggtcttaactaagccacatgtttgatagtgcctcacaattgtaagcaattaaaacctctcgacaattagactgtcagacacatactaaggaaatgttatttttatgaaatacaagagtccatacatgtaaatacttcattattaattattaataaagcatgccattgttcatagtggcatctagtgatatatgactcaagctcatttatcaaagtctagttttaaccaatatccagaatataattgcttgaaccaaatgcattcacttgtcattttttatagccagtgtagttggatatttgccatcttctactcagaataatactgtagctagtgactacccgttgccttggcttttaaggaaatttaaaacaaatttatcgattgttggcttaaggattcattcacctctcagagatgtggtcatggattccctcatttcttgaagaatctacactgcacaaatccaaggatgcatttttctggccacgctgtgttcctcactgacttgctggagatgagaaccttggtcttagccctccagcatacatccctcatgccctggactatgagcatcagtatcgacaacacatttcaaacatgcagatgatgatgattattgaaagggtgctttagaatcatgctaatggcatcaatctctcgcacacacttgggtaaattaattctgcttttaaaatcagatgcactgttagcagcgttaaagatggatatttgacatttatcacgcagactaggatgggtggtttaattacgcgaattttctgtaggatctttgtggctgtataaatagacgcacagtggcgtgtgtccttggcatatgaccatcaggttcacagtcacatctccattcctgtgccccagtaagaaccccaggcggcaaaggccaaatgttgctagtcaatctagtgaccccataaacatcttttcccccacctttcttttctcatgactccaagcacacccgggctatgaaacaccccttccaccccatagttgagttccaagcctgatcagtggcactaaacattaaactcttgtctttgagaataatgggctttgctttctacaccctcaagcatgttgagctactgtgcaagctggaaaataaaaatgttctaattgtgtcttttaaataagcataggagtgaattaattagaccatattttgtctttagttgcttagttacacaatagtattcctgagcacgagtaagataaattggctctttttgtgctgcttgtcccttaatcataattactgtattgcttaggagagtaaagcatacatagattttgaattttttattaatagtcaaaaatatgcatatgatatataaagtatatgctgttcaacctgttttatatgtgggaagaagttttattgtggtggtaacatttgcattagttgctcaaagatgtagttctgggaaatacataattgaaatgtttttgaattgctttttctggccttttcaatcttattcaaaataatagtgcctccagtcctggagtagtcattctcatttgatttaacatctttctttgcactgcacgagcggcacccagttttaaccctgcagagcctagatgaagttctgtgattcataggccatacattgtgccttatgttttttggctcatgctcttggggcttggggggcagcgggcagaagggtgcctttgtcttgccgtcattattccaatgcccttcgcccttggctcacttccatgctccttaaggaaggttctagggttagagagtgtaagagtttttttagcatgagctggacaactatctgtgcttgcctgctggggtcttgcaaaatgaaatgttgctactggaagttgggtttctaaccgcctaccccaaccctccaccaaggagggcagcaggagttagacagcttgatatagttattgaacaatgagagagtctggattatgacccaggatacttgcttggtaaatgtatgtgaaaatcgactccattgttctattgtatttgaaaagcaagtaaattatttacagatatttgctaattaaagcatatgttgtttcacaagcacaaaggatcgcagtataactggagacaaagaactaagtgcaaataatttaaattcactaatactgtgtattcttcttaagggaggaatatgtttttaaaatgtgtatatatagggtgttggtcaaaaggtacaaacttttagttataagatattcatcatatatatgtgttcatcttctatctggagatctaatgtatagtatagtgactatagttaatagtactgtattgtatacttgaaaattgctaacagagtagatcttaagtgttgttaccacatcaaaaaaggataactgaggtgatgaatgttaataacttgattgtggtaatcttcatgatatatatgtacatcaaatcatcacattgtataccttaaatatatacaaccatcatattgtatactttaatgtatactatttttgttagtcaattatacttcaataaagctggagaaaataaaagtatatatataggcatatatataattatgtgtgtatatatatgcatgtttatatatatatatatatatgtatacacacatacacacacacacatacagataacttgtcctgttatctctgtatacattacacatatatacatactttttttttaacccttccaagggaagtctcgcatgctacagagatagcaagccaagttaccccccagttgcttgtcactaagcttgccctaagctctccaacggaagatgagatggaaacagttttgacagaatgctattttccctttggtttttgcttgccattatctagtttgagctcagctcagagtatcactagaaataaggcaaattagccagatacagtatcagagaataaaaatgttctcacccattcctttgtcctcagactttcctgaatgtgataggctcaggtttagttgtttttcttctgttttggcagtgttctggttggaaatttgcactgtggaaaagacgctggtgatacaaggcaaaaggcagaccagtgaaggtcagatgcagaaaaggtcattgataatgttctcagagaccttttcctggctggaactttggtgtatccattggtaaagctggtctctctggctgtgctgtctgccaacatgtttggttttaggcatggctagcttaaagtcccttggtattgttgataacgatggtcaagaagaattgccatggttatttaagagaaaggctcatgtctaatttgccatggacaattctgtagactcacaagataacagataaaagagactgagaagaacaaatccagccctctttatttaatagatgcagaacctaaggcccagaaaaatcttgggcatgtcctcagaactagagagtgacagaagtggaactaggattcagtgttctcaggcaccacagtctggtcggctgttttgtggggaaggggctgctctcttgaggtcatgtgctgaggaaagtaggcaagtgcttcccgtggctgtgttcttggtaggtcattccagtgccctgtcttataccagtgcatggtgccatgggggacatcacttttataaaacaactcatggagagtatggactttactggaatggcaagataccttgttttgtttgtttgtttgtttttgagatggagtttcgctctttttgcccaggctggagtacaatggcgcaatctcagctcaccgcaacctccgcctcccagattcaagcgattctcctgcctcagcctcctgagtagctgggattacaggcatgcaccaccatgtccggctaattttgtatttttaatagagacggggtttctccatgttggcgaggctggtcttgaactcccgacctcaggtgatccacccgcctcagcctcccaaagtgctgggattacaggcgtgagctaccgcgcccagccctggaatgacaggatacttagcagagagttagtgattacacagaagccaggattgatatccaggatcccagactggacatcaccttcatttctataatttttcctgaagccaggagggccctctaatgggatgctatttatgttggctgaagaaaagcttcgccaaaagttggcaatgttggtaataaatggaattggtacttatgcgaacatctgatactcatggatggtttcatcattcagaagtgtgtatctactatatgcctactatgtgtcagttctctgtgctgttaaaggagcagttaaagtgagtgcctactatgtatcagttctctgtgctggggatataatagtgaacaatgagtgactagtacacaaagatttctgttctcagagagcacattttctctcctatagtaagaaggaagaagcaacttgattaatttgtcccaaatggagggaaaaccatctccatacattgtagtcttaaaaccgaattcacgcttccttctagagtgctttctctgtgtattcacagcccagagaaaatgccccatatttctctttcccgaaaccatctgcaaaattttcacccacagtgttttcaatgaagtcaaagtcacaacattttccattaattcagtgaccacttatatgtcaggcattgcaaatacattaacatataaattaaatataaataaaatatctcatttaattctcatggatactctattatgtccgtagtattttgacatttccatactttgtaggtgatgcagctgaggccaacagaggttaaaggaacttgcccaaggtcacacataggtgagactcaagagtcgggattgaaacccatgttctcccgatgctgcgaagaccagtgggcgagcttagtttctcattataactttagaatatattgagaactctcaatatcagcactggggttttcactatatactgatgtattctttaattgagtctttatgaaagcttctttcctgctctttagggacttgcacagttgactgatacccagataatagtaatgccatgcacacaggtaatacactttcaaagggcactttacactccacatagcgcctttctcacatttcacaggagagaagtctcagactcagtacctccagcgtgactttgtgtgcagcccagcactgcgcactggagagagagaggtggaaaaccaggcagatcctgccgccatggagcttaccatcaggtggggaccacgcatagtatataaacttatcacaaacaaagggtgattctgtgatgtggtcaaggggatgaagggcaaatacaagtgcctatgtcaggggtacatgattttgtcggaaaggtctcaggaggcattttagaagaaatatcatttgagttgaggtctaaagggatctgggggtgaagattgggaagtttctaggcaagctgtatggtgagcactacctccctgcagaatggtttctgggctgggcttggccttggtgaattcgtagccaggttagagatgtccgtttgcccactggagggaccagttggtctaggtatcatctagacacctggggtgcatatttagagctaatgtacatcatttggctatggagatggttgaaaacacggcaagctaaggcaaactaaggcccataggccaactctggtctactatctgtctttgtttgtttgttttttgtttgtttgtttgtttgagacagagtctcgctctgtcgcccaggctagagtgcaatggcacgatctcagctcactgcaaccttcacctcccagattcaagtgattctcctgcctcagcctctggaatagctgggattacaggtgcccaccaccatgcctggctaatttttgtatttctagtagagactgggtttcaccatgttggtcaggcaggtcttgaactcctgacctcaagcagtccacccacctcagcctcccaaagtgctaggattacaggcgtgagccaccgtgtctagccttgtttgtttgtttttgagatagggtcttgctctgtcacccaggctggagtgcaaaggcgtggtcttgcctcatcgcaacctctgttgcccaggttcaagtgattcttgtgcctcagcctgccgagtagctgggattgcaggcaggtgccaccccacccagctaatttttatattttttttagtagagatggggttttgccatgttggccaggctggactacctgtttctgtaaataaagttttattagcacagagccatgcccacgtttacaaatggtctctggcagctttcgcactatagtggcagagttgggtggttgcagcagagactatataccacacagagcttaaaacatttactatctggcccttatataaaatgccaacccctcatttaaaataatattaataaaagtaatagtaaaactaggtcctgacagattaatatgtgacattttatttactcttcataacagtaatactgtgaggtagattctagtatcatctccattttgcgggagggtaatttgaaaggttaggtaacttgtccgggtttccaaattcactcacctggtgaatgacagagactgaatgggaactcaagctgttttaattccaaaatgcaggtgacagaaacattgtgctgtcctgtttacaagtagaggaaacgggaagtataagaaaagggtggtaaagttagctgaggttttactctgtgaaataaaactgcgcaacagctgtatccgtctttcaaggtcccatttaaaagccacctcctccttgaggtcttccattgactgtctaggaacaaggaagccacagaggcacaggtgtaagtgccctctgggtcaggcagataagatcaatgagtgactgggccaggtctgggagacaatatgatattcaggggaactggggagcgcacgactggtttgaggcatgcctctaaaatgttcctcttgagccaggtgccatggcacatgcctgtaatcccagctacttgggaggctaagcggggaggatcacttgaacccaggagttcagggtgaaccatgattgcaccactgcactccagcatgggcaacagagtaagatcctgtttctagtaaaaaaaaaaaaaaaaattaattaaaaaaataaaatgctcttcagtttctacctagcattgctgggcaggaatgtcagtctgagatattgacaaatctttccatttttcaagagaagccagaaacctagattttcatgtgattttagttgaccattctatttatttatttattatttatttaagacagagtctcgctctgtcgcccaggctggagtgcagtgatgccatctcggctcactgcaacctccacctcctgggttcaagtgattctctctacgtcagccccgctgagtagctgggattacaggaaagcaccaccacgcccggctaatttttgtattgttagtagagatgaggttttgccatgttggtcaggctggtctcactgcacctggcccaatccaatttttaaaacactctttgtgggccaaacaaaatgtgtcttctgtccagatgtggcccacaggctgccaccttgccatctctagagcaaagctttggactattacagtttttaaaactttctcatatttggcccattttctgtaactaaagcaaaaagaaccgttggtcccaaaggggctgttaaaaatggggtggggagagccacgtggataaagccagggctctggagtctggagggatggcaggaagagatgtgcaagaagaagagcttggctctgccctggagtctacatttaggcttgaggagggaggcagggaccagctgtggaaagaagtgcatgagtgtgaaggtgacctgtagccatcctggaaggtgtcctggagaaggggcccttgaaaacacctagggatggatgagggtaagagatgagaaaatcctaggcagaagcaaagccacaggcaagtaggaaggaaggacataccaataccggatatggtctggatttggtaagagagcacaggtctagtgggaaatgaggtagactgaggccagactgcaggggagcctagcatgtcatgtggacttgaatctgaaggcggtgctgctgaataaattcacatgtctgttttctctttctagttaaaatataaacccttagccttgaagagtagttaaatggagtgtgaatatttactctgccagttagtagctgtgtgtcatcttgaccaacttgcttaatctctctggcatctcagtttcttatctgtgaaatggcttgatcttgctgggctaagaatgtcaagtgagatgcttatgggcatagagcacaaaaccatgacctggcttatcctaggtctgcagcagatgttggttattgaccctgccctccctggtcagggaccacatcctaagttttgaagtcttagtgctaggctgttaataactccttaataactaatttatgggttgagatattggactattatttgaaaaacaggaactaaggaaactatcatattaaatagagttaaacttcctggtttttcatttaccccaaaagacttctcttgtgtttaggttcaacattttttatctatatctgtgatttccagtcactttgaaggagacatgttcaaatccattctattctgttccatgtagatgttaaaggtacattaggggccaggcacggtgactcatgcctgtaatcccagcacttttgggaggctgaggtgggcagatcacttgaggttaggagtttgtgaccagcctggccaacatggtgaaaccctgtctgtaccaaaaacacaaagattaactgggtgtggtggcatgcacctgtaatcccagctactcaggaggctgaggcaggagaatctcttgaacctgggaggcggagattgcagtgagacgagattgtgccactgcactgcaactccagtctgcgtgacagagcctgactccgtcccccccccccccccaaaaaaataaaaggtgcgttaggggacatctcttccattggccatgtcaaaattaactgagataggagtagatggagtcaagagacaaaactggcttcccagatgtttgatctaagtgccccaccctccaccctgccctttcatgatgcaaccatcaggaaacctggtattgatctgcaaaatgtgcaaaacattgaattcattttaaatatacccactattcctccatttcaaaaaagtttcctgtattttcttttcttaaaaacacccctaacttgaaaatttgcttcatccctttgtccccttccaccccaccgtcttcctcatttggggatgctcatggtagagggtgtattccaatccaactctgaaagatgcaaaaagcatcagccagaccatgtaaagggaaaggtcccagccaaaatggctggggggaatctcagaaggatcttccaaatagaggtagccttctgggccattaaatccttttgctttggattaatcccacagtgtatatcagatcactagaattcagatgaaaacactgctgtagtactcagtctcctcgccaaatgattccaaaatatataggttataaatacagaaaaaataactgaattcgatatttcttaagtgaaataatctgttccttgtgaatattctctgtaatagtctaatagtattttgtgctcctgggggctgagtgtgtttttagcaacaatgcattggttgtaaaatatgcatccctaactatctggacagacaagaaagagggctctagtaaaaagactgaagtttttttttttaaatgcagatcgtatgaatcacataaatggtggtgtctaaaaattatcaacaagctctgggtttgtttttatttctttacattataggtcctctttctcactccacatttttgatattactagatcagtaattcaagagacagccaagcaggtgttcacatctctcctgacccccagaattccttaaatgaccccttgaggcagtggagtaaaaacattctcagcatgtcagaatattgagatatctcagttgtcttaatttttttttctttttgccttaatctttacaggctttttgtgtgtccttttttctctctgcttaagccaagaggaatcttgcttcagtcttggccatgaagattgagggacaggaggacagggtctgcagattgtacttacagttaatacagttctaactgctcagctgtgccagctgacttttctaattggtctttaaaagatgaatctttgtttttttttttttttttcctgagaagtttcacttttgttgcccaggcaggagtgcaatggcgcaatctcggctcactacaacctccgcctcctgggttcaagcgatgctcctcaggcctcagcctcctgagtagctgggattacaggcgtgtgccaccatgcctgactaatttttttttgtatttttagtagagacaggtttcgccatgttggccaggctggtctcgaactcctgacctcaggttatccgcctgccttggcctcccaaataaaagatgactcttaaatgagtagatggaaaaaaaaggaagatggggcttggaattctcatatggtagttaagggcataacataatattgctcttgaaaaaatataacatttatatttttaaatatgggcctttgactataaccttttattcaattaaattcaatcaatatttattaggatgtaccagggtactatggggggtgataaggggatgaataaaatcagcttctttctctctagttagaggagatcaaacatgttcaagttagccatacttggcaagattatatggcctctttcatactgaaaaatacactcacattgttagatagtattcttagaaatttctatggatacccctccaaaatgaaagatctctcatacaggcagttgatttaggatttaggcagttgcatgaagtattttactattggtttgtcgtcaactctgcagaaaattatctaatttctaggaatacttgaaacatatttagcacctcattttacaaactttattttattgtcatacaatggtgtgtaaatgtgtcctgtgttaaagatggttgtatcggttatctattgttgtgtaacagattaccccagatttggtgtcttgttaaaacaacacttactatccacagtttctgtgggtggcaagtctgagtaaggcttagctgggtgcctcttgctaagggactctcaaagctccagtcaaggtgtcctccccagctgtggccatctgaaagctctgtagagggaggatctattaatacttcagacccactcacttgcctgttgacaggtctcagatctctcaggctgttggactgaggccctcagttcctctcaggcagtgggtctgggtctccctggcttccttgctgggccacatgggcctctccatagggcaactcaaacatggcaacggactcccctcagagtgtaaggtgtaggaatgagacacaagccatagtccttttataacctgatgctggaagtgacatcccatcacttttgcctaattctgtttgttagaagtgaggcattattgtctagcccacacccaagagcaggagattattaggaggttgcatataatctcaggggaccatcttcgaggccacctattacagctggcaacagagccaatcacttcagtgtacagctcatctgatgagggttgaaaggtattcttcttactctgttttacttttttccttttttcccttttattagttgtttatctatttatttatttttgagacagagtctcactctgtcacctgggtcggagtgcagtagtgtgaccacggctcactgcagcctcgacctccctggctcaagcgatcctcccacctcagccttccaaatagctgggaccacaggcgtgcaccactgtgcccggctaattttttgatacagtctccttggatggcttcctcccaaatatctccccgctcttcagggcatataactatagatgacatacacagtagactgcagattgcctaatcttttgaagatttgttatgtcttacagccgtgtctgcatgtccctatcggtgtccttccttacatctacatgctcctcgactcattgccgtcttggcgagcttcgctcgcatcgggcattgtgctctggtctcgcatgtcaccttctcgccgtttcgaccgccggctcgtgctcctgccgctgttctatcggcttcttcttctgtcttctcattctcaggcctgctctcgtccctcgcctggtgtcgtcaccctctgtttttccttcctcttccgtttcgtctctcgcgccttctggcnnnnnnnnnnnnnnnnnnnntaaccttccgccccgtggtgaagactaatgtcttgatcattgcatttggagagttttgctggaaagggcattgtgtctggttagatgagaaatcggcagagagaaatgaggaaggaggatcctgtagctgatataaacaggctccttaatgcataagaaaataggcatgtttgggccgggcatggtggctcacgcctgtaatcccagcactttgggaggccaaggcgggtggatcacctgaggtcaggagttcaagactagcctggccaacatgatgaaaccctgtctgtattaaaaatacaaaaattagctgggcgtggtggcacatgcttgtagtcccagctacttgggaggctgaggcaggagaatcgcttgaacccgggaggtggaggttgcagtgagccgagatcatgccactgcactccagcctgggtgacagagtgagactccgtctcaaaaaaagaaaataggtatgtttcatgcacagtggttgaggagaggctttaaatcatgttggcatacggccatggaaagaagacctaaaaatccacatgagagggattcttgtcccaggtgtgtttctcatgagtgtatctacaagaggtgagcatctcctggccctccttccatgttgtgtatacgtcaggagagcagctggtctgccatcttttaaattctgtgcaagttaactgttttgtgagaagactcattgatctttctttctggaagtgtgcagtttggtcttcagcaaagtgctcacaacatacatatgtaggcattagagctttgagaaaaaggtagtattaaacagattctggccaatgtttttttaatgcataatgatgttcagtgatactggttaatttttaataatggaaattgatttatggggtggcttccatgttaaacctagtgggaacttaaagaaaaggggtctggattcaaattgaggagcatgcatcagcagtaagacatacacatggggcatgttgtatgtttttctttttttagccttaaatgtaaccatgtaccacgtttctcccagtggcttcacgtgtgctgttcctctgcccacagtgtcctgtgttcttccccatcttccctcacctcttaacttggctgcttccttttctttctcagggtctgagcagagagacctttcctgaccactcaatttcagtcatccccgcttccaccccttgccccatcaatgcctcttctcgtccttttgcatcagattttgtttactatctggctcttctacccagtccacacatacatgactatccgctctagaggagtaggggttttgtctgttttattcctggctgtaaccccagtgcctggcatagagtcggtgttcaataaatatttgttgaactgataaaatcacttatgaccatttttcattatataaaccacatttagctaagggcttacgtttactgtccatctccccgaccttggctgctgtatgactcagagaggcttgttccccagctgttcctagtgcctagcacagctcagaatagatgcttgcaacactgaagatgaaagagtgagtgaactctctgacaaaggactagaaggagtgtgagctgcacttcccaggaaaggagcaggagactctgcctgggcgctgtgtgtttctgaagggcagcaccatgtcttatccatccttatctctgtagctgatactcagcccagtgcttggcacagagcagagagtcaatacaaggtaattggatcagattgaattgagtttgggaaaagctagaacaaaatctctcctgacaacaacactggatgaagctcagcttgtgaatgctctcttaaaggtggcagagatgactcctcctggattccctcctgtgattgttttgtcaggatgcctagtagtatgcatctattcattcatttattcattctttctttaagctccacctgcaaggatgcagagcacagggcatggaaagctgcacaagttttcagccccacctttagaaagcatgtcttgaggaaaagttaggctgtattctctggcttgtacaacctccccgaggaggcaaaagagttggactcaggcggttgtagttgcttgagtctgtcctttgtgttggcctccacaccacagtcgttgaacaggagtagaaaaagcaccaactgtggttgcaaattggcttttgcattaatcctggcttattgaaaaacactcaatatttttccaaactgaatttagggcttttgactgaagcctgaatcatttactgcagcagagcatatcactagtctaggaaaaactagaacttataaatacaaagtccgtttaagtaatccaatataggataattacattattaaataaagctatgggtctcaaattatcccactgcctttgtacatgtgaggataataatgtgaactgtgctaagtgaacagagtaaaaaaatttaacaagaatggagtgtgtctaaatcatatgtttatgtttaaacagaggctacagaaaacaggaagatttactcggtttgtacattaaagtgtcctaaataggcataaggctgtcagtgattcttggaagactgctcttctaattaatggcaacggtatattgagactctgtgccagatgaccagtaagctttaataattcagattttcatacaccaacaggggccaagggttttcttcttcctttgagggtctttatgggatagactctgctggatgatgtacctgggcagaaggtcatgtgcctgcaaaagtggatgaaaaaggctgggcatagtggctcatgcttgtatcccagcactctaggaagctgaggcgggtggatcacttaaaggtcaggagtttgagaccagcctggccaacattgtgaaaccctgttcctactgaaaatacaaaaaatggctggtcatggtggcacatacctgtaatcccagctactcgggaggctgaggcaggataatcacttgaacccgggaggcagaggttgtagtgagcagagatcgcaccactgcactctagcctgggcgacagagactctgtctccaagaaaaaaaaaattaaatggtcaaaaaaatcagatgttaaagtaatggtcgagtcattccggattgggtggtggttgggtttgggctttattgttacggtttttgcttttattgggtgttcttacatatggcttaactgagcataacactggaattgggctcatttatcttctttgttaatgttttaatggccagagctaactgggtgccaagctagcttttattatggcaacctgaaaggagttaaaaaaaaaatagaccatggagtttacaccctattaatttggccagagaaaaagtaggcaggcttaactaacactgatataagtaaagcctcttctttgcatatcaaatgcttgactgtttagagagaaagtatgtaggacactgggatgcaattttctgctctctgtgtaagttgtcttttattttagggaggaaaaaggtacatgcatggtaagcccaagaggaaagaaatggaacagggaattatgagagggtgtttctaggactttctctggagatggtcaggggagcaggctgcagccgaccaggttttagattagtgtgtattaaaaatgtatttaggaacataaaatatttaggatttttgaattacttgtttgatacgcaaatgccgttggctataaccatgaaggatggtcgcgttacatttaacaaagcgtgcctcagagcaatcttctgtttgtttactccctcctcttgtgcccggatggatttccaaaattcatcgagccacaggcgtcaaagatctggtgagcaggatggaaaaggttggaagaggaggggctagcttgggaaattagaacccaatacactaaagagcctccgtggcaaatcatttcatcatgttaagggagtcaaattaaatcttagcacatacttcagagtctatcttcattgctctgacaacagaaaattctttacatttttaactagcacatgagtggtgatttctgccgtctttctttgggaacaaaaacacgataaaaattaaaaattaaaatcctttttgtgaagtgacttgaaatcccattcaccccagggaattggcaggaggtggggaaaggtgcatttgtcccagggagggagtaggttgggatgtgactactgtcaaggtttaaatgaccagttttccagaaagaagatgatgctaccatgctggtttctggttccacttcagttttttcatctctaaaatgagttaagaccacctatctcagaaagtccttatagggattagatgggataatgtctattaaattcgtagactagtgtctgtgtcaagtaaagcatctctgagttttctgcagctgtgtccttgagagctggggaggatgagaaacccaggtatttaattttattattattattgttatattttatttatttatttatttttttgagacagagtctcgctctgtcaccaggctggagtgcagtggcacgatctcagctcgctgcaaccttctcctccctggttcaggtgattctcctgcctcagcctcccaagtagctgggactacaggcgtgcaccaccacacccagctagtttttgggtttttttgtattttgtatttttaatagagatggggtttcatcgtgttggccaggatggtcttgatctcctgacctcgtgatctgcccgcctcggcctcccaaagtgctgggattacaggcgtgagccaccgtgcctggcctcaagcctattattaggttggtgcaaaagtaattgcggtttttgccattgaaagtaatggcaaaaaccacaatgacttttacagcaatctaataattgtcttctggtccaaccttcccttggagataccagcaggagttacaggaccattattgttcctagacaaagaattaagaagagttaggaacatgcacagttacccacaagggacatttgaatcccacttgccctcccttcattttctgctcaagagataatatataatagtaatcaccattatttcatggatgcctactctgtgttgaccattgtattgtaacaactacagcatcctaactaccctatgtagttggttactttatcctattttccccattttttttatatgagaccttgacaagtccaagaataacatagacttgccagggtctcatctaaaaaatgaggaaaataggctaaaataacacagtagagctgcacttgaacctcagtccatcagactcaaaagccagggttttctcagctctcccttagtttcttccaacatggtacattcagagatgatgtaccattaaaataagcacttggtgctttgggcccaacacaggccttggctctttgggaagtacaagagaagtggaagttaggcaaggaaacctgcctctaaaaaatatttgcaattgaggtgtttactgtagaagacagaattatgcaattcagcatcaaatactagtgcctaataaagatttaacattatgtcacaggtaataagaacagtaagtcccagttgagggaccaacttagatgagatagctttttattttgcctaataaggacattcaaaaacaactaccagcatcttttgatatcatcatttcagagaaaataaaggatattataataccgcatgaaagaaacgagaagggataaaagtctccagcggagagtgtgtggagtccctccatatcagggccactcctttcttttctctgctttctgccctgggaggctgacctatgcgggctccattaacagaggccctgggcactgtggtttccggtggggtttactcatagaggtgctgggagcgggaggaagggagaagtgtggaggcaggtatttattccctgttgcttcccttcaggctggtcccttcaggctggtggcatccctttaaggaagagtcattgtgtttggtagaagggtcttctctattctggtaatcactcccacccctctgcggccctttagcccaggagtggtgatggctgagctgctccagcccaggttcctgtactgtgtatctcttacgattcctttacatcccaacacctctgtcacttgttccagtgtaaaacctccccttgaattattattactatcattattattattgagacagggtctcaactctgtcacctaggctggagtgcagtagcacaatcatggctcaccgcagcctcaacttcctgggctcaggtgatcctcccatctcagcctcctgagtagctgagactacaggcacctgccaccatgcctggctcatttttgtattttttgtagagattgggttttgtacaggctgatcttgaactcctgggctcaagcaatccacccaccttggcctcccaaagtgctgggattacaggcatgagccaccgtacctgccccccaacttgaattattattactcaagtattccattggtttcctgttgggattctgactgatacaaggagagtccttgaaatctagcaagtttagcttaatgaagcttgactgcattgtccccatttttctcatttcaccgctgaccagtgaaagcttcatcttgtttgatccatattaccatcctgtcttttctgactttcttggattccgagtggcaactacttatctgtagtgtgaaacctttttactccctctgtagatatcccattagcagaatacactaatgtgtaatggggagaacagttgggcaaactggtaggtacctcaaattgcagtgtgtctgagggaggcttgaaagcaagggagtggccaaaccacccaggcttcgaggtggtacattcttccccctacccgtctccactggtgcacaccagaggcacatgcacctgccaggaatggttccgtcaggacacaagctgaagtggttgtagttagtctgtctaaaagttgactcttaacagagttccttcatttttaatttctatcttaattaaagtttgccaccctcatgcaactagttggactagtatttcggtgtcacaatttatttagctaatacctcatattgttgtttttgtgttcccaacatttatcatgtttcaaatgctacaaagtacattttgaaagcctgggatgttcagggaagactgaggtgagtatgccatgctttcctgttcttgttccatcccctccctgccaacccgtctgatattacacttgtgcatttattgtccttgggatgctaggtgattatagctctccttaccaatgatctgttactgggtacaacacagtatgataagaaaagttcatgttctttctctggagggatgccatattagtaaggatataggttcagctgtgtgtaacagagactcgtatattatagttgcttagatacattgggagttcaaaatctcttatcatggtacagacgtagatggctcacagggctagtgtggtggctttgctctgtgaggttgtctagggactgggctcctttttctcctgagcaatttgccctcattcttatggtccaaagctacacttattccctttgagggaattacatccgggaaggacatcactaatactcatatcctgtagtcataatttggtcacgtgactgcacctggctgtaaaaggaagcagaaaaaggacgcctttattctccacccagcaatttagcagtttattattagaaaggaagaatagatattatggagaggttagccacagttgggaagtgttaaagtctccttgtaccaggcaagatattttcttacaagtaagtcaaagggaaggctgtgcagttccgctgagcttgagttgactctgaggcatccaaattgataacaagggactagagtgtggatgaatttttgggaccaaacagtacaatgtagtcatgggctttaggggtgagcactggaatccccatagagaatgatttctttaaggagtgatatgcagagaaagaagaccacatcccagattgcatctaagtatatgtttcatacattttcccagttgggagatggaatgaggaagaagagaaattgaataaagcaaagaaatgtagaggtgatagatgttgggtaggtgttctccaagggtctcttgcatatgtacacatcttgtgagcaaagccactgactgtctgtgttctggactgtcttttcaaagatctttatatagtgaatagcattggaagacaaaggtagtgtttttccttagaacaagagcaggcatgcttactgtccagtattaaagatacaggttctcggccaggtgcggtggctcacacctgtaatcctagcactttgggagggcgaggcgggcggatcatgaggtcaggagatcgagaccatcctggctaacacggtgaaactccgtctctactaaaaatacaaaaaattagccgggtgtgatggcgggcacctgtagtcccagctactcgggaggctgaggcaggagaatggcgtgaacccgggaggcagagcttgcagtgaaccgagatggcaccactgcactccagcctgggcgacagagcgagactccgcctcaaaaaataaataaataaataaataaataaataaataaataagatacaggttctctatgctcaggactcttctccagtagtgcaccccattgtgtgaaaaggtatcatctatccctcttcacatctccttttgggaactgagtattaaagaaccaccacaaacgctggtacattgactattgctattactgtgagtaataaaccattttttgtctctggccaggagtctcatggcttctgccaacatccatgaaactggcaggtgaacttggaagtctgaaaaaagggtaaaaatctcagacccttcacagttcttaacaggaaggagagtttcaagtcaaaattagggttgttcattaccaaatgctacaaagaagttaaagaaattgaagaataagaaaacgccttgggttagtgacataataccatggctctcaaagtttcggactcaggaccctttacactcaacttattgagggccccaaggagcttttgtttatgtaggttatacctactgatatttactacagtaggaattaaaactgagaaataattttaaaatatctattaattcatttaaaaattatgacatccacatgcacaaaaatacatcaagctgaacctcataacttatacacaattaagtgaaaacagatcatatttctaaaagtaaaatgtaaacctataaaacttttagaacagaacataggagaaactcattatgacctgggataggcaaagagttcatagatataatggcaagccacaatccataaaagaaaaaaaatctaactggacttaatcaaaatataaaacctttgctttgtgaaagacactattacgagaattttaaaacaagctacaaaataggagaaagtggtttcaaaccacatatctgacaaaaagttaaaagaactctcaaaactcaagtgtaagaaaacaaataaccaaatgggcagaagacttaaacacacatttcaccaaaaaggacatgcagttggtgagttagcacctgaagaagatgtttgacatcattagtcattagagagatgaccatttaaaacacaatgagaaactaccacatacatattaggataataattattaattattaataatcaattaattaacagtgatagtgtcaagtactggcaaggatggggagcaactggaactctcatgcattgctgttgggaatgtaaaatggtacagccactctggaaaacagttgggcagtctgtagaaaaattacatccatacttaccatatgactcagcaatctgtctccaaggtgtttactctagagaattgaaaatatgggttcacacaaaaacctgtgcgggcataccttagagataatgcaggtttggtttcagaccactgcaagaaaatgaatatcgcaataaagctagtcacatgactgttttggtttcctagcacgtataaaagttacatttacaccatactgtagtctgctaaatgtgcgttagcaatatgtctaaaaaaaaagtacataccataatttaaaaataccttattgccaataaatgctgaagatcatctgagtcttccgcaagttgtaattttttttgcttgtggaagatctgggcttgatgttgatggcagctgactgatcagggtcgtggttgctgaaggttagggtgactgtggcaattccttttttctttttctttttctttttctttttttttttttttgagacagaatctcactctgtcacccaggctggagtgcagtggtgcattaatggttcactgcagcctcgacttcccaggctcaagtgatccttccacctcagcccctgagtagctggaactatgggtgtgtgccaccacacctggctaatttttgttgctgttgagatgcagtttcgccatgttgcccaggctggtctcaaaatcacaatttcttaaaatgccatgcattggttgacacttcatttcacgaaagattactctgtagtatgcagtgctgcttgattggattttacccacaggtagaatttctttcaaaattggagtcaaccctctcaaaccctgccactgcctttatcaactaacttgacgtaatattctgaactttttgtggtcatttcagcaatgttcacaaatcccagcacttcgggaggatgaggaaagaggattgcttgaggctaggagtttgagagcaacctaagcaacacagtgaaactcctctctaaaaataaatttaaaaatttagccaggcctgtagtcccacctattcgggaggctgaagtgagaagatagcttgaggccaggagttcaggccatatggtgccaatgcactccaacctggccaacagagccagacccaactcaaaagaacaaaaacaaaacaaaacaaaaaaacattgttgacagcatcttcaccaacagtagattttatgtcaagaaacccctttctttactcattcataagaagtagctcctcttcatctgttcaagtttagtcatgagattgcagcaattcattcacatctttgggctccacttctaattctagttatcttattgtttccaccacctctgcagttacttcttccactgaagtcttaaattcctgaaagtcgtcacctatgagggttgaatcaatgccttccaaacttctgttaatattgatgttttgacccactttcatgaatctgaatgtacttaatggcatctagaatagtgaatgctttctagaaggttttccgtttactttgcctagatctatcagaggaatcactgtggcagctatagcttcataaagtatatttcttatataatgatactcgtaagtcaaagttactccttgatccatggactgcagaatagatgttgtgttagcaggcataaaaacaacattcatctctttgtacatctccatcagaaccttggatgtcaataagcagtcatatttgtaaagaaatctcttattctgagcaataggtctcaacagcaggcttaaaattttcagtaaaccctgctgtaaacagatgtgctctcaatccagcttcattttttcatttatagagcacagagagcatagatttagcataatcctgaaaggccctaggattttcagaatggtaaatgagcattggcttcaacttaaaatcaccagctgcattagcccctaacagaagaatcagcctgtcctctgaagctttgaagctggcattgacatctcactatctatgaaagtcctagatggtcttttttgcccaatataaggctgtttcatcttctattgaaaatctgttgtttagtgtagctaccttcaattatcttagctagatcttctggtaaacttgctgcaatttctacatcagcatttcctgctttaccgtgtacttgaaagttacagaggcagcttctttccttaaacctcatgaatcaacctctgttagcttccaacctttattttgcagcttcctcaccacttttagctttcgtagaattgaagagagttagggccctgctctggattaggctttggtttaagggaatattgtggcctgtttgatctttctacccagaccactaaaactttctccatatcagcagtaagtctgttttgccttcttatcatttgtatgctcactggagtagtgctttgaatttcctttaagagcttttcctttgcattcacaacatggttaactggcgcaagaggcctagctttcagcctctcttgggttttgacatgccttcctcactaagcttaattatttctagcttttgatttaaagggagaggcatgggactcctactttcacttgaacacttagaggccattgtagggttattaattagcccattattgttaagtcttatggaataggtaggcaggaggagagggagatagactggggaaaaaggcaggtcagtggagcagtcagaacacaaaacagttgtcagtgaagtttgccaccttatatctgcatggtttgtggcatctccaaacaattacaatagtaatattaaagatcactgatcggctgggtgcggtggctcacacctgtaatcccagcactttgggagtctgaggcgggtggatcatgaggtcaggagttcgaggccagcctgaccaacatggtgaaaccccgtctctactaaaaatacaaaaattagctgggcatggtggcacatgcctgtaatcccagctactcgggaggctgaggcaagagaattgtctgaatcccggaggcggaggttgcagtgagccgagattgcaccattgcactccagcctgggcaacagagcaagactctgattaaaaaaaaaaaaaaaaagattacagatcaacatactggatataacaataatgacaagttttgaaatatcacaagaattaccaaaatgtgacctggagacacaaagcgagcacctcctgttggaaaaatggggccgatagactttcttggcacaacttgcttcccacagactttcaatttgtaaaaaatgcaatatctgtgaagtgcagtaaagtgaagcacaataaaaggaggtatgcccgtacatggaaatttatagcagctctgtttgtaatcaccaaaattgaaacaaaccagatgtccctcagtcagtgcgtggataaacaaactttgggacacaaacataccatggatacataagaactctgcagaaaggaataagctatcgatacaagcagggacatggatggatggatctcaaaggcattattctttgaggctgctttaagaagcagcctcaaagattttgtactgtatgattcaatttatatgacattttaggaaagaaaaaactataccaagaacaaatcagtagttgccaggagctggtggggagtggagggagagggtgactactaagaattaatatgaggggttttgagggtgagggactagtctgtatcctgacaatatagtcgtggtagttatatgaatctatccatgtgttaaaattcgcagaactgtacaccaaaaaaggaaattttactgtaagttaatttaaaaataaaataaaatagcaatataaactcattatgtaaatgtaacgcactttttatgaaagttaaccatattttcaaaaacaacaaaaaattagtaagaacagtggcattgttttacattttttgtaaatctctttactgtctagctttatatagagagcggagttctcatatctccttctgcattcactctgttgtgatatcacatgtcacatcgtttctggaaaaccctactatatatacacttgaaagaggatgagagtgaaaaaagccagtaatgtcttagtagttttaggatcattgttttgaccctgtggaccatctgaaatggtctcagagattcccgagggtttctgaacccactttgaaaaccaatgatataacacattgttccaaattttattttcatagcatcttgacttttatttttctggctatatccacatgttccctgtgtttacttaatgcctatgttcaaattggcccttttttaaaacttgctatatctcctataaatagaaaaccagtaccaccttcccataaatagtaaatacaaaacaaataagcaatgaaaaacttaatatacattttaaaagtttatttctgggccgggtgcggtggctcacgcctgtaatcccagcgccctgggaggccaaggcaggcagatcaccagaggtcaggagttcgagaccatcctggccaacatggtgaaaccctgtctctactaaaagtacaaagattagccaggcgtgatggcaggcacctgtaatcccagttactaaggaggctgaggcaggagaatcgcttgaacctgagaggcagaggttgcaggagctgagatcgtgccactgcacttcagcctgggctacagagtgagactccgtctcaaataaataaattaatttaattaaattaaaagtctacctgtgaaccatctaaaatcatctctgcatgccacggtttggaaaacaccaatttagagaagaaataacaatgatcatgatagctaattctgacatgctacttcatttgtatcaacccattgagtcctggcaattactgctggacaaggcagacagaattattatactgtctttctacaaaaaaaaaaaaaaagaaagaaaaaaaaactttgaagtacaaggaggctgaagaagttgctcagtgttccacagcaagtaaattccggggctggaatttgaacccaagcaatctggctgcagagtccaagatgctgtcttggcagataggaaacctggatctttgttcaagtcctgccgtcagttggttcttggacatgtcactgaacctcactgtcctcatcagtaaaatgagaaaggtgaactaaatcaatgttacaagtttaaatgtctggtgcccacaggggccagatagttaagggaaaactggactgaatacaatgcaatagggagtggtggggattttacatcttgtctgaagaaggcagcttctatcagtttcaactgttttttatttttattttttggcctttattttattttatgagagaagattgaggtctgggtatttttgcctaaagtttcccaagttttagaacacttggaagggcccgccatgcacatgggctgactggtttgtgacttcttgactggatgagctcctcttgacttagaggatttatgattaaatgagctgtttttggacaatggtagaaactaaatccaaattacagaaataggcagtttaaaacaatgacgaaaggggataaggacttagaacgtggctcaacacagcttacataaatattgattaagagctgggttaattgaaaagccaaggtacattaatagaataacaaagtgtatttctttgtgttccttttgtgttgtattagagtaaatcagcaatatttatccagtgctaattctcagtttgcagagaactaatgtaatcatgagatgagcttattgaaattcttttcttagacatagagacttgcccaagaatggtgagtattaggaactttagtcagcacttgctcagaatagtaaatgcgaacatgtgatttatgccattgtgtgcacaaagtaatgtttcctgagacattttctatatatatgttggctactttttgttttcttgtggtgggaggggggtgttggcttgctgtttccccctcctctccttatcagatttccttctatggcatttgacaatgttgcagggccagtttctctgtgaatccacagtaaaacatactggtggtttcacaattaagccaaacttgggtttatggcttatgcatgtttatgtgaattcctgcatttgtttttatgtgtgtgtgtgtattcatgaaagatctgtttgagagagggagaaaaagggaggacaaaacctatagactgaatcataaaagatgggtttattcattaatgacatcataaggatagtattttctcttggttaatatactatttgtttggagggtgttgtaagccatccagagatagtcatgccatttcttggaaaagatctgaagcaactagtaattgaaatgataatcatttgatcagagagctatttgaaaataacactcatctacaaacttgtctcttctgggaaactgtatttagtcaaaatgttgccaaattctctctttactaatgttgagactgatacacctaattattttccagtacattctaaacttgatttctggtgtcacctgtccagaagctgttcccatatgctttgaaacaatatctagcctgactttattctgacatttaataatcaccatgaaatagctataaaatgcatgacaactacagatcttttatttcaagaggatggtgtggtgaatctgagggaaatcatccgttgaaatggtactttgtaatgggccccattgtttataaagtactcaaattttttcttgagcgcacgatagaaacacagtttccactttgtctcccatttagtggtagttcatatttaatcatgataagggaaaggattccattactaaagttttacttttcatttttgatagagtatttgttactctgctgctgcctaatagactttcttctcagaagcagcttggaactcaatgaggaaaattgaaattttagatcctaccttaaaacatcagaaaaaaaaaaaaaccctcaacccagggcttcttattatgtgaagcttaccctaataacctttttttgttcgaattggagaagtgtgtgtgtgtgtgtgtgtgtgtgtgtgtgtgtgtgtgtgtcggtggggcagggggaggaggaaaaagtcatgtttggggaggaggaaaaagtcatgtttaacagcaaaattagccaaaatcagttgtgaattccttttgtttaatagctttgagacatcttcctgttgttgtttgtcaaaaatatttctaagattttgtaatcttaggggttttcacagccaagctttcttcagaaatgtgaaataaaagaaatgaaagaagtcagttcaagttgaaatgtcagatgcttaaataacttaacttaaaacccagtgagatgatcttcttgagccttttccaaagaatctttgggtgaaggggcctccctttgttccatgtatggatgtctattaaagatcttgctgaattaattctgagtcagaaaagttggttgtttcctagaagcaattagagatgcttaacattcaaatttatgatccagaggagaaacttgcatttcaactacttttcttaaattcaaagactttttcctcactcaccctctcaccctctaccccatctgtattaaaagaaaaaatcagttcatttctcagcttacaaagtttttgagaaacatgagaatgtgtaagtttctttcagtgggaagcacataacatttatgaagtatttcttttgggattacatcacagttttatttaatttttaggacaaaagttaaattcaatatttgtgtataagccaagggaaaatgtaccataaacataggaatttgggggtgagtcagagttccaagaatcctagatttacttagaccatttatgtagagacaggctcaccattagtcatctagctttcactttttacatttgcaattaattacacctaaaaactagctttcacccaagtggtcagctaggtagagtgtgaacttgggcaaccaacattaaaaatggcttattagaattactgtcctatttttggatactttctaattgtataacaaacataaaaattattccttaactaaacaactagcagtgaaaaaccattgaaatgaagtgagttactaaagattctgtgtcaccagaatgcacacagtctccttgcattaggttaaaccactcacatggcatttcagatgggccttgtggagagtggatcatttccctcaaacctataaataacgttttttgttcttccccaaccacctcttgtaggatgaagtcattgctgtttccgaaaaggtgattgtgaagcttgaagacctggtcaagtgggtacattctgatttctccaagtggagatgtggcttccacgctggaccagtgaaaactgaggccttgggaaggaatggacagaaggaagctctgctgaagtacaggcagtcaaccctaaacagtggactcaacttcaaagacgttctcaaggagaaggcagacctgggtaaatatgacttgtaattttaaatctaatgtgtgggcgtatatagtaacttttcggttgaagatttttctggaaacactatcatttatatataaatgtatttcaaatttctttaacctcaaagggtcctaagaatatggatggagagatgactggatgggtaagggatgagtgttacctgttggatcaaaggaccttttatgtatggacccttgtgctggggtgatacagtggttctaaacaattttcagtgtgatgtcaaggcatacaatttaattagagcacctaaaattgaattaatgaagagtttaaatacttgctataagtatgtagtatgacatctattaacaccatgtcccaatttcatgttttacattgagtggaaaacaaactgaggaaaagggatgagttcctcaatgtggagcaagagaacaatgtcaagccaggggatccactggttggcaaccaatggcataggtttgcttgatcttttagtgttcagtggtaccatcaactatatatatatatatatatatatatatatatatatatatatattttttttttttttttttttttttttttttttttttgcttccctcttccactgtaagtttaaaggagaacttgggctttggagtagttgtgctgattggtgtttacatactaactctgctgcttcttagctgtatggccttaggcaaataatttaacttctaagcctcagtttccccatctaaaaaataggggaactttacagggttattgtgagatgtgagatagaaggggtagagcacattgactggcataaaggaggggcttcataattagttctattgctttttcttaacactttcttctccagtgacattttgtgtcctttcattgctttttttttttcttctgtttgtattcccgtgtcattcactgatttattctcctagcattgcccaagacgaaaattgttgtcctctgatttagactagttatttcctctttaggcaaagaggaactgcactttaacatattaaggcatctttttctttcatttgcgcacaatgctgatttttgcagtcctattttacgccttaatgtgacaacttcctggtttttttttttttaaacccagaacttaactattacaacaaacctaggcaatttattttaattggcataaagagactgaataacaccagtaactgactgtggctttcatgtgaccctggtttgtgatgagctgtgctgtgttttgggaatagcattaatattttcttgcagtttgagtttaactatcaacggtttcctggcatcttttggttgatgtcagacagtaacattttagatatggcagcctgattgtcacctgcacatttagagacaattattagactagtggttttccttctaaagccaaagagttttttgataatcttcctatatatactgttacaccccccagttttgtgaacacacaataactagtcttatgacttgcggtaatgctgaataatacatctgttgtgttactttcctaatgtatgatctaagttgtattaccattgtcttatgttttccttaacattaaaacctttcttttgtttgtttaattttgtgtgtgtgtgttatggaatatactgttactaataaaaaattaaacaggaaacccacaggggacaaaaggatgtgtagatggttaagcttgatgtcacacatataaacaagagtatttatagcaaggtttatgtttaaaattgtgtttaaaatggataatttattaatgaacaggaaaataagtctaatttcttaattccacccaaagaaataaaaggttgatcctcttggattctaaaaaaaaagaaggtccatattctacctttttgcagttgattccagaagaaattggtttatagtgaatattcacagtacttgcaggtggtttggcctggaaaatctagatgagtggtttttaaatttagttgcttattagactcaagaaagaaatttaaaaaacaatactgattactgagaccagcttttctagattcttcattcagtaggagtaaggaaaggccaatgaatgtgtattgataaaaaggttcctggccgggtgcggtggctcacgcctgtaatcccagcactttgggaggccgaggcaggtggatcacctgaggtcaggagttcaagaccagcctggccaacatggtgaaaccccatctctactaaaaatagaaaaattagtcacgtgtggtggcaggggcctgtaatctcagctacttgggaggctgaggcaagagaattgctggaacctgggaggcagaggttgcagtgagccgaaatcatcacacctttgcactccagcctgggcgacaacagcgaggctctgtctcaaaaacaaaacaaaacaaaacaaaaaaggttattaggttgagtctgattttgtttgtttgttttggtctcattttggagacagctttatgattagtgctgaagaagggaaaatgatcaacaggagagttgattgggaggctctctcctggggcacaagaaacaccatgtacttaaaaaatttttaatgtaaaatacccctttaaggatagaatttagggccttgaaattctactcagttgctatgaactgtggggaatttgagacaaatagcttttgtaattggaatgcacactgtgttgtaataatgtggaaagagaaacaaaaactttccttaatgtaatgagtttccattatctgcctaatctaaggtttgtaagtctacattgtcaggatttatattgaggagatagggggtgtcattttctgtacacattcctgtccccacaactttctcttcagcctcttctataacatcaaaatatttgttgtctgtacttttctttctccgcagtggttttcttatctccttttctgttggtcacactgaaaccacctccaataccacattgttaatggaaattcacacacttattaggtttttccttctgtagaacccttccaactcctcattgttcttaccaaagaaagaagatgaactgtgagattatttgaggccccccccctttttttctggtggaagtaagcaaagaacggaaagatctcacctttctatggataaagtaaaactccaacatgttatcgttttttaactgagttatttcataatgttgaaacatgaataataacaaaataattagattggttcttagagaagggattttaaaatataaaagctcattaaagcacttttcttgcttagtgtttaggtagaataagttcgctttaattccagtttgtgtcacttcctgtctctctctgaatagtaaaaaaaaaaaacaagaatgttctcacaaatgtgtgtctgccaacaaattaatactccacaaagagaaactctgcccccacatggcagcttccaataaatgctctgattcaaatcacaactctttcattttttttttatccccttcccccttgagggagcacatttagacaatatttgaggatgtcatctttctgcttttttaaaactctctagagttttcatttaagactcttaatggttgatgactaaaactacagatctggatagtggaaaaactaataatcttaaaaaacacttctgaaatgtggtaaagtgcattcattctcttccctcctctttgtccttttcaaagaaagaaagttcaatatgaaaccaatgcaaattatgactttactcagtgagatattttaccttctttcagactgtttcatactgaagtttataaaaaaaaaagaaaaataactatgttaaaataggagggttaaggaatgtattattcataagcataatgaacacaagaacctgtttttccagaagaattgggttgattaaatcattcaccacacaagcctctagttatttatttttgtctttagaattacagtacttagcttttataataaagtggacttgatacccatatttggtatggcagttgaaagtagtcaaatgaagaattatttcattttacaaaatttttagtaagtaaggaatataaacactatcagttaaacatagcaaacttgcatttttttattccttgggctatagtttgaaaaaaaaatcaaattattttatgtaacactgattcttacagagttcctttaagcgaagtatgaaagctgcagtgtaagctttattggcctataaatatgtcattatagttggactacatttatatgctttggattgttgtttaagccaagaaaatatgtctctacaggttgactttttattgaagccctttgaggcatacaacagaatgtattttaggccaaggttattaaaacagcattttcatttttttgcagcagactcattgtcaattatgctgccacaaactgtctgtggatgggcagttatgaatggtttcatctccaaatgtgtctttagaaaaagaaagaaaagatagaggagtctgagctgaaactgagaaaaaagacccaaagattatgtgtgggggtctggctgaatttaatgatgggggttccctcagttcaatttctgtttctaaatctgtcccatcaaattgagaaagagtagcttccccctttcttctgttgctgggactttcactgtactttttgggagtcaacagcatggtggggttaaaagagcagagggtgggctgtcaggagaatcttggctctacatgtagatctgtcaccactggaaaagtcactggaagacactgtatgattttttacctgagtgctctcatgaatttattaggatttgaagacatgcctcttattggaacaatccttccttcctttctagacttaaattttatgtgtatatattttttgttttttatttttttcagtgaagagaaataacttttattaatgagagcaatgaattcttaattctcagccacaaaaaaagataaaatacaatgagattttcaaatgtaaaataaaatatctgtactcacttcattgctgcagagataaagtgaaatattattatacagctctaaggtgacatgaaaagaacacaactgttcaaccaaatggctcaaagtaggtttaaattttatgtgtatattaaagagtctttggaaggtatttgttgtttatattttactttggattgctggtttcactctgccattttccataacactgcaacttgagaagtttcttaaatgatatattgtttatacattcagctttgttttgtctaaaatgggcaataatatgtacctggctgtttctcattggatttttgagaagaccacctgagaacaaattagttaatatctatggaaacatttgtgatactgaagtctaaagtggtattattagtacattattattatcagaagcaggttctgtatgatagggagccatgtggtacaaggttagcttatttgtcccttttgaatttccctaatcacacacacattctagtaatttagaacagggtttactctcattactgtctccctcgatagaaaactattataaaagtcctttaggtttttgcttgtttatatgtatatatataaatacatattatatatgactattattttaatatatatttatttcaaataataaatgtatgtaatatataccatataacataaacattttatatatttatatattaatatatatttatattttataaacttttatcctcctgaaaattctgtcaaaataaactgagccataagtggccagttgtataggatatctcaaatactcttggttaaaaattagctgtagtttttgcttggagattctggaggcctcgtattgcaaatggttgtttcagatcacttttgagtttgatatgtcaggcagcttcctgagatgtggacatgggaaggattctcactttttgttgaagaaaacaatataaatgtctgtaagaagcatgctaaatgcagacatcttgtcatagagacttttcactgctaatgaatttactaggattggaagacatccttcttactgggacaatccttccttcctttctagatttaaattttgtatgtatattaaagagtcttttgaaggtatttgttgcttggattgctggcctaagtctactatttttcttaacactgcaacttgagaagtttcttaaataatatattgttgcactatactattcatgaatatcatgaagaatcattacagagcaaccttctaactaaaacgaatttgggccaggcgcagtggctcacacctgtaatcccaaaactttgggaggccaaggcgggtggatcacaaggtcaggagttcaagatcagcctggacaacatagtgaagccccatctctactaaaaatataaaaattatccgggcatggtggcatgcgcctgtagtccgagctactcaggaggctgaggcaggagaactgcttgaacccaggaggaggaggttgtagtgagcagagatcacatcactgcaccccagcctgggcaacagagtgagactctgtctcaaaaaaaaataataataatttggcctttatagtatccttaagttcaacatggaaactaattacatacgagacttatcaaagacttgtaaagatactttccaaaggattttctctctgacaatattgttgtgttaaccatgcattcgttaaagaattttatcatagcccaattaacattggaggagatactctccaagtacccacatgactcttcaagagattgcctcatgccgttataatgtgacaacccaaaggacttttgatggagtacaagaatctgcatccaagatattcagagttttagaacagcttattaccagtatatcttctcacttactttctttttttttttttttttttttttttgagacagggtctcactgcattgcccaggctggagtgcagtggtgcgatcttggctcactgtaacgtctgcttcctgggttcaagcaattctcctgcctcagcctcccaagtagctgggattacaggtgcccgccaccatgcccagctaatttttgtattttttcagtagagacggggtttcacgatgttggccaggctggtcacagactcctaaactcaagtgatcacccgccttggcctcccaaagtgctgggattacaggtgtgagccactgtgtccaacccagtatgttttctaagaaactaggaatacatatggttataacacataggaataagattattcatttcatttgaaatttaaattttggcttgaccatctaattaaatagttgaatattgccttgtaatagtggtagaatgagtgagtaaaagtggctcaaataagtaatattcatttatgctgtctacactcagccatcttggctattcctgctagaaaagaggtctttgtgaaatctgaccaagtctgagccaatcaacagctggtcgttgataatgctgcccaggtacttgtactgccatcactcatgaaggcacaatccaagttaagaccctttcatttggaattactgttgacctgaggattttctagtgtttcctgcagccacgaaagcttcttagaattccaggttcatttcttcttctgatgacggactgaagatggaccatcagctgaaaagaagtttgtagaattttggaatttattcctacttttccatttggagatgtcagggcagaagtagaaaaaaagtgaaattggaactttctgtgctatttttagtatccaggctaccagtatttacctctaggatacaatgtatgcaaaaggagtaatggagtacaagaatctgcatcatgcttttctgaaactctttatagaattgtcaggctggaaggggccttcatgaacattgttttctcctctttttccttctaacagtcgtcaggcctctcttttcagttcttccctaagatgtgctttcagaatccctcaccatcacggttacttatcttaggatacactttaggtaattttttttttttttttttttgagatggagttttgctctgtcaccaggctggattcggatccctgcaacctctgcctcctgggttcaagcaatttccctgcctcagcctcccgagtagctgggactacaggtgcgcgccaccacatccggctaatttttttgtattttagtagagacggggcttcatcgtgttggccaggatggcctcgatctcctgacctcgtgatctgcccaccttggcctaccaaagtgctgggattacaggtgtgagccaccatgcccagctgaggtgatttttttataccatttaactcatttatattgcaggagctcatttttactaagaatcctagagccagaataggagtagattctagagaaaggccccagtgatccattacgcatggccagaactctaaggagctggcttggcatcctccagatacaacatgacattagcaaaactactggactcttctctagagctgtatggccttggcctttttataagtaagagcaaaaagggggaaaatattctgccactacactccctgaagtttaggtacctatttttttgtttgtttttatacacagtaatattaagtgtagactagtatctaatgaacatcgttgttaatatggcagctactgtggctcaatatcaatgttgtgccttttgagcttctgtagttcctgtagttttttactctagcatttaggatagggcttgcccaaactgatttttgcctcagtaacggtctacagttgaagaccagcttggtgtctgagagtctgtttaagctattccaaccaaataatataaaaactgcaagtctttcctaaattttcatatgtgatagtttaatcatgttgttctcttggacttaagctgttcttgtttttgttttgttttgtctattttttctagcagtttgtttttttacagccatatctatgataaaagaccatgatggaggctgggcacggtggctcacgcctataatcccaacactttgggaggccaaggcaggtggatcacttgaggtcaggagtttgagaccagcctgatcaacatggtaaaaccccgtttcctactaaaaatacaaaattagacgggtatggtagcacacatccataatcccagctacttgggaggctgaggcaggagaatcacttgaacccgggaggcggaggttgcagtgagtcaagattgtaccattgcactccagccttggcaacaagagcgaaactttgtccacaccacccccccacgcccccacaaaaaaagaccgtgatggataagacagtgaattcataattttgttttagcttcattaatttgaaatgttaatttcccaaagaactgtctgtagagattgccatctgatgagaagataatcaaaagatgaaagaataaattcatttatggtcctattccttgctatgcctttagtttcttgctgtgtaccttggattgactggaacaagtcttatgcggccttggcttcatacaagctcataaattttcattatcactgatagattgccaaacttagcaccagtaattctgtttgcatttggtgataaaagtgggtctattgtgaaggacaaacccaactgatccaccatgttttgttctttttttttgagatggaggtttgctctgtcacccaggcaggagtgcagtggtgcgatctctgcagactgcaacctctgccttccgggttcaagtgattctcctggcctcagcctcccaagtagcttgggattacagacatgtgccaccacgcccagctaatttttgtatttttagtagagacggggtttcaccatgttggccagggtgatcttgaactcctgacctcgtgatctgcccgcctcagcttcccaaagtgcttggattataggcgtgagccaccatgcctggcccggaccatcatggtcttttaaatatcttttgagaatgcaacactgactctgtacctcagatgtgcttttaaagtgaggtctgtctgggcacagtggctcacgcctataaccccaacactccggaaggccgaggtgggaggattgcttgaggccaggagttcaagaggaacctgggcaacatagtgagacctgtctctgcaaaaaaattttaaaaattagctgagtttggtgacgcccaactgtagccccagctactcaggaggctgaggcaggacaatcacttatgcccaggaattcaaggttgcagtgagctaagatgataccactacactccagcctgggcaacccacactgcattccagcctggccaacacagtgagaccctgtctccaaaaataaataaataaaataaaaatgaggcttgattcagcagttcccctttcagttggaggtgcatgatgcttttattttgtcataactctaaaatgtttttgtttgccttctacctctcacctcattagccactgtatgattactgacagtgagccattattacagctgctatcatgatagcatcaccttggaacacaaagcagatatatcctacatgtgaattgatgtggtttttccagtgggttctgtgagcaggtatctgatttgtgcatttactcttaatactcggtggtattgacactgattcttttgaacagtttgtttaatctgttagagtacttttaagtctgaagttctgttgcaacacattaactttcctaaatgtcagattcactcctctcctgtaacattatgtgtttaagtctgtagtttatgcaggtcactgcagaggaaagctgaggtttggacttttagcttattttaataaatgtatttatttaggacagactggaataatagtgggttttcaaagacttcgtgaagtgcttcatgcacagtaggggctgagcaaatagtgctgatgatttcaggcttttcctagttgcctcactgtgtgttttcatttggtgtgcttggatgaagtggtattgcttctttcttccctaaaaccccagagcctgtgccttgcctagaactctcttccgttgggcagccccacttgctttttgaatttttaactatttctattatcttttacttctgaccttaaatattggcattccgcttaggatccctgtttctttgcaaacttcatgcctacgggataaaatacaaatgttacaggagtatccagtgaacttccaggctccattttcttctctttttcattaagtaactttcattattgttattttttgttactaccaatgttatccatgtttgttttagaaaatataggcactactgacaaacaaaaagcagaaaaattaatgttgcctattttcctcccactcagaagtgctgttagtatttgtatatgtaccaatgcatatgaatgcatgtatcagtgagaatttatatggatattatttttcctcataaaaataaaatctactgtttgggaatctaccttcccatacttaattttgtacagaggtattataaatatgcccccatattgtaaaatatcctatactgggtttttttttcagctgctgaatatttcattacagaggtgtttcatactttaattatcgttgggcatttcagctctttctgattcccacaaactttataaaactcttgtagttatgcacatagccatgactatttctttatacatttgtagggggggatcgctggttcaaagtgcacacagaacgttaagacacctatcccctaccttatctcctctcctaaaccttctttgccctagcctaactagtctaactgcctggttttctttctctttaaccacatgtactcagtcccctgccttccaaactctccagtgtgttttaagtggctcatgcctctctactcgtggaatagcctttctaggagtcctacctgtgggaattctgcctttcgtttaagacttgtttaagcctctgaagcccttctcagccttccagctcagaggaattgccctgctttattgagctcttatcttatcacatttagtgtctctaccaccttattgatcaccttactctatacctaccaatataatgcagtatcttttttcatgtgtttatcttatcttcccaaaaagtcttaactctatagtgttagcactcagacatcaaagctatacctagtaggttaagtaaacatgcggcttttatgatcagactttcctgaaatctctggagttctctgttcttagtctacttgagacacctatgtgcatttgaaggttgatttgagttcttttagagcacttcctaagacactctctagtggagaggctgtttcattggtaccctgtagaagcagcagctacttggggtattagtttgctaactattcttggtctaattagtagtcatctattcatcactcattctagaaaacacattgagagatcacgtgaacatgcttgaagctatcctgctagcctgaggattgtaggtggtgttataggtgtgtgtgtgtgtgtgtgtgtgtgtggacattttacatcttaatagtggtacatattaatgcctttctcaagggaatcttcttcgtgtttcagggtcatagtagtgacaaaaatatgcagggaataaatccagattggacttgttccaccttacctttttttttattattatcggcttgtttgtaatctttttttaagatgacaggttattaagaagatgattctagcacgacatctagtgctgcttattctaggcaatcacaccgttttaatcttcgcctcccttaaaatggttgcttgctaattatggtggaagatattctccatcttccaactactcattctacaacttttgttcacaaagaaagtattctgttaggccttacaaaaacaatgcttcatgcctggcctattctctcaataggaaataaaacattgttttcatagcagagctgataataaggcagagttcaaagcatgatgaaacatatacttttctagcagagaaaaacctatagttacctggctaattaactatcacgtgatggctgtgtgtataaagatacaggcttttcacatgtgcggcctgtatctgggtttcttttctttttttttcaattgagaatgctcatttagttcccattgatttgtattaatgttttccatcaaagatttagaagaatgagcaaacacagaagctgccattttagggtagcttctttttgaccactgtactaaacctcagtagtcagttatgttgtagcggaaagagcatgaactttacaaagtaagatggacctggattgaagtccttgctccataaactgtatggccttaaaagctttcactctgctttgattgcttatctataaatcagcgttaacaatacccatctcacagttttgtctcccaggacttgggaagattacgttagatcatctataggggtacccaacacacagtgggagcacttggtcaacaatattagtttcctttcccctttcctttagaaaggtaaacccttactcaagaaagcaaagtgagtagatgcaacataaaaagaataccaagacagagattacagtagtatgttatttcattttatttaattcacaaacacttgagttatctattataagacattgaaattgattgagggttaagtgagccatgatcccagttctgtaggaattttgaagtttttaatgtgatttttaaaaaatataaatttcagccgggcacggtggctcatgcctgtaatcccagcaatttggaaggctgaggtggtggatcacctgaggttgggagttctagaccagcctgaccaacatggagaaaccccgtatccactaaaaatacaaaattagccaggcatggtggcgcgtgcctgtaatcccagctactcgggaggctgaggcaggagaatcacttgaacctggggggtgggggttgcagtgagccaagattgtgccattgcactctagcctgggcaacaagagggaaactgcatctcaaaaaataaataaataaataaataaaaataaaataaaattatatatataaatttcgatgctaaaatttacctgtgtgtattgtcctacagacctgctttttacttcctctgatcactcttagatcatgattaacagctgatgctagttggctagaaaatttcgtgccaggaattcagaatgtactctggatgatcacatgtaaaacatgtgtattgctgagctcctctgatgtttctctggctgtgaactggtgttcttgtggtttattggatgtgcatgagtaggtgtgtgaatacgcttgtgtgtttgtgaaatcatcccaactggaaatctcttttgtccttgtggtatctatttattccataagaaagcaaactatgggccatgagcagtggcctgtaatcccagcacttcaaggcaggtggatcacctgaggtcaggagttggagaccagcctgaccaacatggagaaaacccatctctactaaatatataaaattagcttggcatggtggtgcatgcctgtaatcccagctacttgggaggctgaggcaggagaatcgcttgaacctgggaggcggaggtcatggtgagccaagatcgcgccattgcactccagcctgggcaacaagagcgaaactccatctcaaaaaaaaaaaaagcaatctatgatgtgccatggttttgtgtgtgttattttctcttggaggttatgagtaagaattttcaagtttagaatagcctaaaggatgctgtagtagcaacatttctaaaacctcaatagctgaacacaacaaagactgacttcttgtttatatactgttcagtgtggggtacataggactctaagagcagttttcccctctacagtggccctgctttggacctccataccaacacatgcttctatgctcacgcagaaagggaaaaaacaggcacaagtggagtactggcaattaagtgtttattaatacatacattaataacatgcagtaacatgcatcacttctcacatttcattaatcaatgaagtgattaatttcatgaccatgtcttgacttaaaggaggtggggatggatatatgatcttatagcattcttagaaggagaggggaattgaatgtgaacattagtgatatttcacacatgcatttaggataatgatgtatatcataggataataaaatctcagggatgaaaggaactacagataatctagttacaagattttagtaatgtcatctttactatacttactatctcttcaatgccctttgcagaaatctttttttgttttgttgttgttttttgagacaagctgtcactctgtcacccaggctggagtgcagtggcccaatctcagctcactgcaacctccggctcctgggttcaagtgattctcctgcctcagcctcttgagtagctgggattacaagcacctgccaccacgcccagctagtttttgtatttttagtagagacggggtttcgtcatgctggccaggctggtctcgaactcctgagctcaagtgatccacccgcctcagcctcccaaagtgctgggattataggcctgagccactgcaccaggcccagaaatcttgattagttgactttttaatattttcaatgagtgggaatttttattactttgtgagatagtcccattacatcttttatccatctctttgttagacattcttacttctgaaaaataaatttgactatatggtttataacaggggtccccaatccccgggctgtggactggtactagcccctggcctgttagaaactgggccgcacagcagaaagtgagtagcctgcctgaacattactgcctgagcttcacctcccatcaaatcagtagtggcattagattatcataggagcacaaaccctattgtgaactgtgcatgcacgtgatctaggttgtgtactccttgtgagaatgtaactaatgcctgatgatctgaggtggaacagtttcatcctgaaaccatcccacacagtccatggaaaaactgccttcgccaaaactggtccctagtgccaaaaagtttggggaccactggtttatagcataaacaattgtattaactgtatactgttgtttccagttctattcttataacaacatggcacaaatcacatttttctttttcttgatagcatttcaaatattttcatttcagtttccaggcctcctcagcactctctgtccccactcccaattttcccttctccaggtcaaacactaataacctcaatctcacattccttatacagtgtgatttctagttccttcacctttctggtggcccttatctaaagaaatctaagttgtccctatcactctcaaactgtaactacatttgtctgtatttaaagaaaaggtgacatctcaatctttctctccttaattttactttttatataacacacataaaaatgtaagtaaaaaatccttcttcacctcctttccagtcctactcctcctcccagaaataataaattgctaacaatttgcgggtattcctccagttatctgtgtgtgtttgtgtgtaaattggtttttgtttttttgaaataggatctcactctgttgggatcatggctcattgcagcctcaaccgcttccaggctcaagtgatcctcccacctcagccttttaaattgtttttctgaaaagacaggaacttactatgtgcattttagtgtttaacagtagtgcagagctctgctgtccagtatgatagctactagccacaaatagctattgggcatctgaaatgtggctactacagttgacaatttgggttttatatttaattttaactaatttcagtttaaaataaaaaactgaagcagtataaatttttttttgttaaacataactttattgtcttgtttttttgttgttgttgttgagacggagtttctctctgtcgcccaggctggagtgcagtggtgcgatctcggctcactgcaacctccgcctcccaggttcaaacaattctcctgcctcagcctattgagtagctgagactacaggtgcaaaccactatgcctggctgatttttgtatatttagtagagacagggtttcaccattttggccaggctggtctcgaactcgtggcctcaggtgatccacctgccttagcctcccacattgctgggattacaggcgcaagccactgcgcccggcctgtcttggcattttaactgtcatatatttagcatgcagactggatgtactggaagtgcaaaatacactggatttaaaaaacttagtatgaaaaagaatatatatctctctaatgatttttatatagatggcatgttgaaataatatttttgatatgttggattaaataaaatatattattgtaatttgaccttttaagaaattttaatgaaaatttaaaataatgtatgtgtctcactttatatttatattggacagtgctgatctagagagatttggacaaatgcagtgtttagcccaatctgttattttgaagtagaatcaccatttcatgcttcataaggccagggcactatatttgctgtagaaagaatatgaagacgaaagggacccagtcactgccctcaactacggccttcattttgaggttgtccacctggttggttggtgggtttcctcttttagattggagggtttctggttttcatgcatgtgtaggaaggaaggaactcacaggtagcagggcaaacagctacaactatgttataaggtagagtctagccagtgcatggatgaaggcgtaagcagtgttccaggagcttggatgaaggttgcatgagtacgtcttgcctgtgaacaacattgtaaaaacttaaaagagtaggcattgtgacctctttttctttctttctttctttttgagacggattcttgtggattggtgtgatctcagcccactgcaacctccgcctcccaggttcaagcaatttttatcctcagcctcgcaaatagctgtgattacaggtgcccgccaccgcgcccggctaatttttgtatttttagtagagacgggtttcaccatcttggccaggctggtctagatctcctgaccttgtgatccacctgcctcagccttccaaagtgctgggattagaggtgtgagccgccgcgcccggccgtgacctctttttcattggtagtagtctcatacacatgattgttgaatgaatgaggagactcccatcccatgtactactcttcctattctaccaggatattactagaaataaagaatcttgtggtcagctctgacttagattttctttttgaaaggcctagtcatcccactaggaacttatacttagttcaaacccagctttccaaatagaaaccctgtgcttgatgttaaatactgacctttttgttgtctccgataagtgcatagtggttcattttgaggttgtctggttaacagaagaaatatgtatattgtatattccttgtcaaaattcctaatattccaccaaagctctagcacttccatccagaaagtgttctgaggagttgaaggctctttcttattttgatttattcagtttcatttgcttcataattatgaagactgtccaggcctacaaatggctgcattggcaatgaaaggctgtcagttgaagctcagaatgttaataatttatcctctcattcactatccatgattcatcactgcaatattttcatattatattcttagggtacaacctacaagctaggggaaaacattagcaattttagattgcaaatgatagaacctttccatgaaaatgtcaactttttgcctagttatattcatggttgcaaatggggctagtgtggttaatcaaattgtttcatataaaacaatttctcctgaaggcaatgttagtggtggatttcacaaaatcacagaattcaccttgggagaactttgtggctgaataaaacttctgtcacatctctgtctggggagtgaaggtagggcaattttatctagaatctgtactacacctaataggttcagtgtttggcaggagatatactgataatcattattcccccaccccaccttcaaaaaaacctataaattgggctacatgtcaagtgcctaaatgttctgctgggaaataacctgagtaataggatcttaattaagaactgatggataatttttgtggagatgctaccccctgccaaaatctgcatgcagaattttatatgtaaacacacattttcttgggagaccattcatagcattcatctgattctgaaaggtattgatgatgattttaaaggttatgatatacccttttaaatgcccaattaccagttactgttctccccaagaagccactcaggcatctcagctaagttttatttactgtattttcctaatagttcatgcacgtgtgatagggaggacaggtggttggtcacctagtctagtggggctataacttgggagggcagcatggatgactttgagaatccaaagaaccctatggactgtctacccagaaaacgtttacatccacaaaatttgaatgacatttgaggacactcatgaacagccccctcctgaagttggtccatgaactctttgttaaggactgctggatgatttcctttaagaacacagaaccattatgctgtgaagaaggaaaacaaggatgatgtgtgtctacccgcttggttggtgggtttcctctttcagattggagggtttcttttttcatgaatgtgtaggaaggaagggcatgactgtcttatttcatatatttttcttttatattttcaaattataaattttgacaacaggagacaataggtaatattcattctctactgtctggacagcatggaaatactacgtacagtaatgtcttcagtagttactttctctttagaaagctccaaggaagctcacaacagtaggaagtcctactgaaactccttttggtaaagtggagcacgttttgtaatggaaacacattttctatggcttaatttttatatatagggttttcataaaatgagacttgcctaaagattcttttggaagccttttgcctcttttaacagcaatgtgtgtattataggaatcagtctcctgctcacttataaaatattctaaatattcacttataaatattctaaatatttataagattatgagttttgtcttttaagtagggagttctgcatattgtttttggccaaaatgtagcctgcctccttgagcatgagttgaagcccaagatgagaagcccttttttttcccctctgaccaagatctcatctgccatttactagattaggctacttgaagggaaggaaatgagggcccccttcttttaatccaggacattgttaggtatatcataggtgctccgtaggtatgttggatgaatggatggatgattagaccttaaatcttgtacttggcagcaacataatgtagtggtaagggactaaaagtctggcagacatagactagcactctggatccccaatctctagctttatgcccttcggcaagttgtagagtatcagttttctcatctgtaaaatgggtataataaatctatctgatagggatactgtaggatttaataacatatagaatcccaggtgcttatggacatttttctggtgccataaagcacttgatacatggtagcattattaaactcttaagccttaaatcaggatatcctagactttagtcatttataaagcaactttatagttcttgccataccaataacactgttttattatttacttaatttttctttaaattaattgctttttaatttaaagaactttaagtaggaaattttatatcatcactgtaaatggaaaacctgtatcacttgctataattaatggtgaaggtaaatatataatccttaaaataaaaaatatgtttatccatgtaccacctaacattgacttgggtaccgctagtgtataccacagttaagtcatttcctttgaggcttttctcttgggcaacagcctaacctaggttattgatagctttgagaccttctgagaccatgcaagcctcgtgtcaacaacaagctagaaagggttggaaccggttgcgctgaattaatctataggctcagaagtgtaactgccacacagatgtgaagtctgaaaataacccaccgtgcacctgcccttttcgcgtgtcagttacagtgttaactgagcaccagaggatgaaatgctgtaggaacagtaaaggcatgaatcttaccttccagatgctcagactcttatcagtggtttgatacctagccccttgattgggcttggggacctcagtgtctcaattctgggcaatttctttctttctttctttcttttttttctgagatggagtttcactcttgttgctcaagctggagtgcaatggtgcaatctcggctcactgcaacctctgcctccccggttcaagtgattctcctgcctcagcctcccaagtagctgggattacaggcactcaccaccacacctgaataattttttgtatttttagtagaaacagggtttcaccgtgttagccaggctggtgtcaaactcctgacctcaggtgatccgccagcctaggcctcccaaagtgctgggattacaggcgtgagccatcgcacccggccttctcggcaatttctgaatacagatcttagcagggtgagggaaacggtaattgttattactaccaactggccccaaacagttattgcataacgttgcacaactgagtcctgggtaaaatgagcttcttcagaaattgcctcgccaaaggtgatttgccaaggttgaatccttcggattgtctgcattggaacaacccccttgcccaagcactgagcttaagctagataaaaggaaataaacactgctttaaaagggagtgcactttagcagcacacaaaaaacaaaggtgaaggctcacatctgtgttgcattgcataattgataaaagctgaagcaccattagaaacagcctcatcatccatactcctctcctaatcatttaaatatgtacagcatgttttaggatgcttgttaatgactctacgggcacgttggtagtcagaacattacatgtgggtttgagaaataggcctggatcatttgccagacaatctaattctgacagtgtagtgaaggccatcttcaatttgactgtgctccactctgttatgctgtgaaagaaaaagataattcagctgagcattctgccgttggctagaaacacccgcagttctgaatacaaatattatgcaggtaaatgaatcattaaaagaatagaggcataaaatatctgacagatgaactcctaaagtttggactagaataaattttcccatatatgagcagtaccttcatccatcgactaacagtgttagttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttaatgttagtagaaacttaagaaatatttagagccgtgttcgcagccctacagttgttttttttcttttttctgggagtgtgtgattggtgttttgtcaaaatgtgcaactctaccaatggactcaactcaactaatgtaaattagggccaatgagagtgtccgactgagattagtcctcaatttgtatgacatgtgtctcaacaaatagaaaatattcttaaagaaaaataagatattcccgcatgtctctcttttttagttccctaatttctgattcctttcttctgaatgagttttctgtaagttaaaaaagacaacagtgaaaggccctgttcctctcagcttcttaaccccagtttgcctggtttatctcctgttttagattctaaaaaggaaaacattaatcatgcttagccctggactttgtttccctacctgttacctcctggtctaatggcagagatactgaaaggggcacagacccacaccagccaactgacctagctcatagccacaggaagagcggcatgtccctggggcagtgagagcgagactgcacccagaaccactgtctcatgacaccaccccacatctcaattgaagatccagatggacagctgacctatatgtctctccccgactggaccagctcggcagagcatcctagatttgagtaaagagcaacacaattctttgtaaagccattggccccacagaaagctccatggaaaatgatacatgcgggtgttagtgggaggttgagaactgcttggtgcattcttgatttctgtgcctgtgtcctgatttcaggagacttcggtcatctttgattactgtcattactctagccccttctgtgtgcagttactatagttgtatctagtgtgttcaaggcaccggggaagaaatgacctgtgcccccagtgtacctacagccttggcatcattagcaactctcagttaaaggagcttaacacagagacagatgtgcctggtgtgaaaaacattgccaggatctgccccagagtgattttatttttgcaggtttctgtggtcctcaaatcccttttagatttgcacctttcttgattttgaagtctggggtcaaatatagagatcaacttgctggataatcagatgtagtggggagagaatcaacacattagcaactgtagggaataggcaggcatcagtctaaatggacacaaacctcagggccacgatagcagccagggacctcttgtgtgtgtcaggagttaacccttcagtgtctggactatagggtgtccaggaactcccaagggaagaccagagatagggaggaagagtcagggagcactagggagaggagatggggcagcagctatttattaacctgcagggacgtctctcagtattttaaactgatgaggccattctagtgcgttctagcccttgctgcagtcctggtgtcagtgtgttaacccaggggcaggaatctgtctagtttctgtttgtagcttactgaaatcccaccctataatgcttaactgaatagtgctcttcaaaatgcaccaactaaaaatagtttcatctgcagtgtgaacatagtttcatatttatactagcatctggcctaaggaattgaatactccattctttaaatagcttcactccagctctggaatactctgagaagaaaatctcccccagtcaaacaccttgtttacataggcatgcttaaatgcaaacaagctccctttttaaaatgcagaagaatattaatttgtgaggcaatggtgctttggggtagttttttggtgagtgaaagtaaaggggttaagtagagaatgaattttttaaatgtctacttagtaaaagatttctgagatgcctattatgttttaaatttttcattttcctaaatttgattcaagaacacattaattgtacgtgtgaattcggaattccttctttaccatcacatgtgaagccagttagaatgaagttcttgggaagaaaaatttatgctgccgctaatgcccaacaataatagaaatataagcctagatatactttaactttttctaccagcaaatgctttggggccggaaatcatttgccagcatgcaatgaatgtacttttgttagtcttagggggatactaatggttagtccccatgaagaaaaatgtgaaaataacacacaaaaaggtaaacattgcgaatggatggctaatgattagctgttacagtccaaaggggcagggtattttttttatagttttatgacccttggcccagcctttattgaaagaacattgtatgttcagagttatatatttcaaacgtacatctcctttgaatatccctctttaaagataataggaaatttttccatgttcatttttatttgtagagagaggaggattttaaatgtatactagttttaactctgtattaaagaggaggaacggttatttttaaacatcccattcatgaacccacagagtaagatataataatatacctttaccctccacccaccccagccatcctgaaaatgagtgaatgtagggcagtatgattactctgtcatgtagatgagttagtattcggtacattactaccacagtatagttatgatatgtccctctctgaagtgaatggtttttgtgcatatacgtcaattcaggaaaaaaatttttttctatttaaaataaaaatggcttttttgagttcccaagcgttctatttttacaacttgcaagaactactttagtaaataaaagaatgtcagtagaacactggccactaaaatgttaacatatgggtatatttgaggagtagtaacataaaggcaacttttcagtcattgatgttaaaattagatttgaggccataatctcaaagaggtaggccaggggttgtttttcatggtctacgaaaataaatgctttggttgaactaaagttatgtgcattatctgggaaacaatgaaatgtcttaatttagacatcactttcatttttcaccagtgggacttttctagatgaaaatctaatcctgttctaaatcatccttttaaaatgtttttccccattacaaatgtaatatgtttgtgttgcagaaagtaaagatatgcaaaaagaagagataaaaatcagccatagtcccactatgcaaaggcttaccactgttaatggtttaattccaatttactatattttctttttactaagatgtcactggttgtatacaatgcatcattgatttcacaacagcttttggggaacaggaaaccatttcatcctaaatatatgcatgattttaagatatatactgatttcagaaagttaaaaagtggtgaggagaggcagggagcacgttttaaaattagtttttaaaagccagctctggccctcctcccccaagaagtcatctttctccctgtgtttccagctcacagtgaatgctctccctagtccaagactcctagaattgtaaggaattgcaaaaattcaatctaattttatttgcatccatcacagtaattttcccatcgttctctcagtgatattgagattacttgccttacacaactgtagattttttttttcacatgctctgaattttagaaaattctttgtttttacatggaccaaataccctggctttaccacattttcccgttgagactagttcccttaaggcaccccataagatgagggtataaactcttatcccacatgaaagtccttcagatactttaaaagcagtaatctgttgctttcaagagctcctgaaatcttcctggttcttctgacatctcctaatttctaggtgaaacatccctggtgctttcaacctggagtattccttaaagtgcacctttgtcatgtgcttcagttaatcaatgcccatttaaaaatactgcctgcagaccatatatgttgtgtaaccaatgtggcatattataagatctataacattttttatcctggacctatatttccatgaattctgcccgcattttattatttctcactagcagtactctgtatattggctcgtatagaaataatggttagctcagaaaaccgggcctttttttcccccagaacgtatgtaagattgcattttccgttactagatttagcattaatactatctttaggccattttttagccctttaagagcattttgctcttcactcacatacatttggattatatcttccaatggtgtcatctgcaagtttgagaaggcttctataactttactcaagcagctgattaaaacaagcaaacaccaaacaaatatgaaccactcttatttggatgttaccatatttctactttaagatatatcttcctaacttgactccaacctagtgtcttacaggaagaagcttatcttaccggtcaatatttgtattatccagagctcttagttcaaagtaaatttttaattgatccattggccgttagtgaatcatatatctaccttacttatcttcagccaccaccacaattctttgtgtgtgaacacaggggaaatatgtggtatgagacaacacatcgaacctggctggcgatggtttgttcacacagtgtcatgcaccctacagcaaaaaagttcttttcttgcatccatatgctttgttgtagaatgacaagtggagctggttgatggctaaatgtgcatctttcagctagatgatttgtactgtgtagacaaactgcccaaacattcaatttttccctttccaagcagatgttttgctagaatgtagacacagcctccaaaaatacctttctggcctgtgaatgttaatgtctctcttatgtgtgtgccatttacaacagaaaatataatgctggcattttatttcaacagaatgttggaagtacagatcgatgttgtaaaggtaagttgtccaggcccatggaacagttcatataaccttttggtttggaaatgcttgtcgcattcttgtagataaccatctatttgtacattcttatttttcttggtttattcagtaaacacgtaagggcctattatgcccaggctccattaagccttggatttttagaaaaattattgaaaatgcgcattttcttattgtacggcaagtgggtgggggtggctcatttcatgaaaattacctaagtaagaatttataggtctataaacacacctaatctagtgtgccacaataataatacatttaacatggcaagtcagcacacacacacatatttatacacacacacacacacacacacacacaaaacacagtttcaccaggcagtacttaccccttaccgacaatgccctctgacattttcttttctattatatcctatttcatttttttaaaaacccacccgattggttttataatcctattaatgggctacaaacctacagtttagaaaatactaacatacacataatcgtttttgcctgatgtctctttctggttaagcacactatttccaaacttaactaagtgtttatggatccaaattcggctaattgatacttaggttcttccaaccctgtaacaatccctgcagaatttgcatttcttttccaaagtctaaaaatgaaccctttcaaggtatcctatttctaaggcaccattactggtacagttccgtgctctttttggtaatctaatatattgtcatatgttactaaactacccatgtctaaaacagaagaaccccacagcacaagtccatttatgatacagtgcccttgatttttcaaaatatgtggataggtttgctgttcttctcatatacagtgtgttttaggaatccatcttttaggcattgtctgaatcagcgtattactccttgatagagaaagagtgataattcctgctttttgcccaggacctaagagaaactgctttcaacaatcccaaagacaaagaaaagcttctatttataggctccatatggtttctaaagttttaaccaaagtgaatagaacaataataaattgctttcacatttctgcccatagaattgtttatttagcattttctgtaaaacaagaggccttccatccacatgaaaagactgtattttgattgcctgggagattcaaaatgatttctaatcttgccacaactgtcttctgctgtataaatgaaatgtttcattttcaaagagactgtcaggatattctgaaaagagttccttagctgctctgcaataccctcccccccaaataaagtgctttgttttgtattttccaagagaacaatggcattacttctcatattggaagatacgattttcagcaagtcctaaaatgcttatttgctagcagtttgtttcatcaggttcctcataggaatatcttatttaattcacttacaaccaaaaattcccagttttgtgaggtggtcaaacaggatagtagccttctgcatatggaaaaggaattgaacctataatatgcattatgcacactgttatccttttttttttcagagtcatggtaataagtgtctacaacaaaattcccttccttcattgaaatagacaggtctttgctcgacagctggacagaccataccagccataccaagggacctggcattttgtgaaggtgctgaggaggactgagttgagtttaccaaatcagccttcttgacccttcggcttagcattttcaagtcattgacattctcttatacctgtgccgctgatctctagacctgccatgagtgtgaaagaggcttcgttttttagtgacactttacccaaccaattttcactcaagaatcttcatattctattgtctcacaatcagaataaattggcattttcctcactcagtctactaggtgctttaattgtgtttagaaatagccttttgattcttttggatttgttttttgccctaagagtcttgatttccgtactaaattacctgacaaaactcactctctccaacatcaattaaagggatttaaaaaatataattacacttaaaacactagaaagagtcaagtttttagcatatgttatggcttgccagtacgagaaaagtgacttaacatccaaataaagaaaaatagttagccaatccattcattatgttgatatgatcaggtctccaagatgcatttaatcaatatattctgccttgattagccatattgaaatacttgaaaacataacctacaatatgaaaatcagacatacttataaatgccaatagcttttatttagagtcaacaagtgatgaaaaagctcttacttaaataaattgactttgagaacaagaatgcgaacagaaacataattcgttcattgtataattgtttttccctgctgtggacattagcctttggcatatggtctttgaccataatctatgggtagatatagccagggcactggaggaacacgaaggtgaattccagttgggtaacactggagaattccagttaaaacaaggttgactaaaatctaaaatacactgtaacatagacaaaagaattcttattgtagattaaatgtatgtagaagatatagaaggattattgtgtctgtttcagatgtaatttcatgcctgagaatttacattgaaggaaaaatggtctggatcccattagcgaaggccctgttttgctgtcagtttaattaaatggaaactgctggcaagagcgccgaggaggttgatagaagcaatgctattttgtatgttggaacaggaaactgttaggtcttccagtttgaaaaggatacaaaaatgaaacctgtgattcatttttgtttacaaactccttcctagtttacaatgaccttagtgataaattaactaaaataagttatacatagtgagcaggacaatagcttgatcccaagatatgaaatactaatctctgatgaagaaggtagaacttatttttatgtgactttccccctaaacaatggattcctcaacaaaagtaattgtttcctttggtttatttttctgtaagtagattgagaaaaggaggaggggtattagtttgcttttaaagtgtgtgtgtgtgtgtgtgtgtgtgtatgtgtgtataaaacaaaagaaagagaataaaaaagaaagaaaagggaaaaagagtaaaatagagaccctgaaacagtgatttatctgttaagtgtatttggcatcctgccttttggctggaatttttgagagaaacatatttggtttactttaatgggcaaaagctctgaacctcatttgtaggaaaaaaagtgcatgttttcttttccctttttcagttcagtttattatatcttgacattctgtcttgtaattgaatagtaattctggatttagagtggagaagaaagaaatttaagtcagtcctcctcccctccttatgtttcagagaaaaggactagctgatcccaaagttttaacttttttcacagccaccctttgaactggcaccaaaaaaatgattgtttaattttgctgaaactctgtagctgtctttgttccttgactatgctgagggttgttgatatgtttgtgtctattctaataatgcaaagtcagtatgtgttatccgatggaaattttcgatctcagttaaggaaacagattggcagtgaaagtactctattagatattgccatggtggatacatgacattttgcatttggcgaagcctgtagaactgcacaatacagaaaatgaaccttcatgtaaactgtagtcattattataataatgcatcaatattgtttcgccagttttaacaaaggtaccacactaatatattaaatttttaaatgttttgtgtgaagatactagcaggaaaaaaagatgtcagtggcatgtaaacctaaattgaattttttcctaacttggtgcagctattttatcattatttttaattgaatatatattggattgtcatcttcttgctcgttgtgttgagggggatttatcagagttacaaaaacatgaaagtttggtatatttatttcaaaaaggcatgagcaagtatttgagccatccaacgctgaagaacttatatgaggttattttctttctctatgtccacgtttttcataatctcttttaattgtgcttattttgttataataaaaacaatccatgtttatcataagacaatacaaagaaacagaaagaaaaaaattatccagaataccaccatactgagataactagtgttgatatttgcctgttattctatattttttatctgcttatatgttggatattaatttttaacattatactgtatctctagtcttatatcatgcttttttttttttttttttgagacagagtttcgctcttgtaatccaggctggagtgcagtggtgccatctcagctcactgcaacctccgcctcccaggttcaagggattctcctgcctcagcctcctgagtagctgggattgcaggtgcccaccaccacatccggctaattttttgtatttttagtagagatggggtttcaccatgttggccaggctggtctcaaactcctgacctcaggtgatccacctgcctcggcctcccaaagtgctgggattacagccatgagccaccactcccggcctgtatcatgctttcaaaaacacttaatatgctctttcacacagtaaatattcatctgtagcatcatttttagtgatgaactccactgtattctattatggaagtgccatagcttatctgactatccccctattgctggactttgggttttttcctccagcttttgtatataataaacagtgctctcagagacatccctgaagtcatattattatttctttaggataaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgcacaatgtgcaggtttgttacatatgtatacatgtgccatgttggtgtgctgcacccattaactcatcatttacattaggtgtatctcctaatgctatccctctcccctcccctcaccccacaacaggccccggtgtgtcatgttccacttcctgtgtccaagtgttctcattgttcaattcccacctatgagtgagaacatgcggtgtttggtttttgtccttgcaatagtttgctgagaatggtggtttccaacttcatctatgtccctacaaagacatgaactcatccttttttatggctgcatagtattccatggtgtatatgtgccaccttttctttatccagtctatcattgatggacatttgggttggttccaagtctttgctattgtgaatagtgctgcaataaacatacgtgtgtatgtgtctttacagcagcatgatttataatcctttgggtatgtacccagtaatgggatggctgggtcaaatggtatttctagttctagattcttgaggaatcaccacactgtcttctacaatggttgagctagtttacagtcccaccaacagtgtaaaagtgtttctatttctccacatcctctccagcacctgttgtttcctgactttttaatgattgccattctaactggtgtgagatggtatctcattgtggttttgatttgcatttctctgatggccagtgatgctgagcattttttcatgtgtctgttggctgtacaaatgtcttcttttgagaagtgtctgttcatatcctttgcccactttttgatggggttgtttgtttttttccttgtaaatttgtttgagttctttgtagattctggatattagccctttgtcagatgagtaggttgcaaaaattctctcccattctgtaggttgcctgttcactctgatggtagtttcttttgctgtgcagaaactctttagtttaattagatcgcatttgtcaatttaggcttttgttgccattgcttttggtgttttagacatgaagtccttgcccatgcctgtgtcctgaatggtattgcctaggttttcttctagggtttttatggttttaggtctaacatgtaagtctttaatccatcttgaattaatttttgtataagctgtaaggaagggatccagtttcagctttctacatatggctggccagttttcccagcaccatttattaaatagggaatcctttccccattccttgtttttgtcaggtttgtcaaagatcagatggttgtagatgtgtggtattatttctgagggctctgttcggttccattggtctatatctctgttttggtaccagtaccatgctgttttggttactgtagccttgtagtatagtttgaagtcaggtagcgtgatgcctccagctttgttcttttggctttgaattgacttggccatgcaggctcttttttggttccatgtgaactttaaagtagttttttccaattctgtgaagaaggtcattggtagcttgatgagaatggcattgaatctataaattaccttgggcagtatggccattttcacgatattgattcttcctacccatgagcatggaatgttcttccatttgtttgtgtcctcttttatttcgttgagcagtggcttgtagttctccttgaagaggtccttcacatcccttgtaagttgtattcctaggtattttattctctttgaagcaattgtgaatgggagttcactcatgatttggctctctgtttgtctgttattggtatataagaatgcttgtgatttttgcacattgattttgtatcctgagacttcgctgaagttgcttatcagcttaaggggattttgggctgagacgatggggttttctaaatatacaatcatgtcatctgcaaacggggacaatttgacttcctcttttcctaactgaaaaccctttatttctttctcctgcctgattgccctggccagaacttccaacactatgttgaataggagtggtgagagagggcatccctgtcttgtgccagttttcaaaaggaatgcttccagtttttgtccgttcagtatgatattggctgtgggtttgtcataaatatctcttattattttgagatacctgtgggacagaaacttccaaaggtactgagtgtgagatgcagccagccacgacacagagctcatcgggagaattccacgggagacccgagtacacatggcctgccagtgggaggtgctgcacccaaacctctgcagcactggacagtgatgcatttttgcaagccatctgagttcctcaaagtcctttcttaggtcctacattagtgagtttcctctgggagaggaagcaacttttggcattgtggaacagttatttaaatacttgtggcaaagaagaaaagtctaatattagagcaggaacagagactttagacatcatggaatccaatcttgtttttgttttttaaattccgtgttcctggtgagccatgtagatcgtaggaaggatttcacagagtcgatgggagaactggaggagggcttggtttacatccacactccatgcaaacactaacgtcatcactcccagccaacacttctccccatgactcttcaactggttcccaattggaggtcttttctccaggcgtctcccacgtggaggccccttttgcagaacaccactgccaggaccactgcccttccaaatgtccttccccagctccaagtccttagcaaaccaggggtctaccctctatccaggtctggcacaaacagtagccacagcaaccacagtgattagggcccatagtacttttaaggacccacaaaaatgcctttagtccttttaaaacgagaagaaaacacgatgacctcttcagtcgaaaaatatgttttaggccgagcgtggtggctcacgcctgtaatcccagcactttgggaggccaaggtaggcgtatcacctgaggtcaggagttcgagatcagcctggctaacatggtgaaaccccgtttctactgaaaatacaaaaaattagccaagcgtggtggcacatgcctgtaatcccagttactcaggaggctgaggcaggagaatcacttgaacccgggaggcaggggttgccgtgagccaggatcatgccattgcattccagcatgggcaacaagagcgagactctgtctcaaaaaaataaaacagaaaaatatgttttaatacattatttatatatttatctgtgtaccaatgtagtcctaaaatgtgacttttaatcttttcctatggaggaaggggctcaggagggcaaagtgcctagaggctaatggaagccacaggcagtgctgtctttacctggtcacagtctccctagaagacagtgactctgtcattttacagagccagagaatgaagcccttctttgcccatggttacaaatccagtgcctgtttcatatttctcctccttatgctgcctcttcataaggcatcgccttgatttcttcttaaaacgatttattctggggctgatttttcccaaccttaatgtaattgtactttaatcaataaaaaatttcctgtggaacaactgggaggggtggggaggagagaagcccagcaaatgtgaattgttgtttatttgtctctcttaaacaatgtttcacgttaaaccagttgcaaatgaaatgaattgtattataaccatcttggaaaaatagctgctgatctcataaattcatcgagcttcctggttccaaagccctctcttacaataatagtaagtgttgctgtgctcagtaaatatctgcctccacttggctggtagtgaaggaactagaatggcaaacccaagatgggccccccttctgcctcctccaaaatcacaggttttgtgctgaccctgaacaggaatggagaggaacatggcttcccaggacagtgactactgtcctgtctcctaggatgccagtatcccaaatatcatcactcacccagtaggttgctcctctgggcacctccactgccttgcgtctgttctcagtgctgcttccgtggcatctgcctttgtgtcatcggttcatctgggcacaggcctctctcagaacttataagcagtggctatgactgtgggctttggaatcagacagacctgggttccagagtcaccttgaacaggttgcttaatctctctaagcctcaatttcctcatctataaaatggaagcagtaaacttatccctcataggattgctacagtgatgaaatacacatcaagggcttagcgcttgcctgtctgtagtgcatgttcaatcaaaggcagctgtattctagcaggacagtgcaataactgaacactcttggtgggtagcctgagttttgttttgtttgtttgtttggagacagagtcttgctctgtcacccaggctggagtgcagtggcgcactttccactcaccgcaatctctgcctcccgggttcaagcgattctcctgcctcaccctcccaagtagctgggattacaggagcataccaccacacccaattaatttttatatttttaatagagacagggttttgctatgttggccaggctggtctcaaactcctgacctcaagtgatccacccgactcagcctcccaaagtgctgggattataggcatgagtcaccatgcctggcctgaggtttttatcttttttttccctgtagtttggcattaaatgtcataatgactgtggtgttaataaacatcaggaagtgtgcttggcagtttgcaaactggaccttatcttacctgttcaggtgtgtgagatcttctcagagatggaacaagttcctcaagtttatgatctcaaaacccacaatgtctgttcctcaatgcaggtctcttaacacctgtctgttacattatgttggtcatccaaggatgcattaagcagaaaagaaacacctcacctaggtgttactaaattccattatcctcctgtcagacgtccatggtgggagagactttggtccccaccaacctgggtttctgcagggtttcactacctgcctttttatagagtcttgtataagacaaatggcattttaagctgtttttctttttgcaggtttggaaatcttatttaaatcaatgtaatgagacactttgaacaaaatgtaatcattctcacttctccacgtgttggaagaagcagtatagagttggagacttggggttagattagagctggctgtcttcacagatttgcatccttgccgtgtgctctgagttgtcacagtgtatcagataggtgggatgtttttgcctctgtgctaagtaaattacattctagaagaattaagagggctgttatttcatggtgattttttaaaaaaagtcagacaccccagaaccgagctagaattgttggaccagttttcttcccttttcttcttggcctccttcttgtcaagaacaactgttctccagttttcaagaaggctctgttgaagtggaaacataagcctccattaaagtataagggtttgcgaggaggtcaagggagtcattactttgtcttttacaacaaggatgtatttatatattctgagttaaaaaaaatgcttttaaagaaggtgtgagcaaagataaaaattatttcttacagctaaagaaaagtagtctcttcatcgttatccatgagggaataactcattgacacttataaaagagcgtcctagcccaagatatcatgtggtgggaaatttgattggaagaatctcttccactaacttgtgcatgagaatatttgttccagctccaaagccttagaagctgttagagaaaggtgggagggtatttggctggccttgggaaatggtaacctaacactggaagccccttgcttttgttctccttattgtacataagaagatgagattttatttccagatttcaaaacacggaccaacttgcaataagaaataaacccccgccaaggtgatgaattatgttgctttttaatttagaaactggccctccgatcagaaagagtaaggatgactttaaataaccagattgatttgcaggttggggcaaagtagagggatctggtggatctcagagactctttcttggctgcctagaacctcatattgaggctccttcagaggctgcttgtgtgagcctctgactaaatccttaaaataactgctgttggaagtcctgtaagtttcaaaatttgttactggagcaaggaaagggtgtgttgggtgtctcactcggcttgaagtaaggacctgaaagcttagcagccaataaaaagagaattaggggaagatgaatattaattttaggaaatacaaacctcagttttctcatccaagcccttcctttcctcctcctcccatttagaattgaagaattgcaatggctttgacttaaaaggataagaaagagtagtgattttcttaaatcggaggagacaaacatggaatttttataaaatgtaatatttgctggtatttaagtatactttggtggtatcttggctggcgttcagagactgttgaaatcatcttgattgtgaaaagtcgctaaatggagctgttaaattgtgcttcgcaaattacatttagctgcaaagtattggttcagtctaggcctcctgaatgataacacctattatatagatgttctctgtccacatcccacctgaggaaaaaaaaatcacatcaggtttgaagttcagttgaggcaaattttatattagtaatatcgttcattattgagagagatctcggctgctgacctgcgtatgaagcacttgccccatggaagttgtggcaagccaagtgccagaaaaaaaaaaaatgaaaaaggaaatatttaaatggtagactatgtacttgatgtatccatttttcttctgcatgaacccagtcataatccaaattatattttttaaacccccttttgttctttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgccccttttgttcttactgttgtaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgacgcgccccatgcaccccgggtgactaagcgcggtaattgcggtttttgcaatcctgtttaatgacaaaaaccgcaattactttttgcaccaacttaatacatctgttcacatgcccaccaccttttctaggctatacacccctctttaaagagggatggtggcttttggtctttatcctcttgccacctgctacttcttaatccacagaaggtattcccttggtgtctgaccagccaatagatggaagaccattttgatgttaaatcctttttttttaaccacatattatgttaatccatttatatgaaatgtccagaataggcaagtctatacagacagaaagtagatgagtagttgccagggtgttaatgggtatgaggtttccttttggggtgatgaaaatgttctaaattgattggagtgatggttgcattgtgagtgtcctaaaaaacattaaattacatatatgtaatcgtatcatttttaatcttatctttttgaggatacaatgggtgcaattgtgtgagctacgtgtgtatgatgagaatcaggtggttgtggatctttgtcccgggatcaaaagaggagaagtaatagagagaaataataataccattgtcttcacttaggctgaaatgtgctttctaaggggttaaaagtaaagaattgtgctggcgaggtgtgttctgtgcaatggtcatctgtttttgagattatcttccaaataaggcaacaccaagcttcacttagggattgttttgaacacaagactggaagagattctttaatactgcaatctgaaaccagaaatttgcgtctcataaaaatcacgagaattctcaaagccaccagcccactggagggtctctgagaggtacctgggaataccatgaatctgacagggctcttctcagaggttcagagtcaagcagaaggcagctggggtgtgttgagaacagtgtgagatttaaaatagtgccaggcaacttgcccctgccattagctggatgaccttgggcaagtcattcacctcattgagctgcctgtgtcctcctgtataaaatgggactattcttgacagaccctaagagagattctaggaggattgaatgaatctaagcacatgaaagggctttataaatttgggagtgttatacagatgagtgattataccatgcataataaactatttgtaattatacagtgttaagctggctgtgtgtgctgagaaggagagctgaagggagcagggcaattgctgtaatcaacattcgggtgtgttatgtccccaaaatgtgatcagggaaacactaacttgttgaggtgagccatgaatgacaaaaaagtgggggagggtgaggaagcggatgggagaggatttcatggtaaaataaagtcagaaaaagcagcatcttcccccctgtgcattaaaatgtccattagcatgttaaaggctccaagctgtttgtgtaactttttgttaaactcagtgtttcccgtgctgtggtgccccttttccacataacccttggtaacatactcccttctttctcaaggaactagtgttccttggcatactttggaaaacagcttgcaaagcaataatcagacaagtacctacggggcgttcactgtgtgctacattagcctgactactttgcatcttttaactactgttaaagaccccccaggaagtcactgttcttaagtccattttacagtttgggaacccaaggcttaacaaaaggaaccaaaggaagactatagagatggggttagggtgaaaagaaccatgaagacatctgggcactagtaagaagcaagaggaagacatagtgctacctggtgaaagctgccgtcagggtggagctgtggccttggccagagctgccaggccaaagcagagatggggcagagaagaaatatgacaacttctcactctttcccacatgcgatctgttaggtgtctcccattggctgaacaagcagaagccagccagcccatgagggagcccaatgatacaacattcaggggtcacagagcaaggaagaaagaatgggtaatagatccgggagtaggatgagaacagagggacagtgaataaccagaaaaagaaccaacattaattaaaaatctatcatgtgcttcgcttgtttccagggtgttaggaattcagacatgctacagacctagctcctgcccttcaaagaacccatattctggaaaggagagtccagcttgaacaagtaaatgcagccaagtgttacagagtaactgtatcttagaaattaagctgatattcgtgatccaaaatagcagatttctggcagcaagactatattctctagatcaagggtcagcagagccagatagtaaatattttagatttgtgcaccataaggtctctgaggcaaatgcaccactctataatcacacaactgtgccgtcgtagtgtaaaagcagccaaagacaatatgtaaatgaatgtgcatgactatgttgtaataaaactttatttacaaaaacaggtgttgggctgaatttggcccatagtttgccaaccctttcaaacagaaataaccttaaagaaatatctgagagatacccagaaacagggatctgtagcactggtaactcatggtatgaaaccacagaactatcactggaattaatatagtagtcacgagcaatttgtttattgtcttttatgagaaaagagaggtaggtttggatgttagagattggggaaaaggggatatttgctgtggaaatgattttcagcagatggtaggtactttgggaaaggtgactaaactagagccatcctcctcctgtcttacatcagcttactcagtactaaccctgtacaaaaaggaagtaaaacagagcacatctgtatcatcagctttcaatgatgttcttccatggtgcactgtgacagcacattagaaggtgccggagtttttatatgactgctttgccgtgagattaaatagtggtttcagtttccagtaggtttcataagtatctctttcagctgttaaattacttttagtaatgtgcacactagaaaaagaaagaaagaaatatccattctgaacaactgggtgtcatgacagaaaacagagcagatggttttgtggacatggcaccaagtgaacctgtagctggttacagcagaaggatatgtttaacccagaggagagggctctcaccaggtcttaacagttgaagcttttaagagattattattttactttgaattgatttttgttattcaccagaaaccaaaggtggcaagcgagaatctctactaaaataactatacttgctaactttgggtctttgttggggctttggggtatcagaacaatgaaataacaggcactgtgaggcttttcctcctgttctgttctcctctcctagctatatttcagaacatcttatctcaagatagttggccaaaaggaacctgtacacagaacaacctcatttttcccaagtgcctcttcggacccaggacacaatgattttaaaatttcttttcaggcagacgctctaaagagagctatgctgttcaataaggtagccactagccacctgtgacaactaagcccttgcaatgtgtcttgtccacttcaagagatgctataaatgtaaaatacacactatattttgagagcttactatgaaaaaataatgtaaatatgtcactagtaatctttttttttcttttactttttttttttttttttttgagtcttgcactgtcgcccaggctggagtgcaatggtgcaatctcggctcaccgcaacctctgcctcctgggtttaagtgattctcctgcctcagcctcccaagtagctgggactacaggcatgtgccaccatgcctggctaattttttgtatttttagtagagacggggtttcgctgtattagccaggatggtctcgatctcctgatctcaagatccgcccacctcagcctcccaaagtgctgggattacaggcgtgagccaccgtgtgcggccagtaatcacttctattgatcacatgttaaaataatattttggatatactgggttagataaaatagcttactaaagttaatttcacctgttttctgtttacattttcaatgtgttaattacaagttggctcacattgtgtttctattgaataatgctgctctaaaagatttttgaaaaaaataatccatgtattcctttgcccagttttaagtggacatctacatttttaatcatgttttgaataaattttgtgttaataagtaaaaaatgttaaacatgataggaaatgaaataagatggtgattaactataattagaagacatattacatatgatttgataaaaatctgaagtttaaatctgtgtttaataaagcacaacagttctaaaataaattatctaaaatttttatgcataggtttatgcagtttatgtcaaaaaatctggtagccttgccgtgcattccagctacactttaatggatcagcatcgttaacctttattagtttggcttttctgaatttagagcatcataacacaggccaaagtactctatttctaatgctaagcttcctcttgaacagaactatgtgcaaaaagggaaagatcaaaaggctatggcttgaggttccttgatagatcaataaggaagcatctccaaaaccaatactttgatttgactctttagtgctcataataggactagggatggaggatgggtgaagaaggagatgggctgttctgattgctggctcattcttgggcagatgcattagggagtggagtagtatctaagttgaagatctgccccatccctatgtaggttccctttaaaaagtcttctcgtaccctcaaaggagagattcaccattttgaagaccactgatttaagatgagtcactgacagaggcaagaggccttttcccttctttccttgttgagctgccccagaagccctgcggtaaggtgaaggaaaacaatgcaacctataaaagtgctcttgacacagatgttagctcccagaagtcagtgcagttgcagaggtggctcagcacttagagcatggtggacaaactcctcaagtggcgagattattttattttttaaagtcactaaaatgagatgactgcctaaccacatgaccctttgtctaaaaaaggcctgccaggcagtggctacagtcatgttgggcagataaccttctccagattccttcagccttttaggaagtgtcattggttcagagcctgtggtgaactaatgaaatgactgctcttatcctttggaagaaggctcagatgtttactgcaacactgtctgtaggcaattacatttgtcagcactctcaaaggtctaggagggataccaaagaattaggacaccgattctgtgccctccaggatatattctagttgtggattggagagacaccacttttcctccccagagcaaccaagcatgcatctacacagaaaatataacccttcccagatgttcccctctttgtcattgttgtgtaaaatagacataacataaaatttattattttaaccatttttaagtgcacaattcagtggcattaagtacattcacaatattgtgtaactgtcaccactatctatttctagaactttttcaccattcctaacaaaaactttgtatgcattaagcaatagctctccattccttccaaccctcctagaccccctgcacctagcaacttctattctattttctgtctctatgagtcaccctgttttgtgattccacttttaaatacctcgtataagtggaatcacaatatttatcctgtacacacacacacacacacacacacacacacacacaccaaattttgttatctgttcatctattgaggaactattgggttgtttctaccttttggctattttgtgataatgctacaatcaacattggtatgtaaataactgtttttgagtccttgtttttaattctttggagtatatacctaggagtggaattatcacatggcaattctgtatataaatttttaaggaagtcccatactttttcatcatggctgcaccattttacattcccaccaacaatgcacaggggttcctatttctccacatccttgccaacacttgggatttttttcttttcatttttataatagtcatcctactgggtgtgaagtaatatctcactgtggttttgctttacatttccctaatgaagagcattttttaagatgccatttatatatattctttggagaatcatcaaagtcctttgccatttttaaattggtttgtctttttgttactgagttgcaggagttctttatgtattctagttattaatcccttatcaggtatatgctttgcaaatattttccccctctccaagactgtcttttcactttattgatagtgtccattgatgcacaaaagcttttaattttgatgaagtccagttgtctattgtttgttgttttcttatgtgcttttggtattatggttaaaaaatcattgtggaggccaggcacggtggctcacgcctgtaatcccagcactttgggaggctgaggtgggcggatcacctgaagtcgggagttcgagaccagcttaaataccatggagaaaccctgtctctactaaaaatacaaaaaaattagctgggtgtggtggcgcatacctgtaatcccagctactggggaggctgaggtaggagaatcgcttgaacccaggaggtggaggttgcggtgagctgagatcacgctatggcactccagcctgggcaacaatagcgaaactctgtctcaaaaaaaaaaaaagtgaatggctgactctagccaaagtttaacccatgtgacggggaagcaagttaaggtaagtcaggccccatagaataacacctcatatgtggtaacaactttacctacatgtcaatctggccatgaagtctcacctgttgcataatccctgtctagtgtgacatttaaatttaaatgtggctaagatgaaccctatggcaataagctgcaaaattctcaagataaaaagtggctcccggtcgtggcttagaattcagtgaccctttgggacaaccttggaggtggagttggctttcttcccactgcgttcatttgttactcagagtggtagcagtgtttggttatagtttagttttgtgatgttttttttcttgagtgatgaagcaatagtgagggcaaaagctgatagtaacattttgatacatatttttgtatttgtctatgcctctattttaagtggtttgcttttgaaaacagctggttcaaacccttggttttgggtttgaaatattctttgttttgtttgcatccatgtactgatatatttttcccacatttacttttttttaagttctccagtgatgttttcgttgcctatcctgggaagatctgtgtttccatttagcaaaacaaatggcaagctggggaccatttaaagtagtttttttttagttaataaagccaagccaatctccttgttctgttatgttaaaagtacattatctttttattgccagttctgtatggctagttctgttttctgtctcagcaatctcagggctgccccacttgcttactgtgtcgagaattacaaaatcattaagggtggggcagcaccagctgacttacagtacaaaccatttctcaaaataaccacaacagtgcaatactgatgtgtaatttacgtcacagtttgtttttatgaaatagtttgtggcattttcatttctattccggatggaatcttgttctctttcccttttaatcaggcatttaatttatttttattattaatattttccactccttgttttggcatgcctccaatttaacagctttgatgaggaagggagatacacacacacacacacacacacacacacgcacacacaactgatcttccctgactccaactcttcaacatcagtttaactgcaaatgtgttttcccctttgatgtgtactaactttgggtactaagtttactaccttaagagagattgaaaaatacggcaggacacagtacacatttacatagagctataaccacgaattgataaagttgatgtacaactttggaattttaaacactttcaaccaattcaagctatttagtcatatgctctgctgcattttccttttacaaatgtctttctgtataatgtcctgtaattagaacaggaaatcattgagtaactgcaagatgaataagagcacttagactgaaaggaaaattaccttccgagaaattatattctctttttttttcttcatgttacaatgttggtaatgatagtaacagctgtagctactcttatctgtagaattttcatgcttaggttttctggaataaaaatttcattttcagtaataataaaaaatgcatggacagaaaataggaaatgcctaattgtgacaaatattcggtgtcacaacagagcagcaattaaatggaaacttcaatataattgtcaatagcagtaagaattggaatagcgccaggtatataaagttgatgctttgccgttggttggttgctaggagcacagtgaaaagtataaagctttgagaaaagaatgtctaatgtaataaagtaacaggaggaagcataaatcattgtgagaacctcacatattgacattattttgcttaaattgtttcaaaactagacatcaagctttataacgtgagcacattcatatttcctttaaaaaaaaaaggagaaagaaaactgtatgttgtctttgaagcacaagggacattgtgtctcaaacttagccttcatacatatttggaatcttttaagtgaaaatctttaaatgtttgtttctattggcatccaaatgcatttgccctaatacgattaagagaactaaagggcaaaatacttggcagatttttcagttgaggtaattaggtgcaggaaggaacatgcatattttttccactaggctctataaaatcctggggcgaaggtttttttttaaaagattttttttaaaaaacttactgatgttagaagtagattatagtggttttcagtaagcataatagtgtgatgtttccgaaacaagcctcccctcaccccaagaatgaaaaagaaagttacatttctaaattgttgtgtaagagataaaagcaaatttctcctctggaatttatgttttcagcctccgtgcatttggccgccattatctattttcaaaaaatagcattatggatatttgaaagtcaatgctccattaattcattgtgtttgctatttcatgcatctctctttgtacaaagacaacttgagcaacctgctattcagaatgaaggcctgctcttaccctttctccccgactccttccccacccccagcccaactctgaggattaaagcaatggtatacagttactgtttgaaaagcttgggtggagtctcatgttataattacagtttcgctatggaattctgtttcggactttgaaatatataaataagtaaaaaattgacattgagagaggttaacaaaacgtgtaattaagagtcattttggttgagcattacaagcagtgtactttaggtattaacttttaataggcaaagttctttttattgaagttgaaatgaggtttagtaatgttgggtctcttattccctttgaatgtttcattttaaaataggcattcacttttttttggtataggagaaattcaggaatgggatgacattttaatagaatatcataattatggtttaaaatttcagtcttggttactagcaatttattacagatcattttctgttgactgaagtcaagtaacgtatatgtaacccaaccagctacaaccaactagagtgtgttagaagaatactcctaggggtactttgatttctttttctctatgggtgtggttgaaagaaaatctgtgttccaggaacactttgtttgtcttttacaaaacaaatgtgcaatttattcattcttagatttatctgctttccctattatgaattggaagggtgaaaatatcttacacagcatttattggcagcccttgtttcatgggtaactttgcacaggagtgtttacttatgtgtatatgaaatgcgtgggcaagaaagaagtagccgaggaatttaaataattcttgaaaggactatttggctttatttgtttcctggtgtactagggcaaaataaaatatgccgaccattgaacactttagtatttttatagctgtatcagaaggaagttaatttaatgcaaaggcttaggaggcagttttaggatcacagaattttagatctggaaatctctccccaaactcaaaattttatactctgttatacacacctttcatataaagttgaccatattttgtcttgaggaaaaaaaaaaatgttttcaccaataaaataaactgcaaagaagagacctggacccagactgttttactcagtgaaacttcaacctagcttcaaccttggcttttccaggtcccactttgactctgtatctttcccttttacttttcacttagaatgctttgtaaactttcctaggagtcctcaaggtctcgtgggctttctccagtttggtaaatattaaaggcaactcctctggggatgtctaattgcaaggttggaaatctgcctctgtccaaacaatgccaaaattctggtccaaacgggaggttctgttcataagcaacaaagttatcatttgtgttttgccccaccaagcattgccacaatagaccaagccccagctgtgcctgtagcctcttagtgtgtggaaggaggttgatgaaaggtaggggttctaggctggcaacacatagagttgggactatttcctatcacatgcatagaaagtagaaagttaatgtacatgaatgatgtatcaataatgttaaatcattacagtggaaattgcagtgttccaaaataataagtaacaagctaacctaaggagagtagaattctggcttccaactggctgaattctacagtcttacatcaaacagaagtcttatatttgacttgatcaaaggccaccatcctcgtccctaatagtgtaaaccagttaaatctctgttattattattactattattatttgagacattttatcctaatgaaaagtccaccaaactgggagttcaaagattgggttataagtcccagctactcaggaggcagaggtaggaggattgcttgggcccaggagttttgggtccagcctgaagaacagagagaggcccatctcttaaagaaaaaaaaggattgggtggttatagtctcaaattggggaatattaacaactagtaatgccactaataaggttgttgtgaggaacaaaagagacgtgaaaacactatataaaaaacctttgtgaattttagtgttttattatcagtactggaaatagcattaatacttgctttctaaatggggaaacagtctctctgtttctcgtatttttagttaagagggcttttaaaatttgctgtcttctgtgatatctgtaacaatcctgcaaaagtggcagagagaagagattttgcttctttgttctatgtactggggggttaggagagaaataagaattttttaaaagtctgacaactgaaaaaaaaaaatatatatatatatatatttcaaaatccaaactaacaaccttactttaagtcttcgcaaaaaagtaaactcagagttactggtttcaaagtttagtgtgcatgagctatttgggatgcttgttgaaaaggtaaattcctagaccccagccttagagatgctgagtcactggttctcgatggcacagtatctgattctgatgcagacagtcccaggaccactattagcaacactgtctccaggatgcacggacagttgtaggagttgagagtagggggaacttgctgtttttcttccaacagaaagagaaggattcatgacttggctagtgttttgggtactgcgtgatctaaatgttttgaactaggatgaggtggagagaaaaaaaaaagaggtcatttctaggcacagaagattgccagggagccgactccatccagaacagagaattgggaagcagttagagatggcatcatcatgaaaaatggttagagaaaaaaaaaaggagaatgaagggatatgaaggaagtgaagtggtcccaagagtccaggtgacatcttccatgaaacttactctgaagcaactgttcatttatactccttcaacctgagagcacacacatttttctccattttatttcaagaatacttggagaaattgatgcacctttacccctatcatagaaagctaattgcacaaccaagatagaattttagaatcaacaggtatttacaggcacagtatttactatgtatgggagatggtgttaagtgctatgaggggtagtcctggcacttaatggttatatgcctctctctcattaacaatgtcttagacaaatcgagtataatacaaatcgagtgtaataatacaattgacacattgggggctgcttcttgaaatagcacttaaaaactctggagaaacgaccgcatttgaatattttcactaaaactttttgtgctttagctgtataaaaagcacggttttgaacccaaagtttgaacttagcgtcttggtctgctgtaaaaatctcagatgggcatgccttgggacatatatcagcatctcaaaactagtttgcattgggggacttgccttcaaggtaaacatatttccttttaattaagtgtgccagctgacaaagcagctatacacagaccaggcaggagttgaagacgtgtacactgttaaaagatgtcatcttgtaagcagctaaacatctccatccgtggaaaagccgccagcctgaggaactaagtgaacataattagaaatacatctgggtattggcctcctatctgaaaaggtcacatgcacaccttccattggtactggttatgttccatcattatgttccgtccttgctcattcgtctcccactggttaccagatggccatgataatgtcggtatccttaacaactgtctagtgcaattccctgcagcatggtaagggcttgaaatattgagtgttttccctttggagaagcaagtgacatgtctgggaattgcttacaaccgctctgatggggtggttgcggagtgatggcaaactgggtcatggagcctaaattcagcttgatgttgtacaggtggaggccaccaaagcacggtgtttgccatttctcaagcttaagatgaaggaaggcttcatccatgcagaatctggtgtttacaaatgagcacaaaataaagtgaggtgtaaataagcattaagatcattataagaggaagcttcgctaaatttgctgaaatgttcccctgagttaaggtggttttgatagaactctctcacaagaatgcttagggagtcctcccagcatggttctctgaggtgtgccaagttaccagatggatttgaggaacgttaaaagagaggagtatgggtatggggagggtggagaaggtgggtgtatcaatcaagttgggctagatcatgctgcaataacaaatgacccccaaatcaccactgctttagaacaacaaaggtttattttctgcttatgttatatgtctcttttggatcaaccaggggttctgcttcatgttaattttactccaagacccagactggcagagttgccactatcctgggacattatagatggtcacagcaaagacaaagagagattgtggtcagtggtacactgggtcttaaagcaaccatccacttctgtcatatttcattggccaaggaaagtcacaaggccactggcctccaagagagtgaggcacacaggctttccacaggcccaaaaggagaacaggaaatagttgctgaacagcactcatgaccccagagcagatggcgatgcattttagacccatggacatctttggggccagatgaccttttcagaggctccaagcactgaaaagattatacagatgcttgttgactttctatggggttacagcccaacaaaccaattgtaagctgaaaatatcaagtcgaaaaggcattgaatacacctaacctactgaacacatagctttcctagcctaccttaaacgggcttgtaacatttgccatagcctacagttgggcaaaatcatctggcaacacagtacactgtagagtaccggtgttcaccctcttggtctcgtggctgactgggagctgccacccactgcccctgccaagccttacaggagagtgtcctactgcatatcaccagcccaggaaaagatgaaaattcaaaattcaaagtatgctttctactgaatgcatgttgcttttgtacgtggaaccatcgttcagttgaggatcatctgtataatccaatataagagcaattccaaactagaaataaatgtaaagaagcccagcaaagttctacctttccctatgatgaggatgactttaatgcttcaaaaaatgaagattctttcaaaacagtttttgggtcctactgcttgctgatgacacaaacattacttactgtgtctagagggccagcctactcttttcttttctctgcaagaaggtccactgtgcgggtagcctgaagcgtattctgtggggctggatgggtgaagtggggctgggaggatgctggcatcccccagactgtaacaaggatgagagtctttttagtcccaaaccagaagtgattattgaaattataccatggccatgaaagttctttgtcagagggaagagggtaatggaagtgttttctcgtttgtctaggggaggacgaggaagaaacgaacgtgatagttctcagctacccccagtactgccggtaccgctcgatgctgaaacgcatccaggataagccatcttccattctaacggaccagtttgcattggccctggggggcattgcagtggtcagcaggaaccctcagatcctgtactgtcgggacacctttgaccacccgactctcatagaaaacgagagtatatgcgatgagtttggtgagtctttttttttttttcctacctgattcttgtgcgtgtgtgcctagttgttttcagttcttctgaagagcggtgatggggaacggggctcactttcacaagccccatgtgctgccccacccctcccatcccccaaattattgcggcataaggcgtcattgcctccttcgtagcctctgtttactatgagtaagagatgattatttataatttgttgttcaatgtagagtctgaagttgcttggtcgaccttgaaattggactttaggacaggaagctttcatgttacttttctctcaaaaggctttgtctattcaaatgcttttttatttaactagtcactctcttttcattgttataaggtattgtaaaaatgcaccaatggtaaccacttcagtagtaaacagtgaatagataaatagatagaaagaaaacaacttcagtactgtatggtggataaatagataaccactttagtactgtacagtagatagacacgtagagagatgatagatagatagatagatagatagatagatagatagatagatgataggtgatagatatccatgtcctgaattttttcatacactcatacacacacatgcacacgtacacgcacattgtgcccaccaaagatggatacatatcttaatctgcatctctgcctagctaactggtcacgtgtctctacatgtagacagaaggggaggagaagaagatatcacatcaccagtttgggaagccttacacggtgcagtagatggcgagatgcaagccaagatagtcgttctcttacattatcactttctcatctgtttgttgaggagactggatcatatcagtggttttcagcaggctgggcagggatgtcagaataccctggggtagccttatcaaactgcttgtgttcctgggaatttctatacttagaggcgtgaacccctaccactctcaccctaccccttctctggaatcactaccacagagtgactgctgggatggctgagccctgctgaatccctcatggctacctgggtgaagaagaggttgagacccttagcctggagagagcatagggtccctttgaactgaaacattccttgattttgttggctgatgttttcctgagaatcactagttggcagattatccagattcaggttactctgcttatcctttgcagaccttggtatggtttcaggagtccactatggcctcttaaatttgattcttcatgattccaacagccctggtgctgctactagagaaattttgcaagtagctatgtgaacagagttggggtgaggatgaggagatggcatatgatgatcaagaaggaagggaagacagagagaggaaggggaaccaaatgatctaagtccattagattctaagagccatgacattttttccctctaaattgtgtttttggatatctctcacaactctggcttatcaaatgactgtcattctgtaagagggcaacactgtttgtatttattttttcttcttcaaagaaatttatttattgtcatatttttagtattcaaatatcctttgacttcaagtagataaatgtatgcaatacatttttttacaatgccctctcttttcagatcagcatttacaaatcttcccttttcaatacctgtgtttgagtttttcttccacattctcggctcccaaacgttgcttcctacttgccgctcaagaggtctctaaattcctgacacagaataaaactgaaagcatgtgttccctcatttaagagtgttcaaaattagagtttcacaacgtaatatgaggaaaaaaatgttttaacctttctggttaatttaagaattattagtcattgagtttcaaagctgttggatctagaattggtaatagaaagaagttccaatttaacagcgatcacaatggttgttaagagttactaaattagttttaaatgttctcacaaaaacaagcatctgacttttgaatgttttcctgaactttcttctggtatagctaattttaatgctgtttttcttctccagcctcttaaagtggaagctttcttttggaataaaggtacctttagagaccttctagatggctagtttaataattagagtattagacattttttagttgtttgtacttcaaatagtttgtacttcttacagactttcatgttagtaagtggaccaaaaagcttattttgagcagatttgagcaacttcactaacatccctccccaccgtcccactttcggtcacaacctaaatttccaaagagcacccttttaaatctccaactggttgcatttgaaattgacatgggttaaagtgtttgttaaaatgtggcattgagtttctccaaccaactaacagttggtggaagaacataaatttaattagtgactagcattaaacaaatgttcctaatattaaacactgccagatgactgaaacacttctgtcagattaccgagagtgccagggggcccacagatgaattttctacacagtatatattctgtaccacacgtttggtgacttcagtaattggtcaaatgtaatttaggtaacagtatgcctaggctgtaaaaatcaaattttattggccatatcaccaggtggatgaatggtagagctgatggcaaagagtttatagcatttagcagctacacctttgacacatgaaattcataaattgctgtaaaatacctccaaggcccttctcaaaaggacactgtttgctttcctatgattgaataatgtttattttattaactaatatactttttgctttcttctattaaatgcgattatggagtagggggtgggaggaggtgttcaaaaggtaaataaaacttggctcttgctagttttgagaatttaaaatctaattggggaagacaggattaacacacctgaaaggttaactaatgttacaagaaagtcaatgattaagtatttgatgagtgttgcagaaagcaagtgtggtaggaatttagcagtgggctgggaggtggatagagatggaaatcttggtgaggggtcagggaaagcctcgtgaaaaaggcagggtttgatctggttttaaaagatagggagcaggttaataactactcatttctaatttaaaaaactattggaaatgtctagattgtttaaaactcatgttctgacctcccattttgggtaatggctgccttcaccctggatcaactgttgatctgtcttaggtttgttctgcctctagtcactatcctttgggtgggtttcataaatggcctgatgtcctctctacctgtgggacacacatgtgactcagtgaccaagcctggcaagaacccaggctgtgactttggagctggggctggctttccatcttggataggaatgagtctgagttttctctgtgtgccgtggagcttacctgcattccctggattcatctctgaaaatagactttgcattatgggatgaccttgcccaactgcccatacacccctgctccccacccaccaatccccactgctgttttaatgttgtccactgaataacaagtttaattgaacaatgaaagtaaggcttttaaatctgcaatgagtccctgtaaataaattctctgtggaattttatgaagctatttaatgaaaagtttgattagaaactattaaagaaaaatagaatagatgaaatttcatcatttagtccaacattacagtagtgtcattttgatttttatttacattgagatattcagaattgagtaaatatatcctggttttaattaactatcctccttacttgggaaaggttattttaggcttgaagggttttgatagcataccatctgctttcttcactgtattttattcaggtcccttccttgcttacagagctgtgcaatgtctaaacctatgacataagcataaattgaatcgtattaatggtaggtgattgaaaagcttcagtctcgacattctgcttgcattcttccatcttgtcagttacactgctcttaaaggcaatatgctcttttcttagcacaagagaattgactatttttaaaacgaaagcaacagactccccattaaagcattatgaaaactcattgtattgcacatgcaattaggaaatgagcttgtaagaccaatgtggggaaagtgatgtgaatggcaattttttcttcataagaatctttattctgtgcataattcctgcctccaccgtcctgttagaatagcctggagaatcaagcattctccaacaacccctaccttgcttttacctttttaaatgattcctcttttgtaaaatgcatactgtcatttatattgtgttatttcctatgcaatagaaaaaacaaacacatacaaacatttttgtctatttttgttgttagaacaataaaatgtccaccactttgtaatgcacagtgtttacattaatatcacacagattgatttcacatgtgtgaagtgttgacagctaaatccaaacagaggcacactcagtacagtagataaaaggataactttaaggtactggcttccatcaaagatatgtaaggcagctcaatatatataaatgagatgaaatcaattattcaaggtgtgtggtactaaatggcttaagaaatggttgacttaaaaaagagatacagtttattttggtctgaggtttgaattgcaaagaagaataagaagttgaagttgtgcttctgagtcttttggcaattgggatgtgtgttggcctgtcatcagctgtttggtccatgtgtagacaccatgagctctgatcttcagggagaaggggttggctatgtcaatatgaaaatacacattctgctggggaccagaaaggagggacagcagggtatagtgaaagagtgctaagcttacaggcaaatagcccaggtttaaaatcagggctcaaccacctgattctctatgcctctgggcaagtgacataaggtccctcacttgccccatctgtaaaatcgggtaataacagccaacttgctggacacagaataagactgtgttcacttgattttaaaaaaccctcttgataaatgaagattctctactgtttctattagtcatatgtcttgcacaactcatactcatccaaaatgatcttgtttttcaatcatgaaggaacccaattccctaaggctcctggggtcttactataatagaactttaatggaaaagacgagttttctactttttacagtatgtttttaaagaggcttttctatctctgtactgaactttccagtcctgtttttcctgtggagtgaaataatgacattatggacaaaagaagaaaaagaaaagggggagaacagaagagatgaagggacaaaaccttgaatttttatgaaaggaaattcaggacgtataaaattaatttgaagcataaaggatgagctggactctgcctcttcctttctgaacatcacatgttttgctggaaatgaaaggcagttgttttgttaaggatcatgggaatttgtaagtgagtaaacatttttttccttgccgaagtaggtttcatggtcacagtggatttcgatgaccaaatggctttgttcctggcccctgtccacattcatactttctctgcctgcctgtggtgcccactgatctcccaaatgataagaaggcagacatttttctttcattgaagctaagtagaaaaggagttgtgcttcttgtatattgctgtttatgcagaagaccttaaccttcagagatcttacttggaggactgctttgttttggaaattttctagaggttttgtttatcattaaagaatggtctaaccaggctgggcgtggtggttcacacctgtaatcctagcactttgggagactgaggcaggtggatcaccagagttcaagagtttgagaccagcctggccaatgtggtgaaacctcttctctactaaaaatacaaaaattagccaggcgtggtggcgagcacctgtagtcccatctactcgggaggctgaggcaggagaatctcttgaacccatgaggcagaggttgcagtgagccaagatcgcgccattgtactccagcctgggaaacagagcaaaaactccgtttcaaacaaacaaacaaacaacaacaacaaaataatggtctaaccaagtcactcttggcactttctccttgttgcatgggctaccaaagtgaaaacaaggagaaccttaaggtcatcatatggcatagtaaaccaaacccaactcagtgctggtagaggtgtaatggatgtgctccgtgatacatgtaatgattaaaagatggactcagcttctaagagagtaagacaaaagtagagcaagagagaagacctccttgggcagaggcctcagaagctagaatatcatttctcttgggaaaagaattttgtgtgttgctactgtaaattaatttacagtcataatatatggaatggctaagattcgaggatttcttttctgtttttggaacttgaaaggagatttaaaaataactctggacaccttttgtagctgagtgggctcaatgggttattaaaaacaatttgggctcatgggtacaataaacttttgttcacgccgtaagaaatgatttgtgtctatattgactaatatttcacctagcatttcatctagaaaagcgagaaagttatatcccattacattagcaacatcaacatatttctctctagggtgaaactgacatttttatcaattaaaaaacatacatgctgcaggaaagaaccaggtcattgaaaaatcacaagcaaaagtgctggtctggggtagtggtggtggagagagattcagaataagtctatgttcgcttgacttaagcagcctccttgataaatgaagattctctgtaatcccctttattatgtcctgccagggaactagatggatataagttccttgaactgtaggtgaggctgtgtggagatgcttagagcctattacagtgcctgacacatgataggctctcattcattcattcattcattcattcatttaaccagggtttattccacagctattatatgtgaggtgctgttctggtctatgaggacaacagttgtgaacgagacagaaaatttcccacttttatagtatgtggaaaggggagtgacaaaatgtgagataactgtggacctgacctcacaggtattgacctcacaggactattgtgaagattaaatgagctaatgagtaaaagcacttagatggtccatgtaagtgctgtttaagtactcattgttaacctacccttcttgtgcctcttgcagcacccaacacaaccttaaccacatactggttctgtagtggttcctcagaaaacacccacaaaattatttcatattgatacagactgctggggaaaatgaagtatgtcatttgctattaaaaatcattccacatcgcttattccagaaatacttgtttgtttgtccctctgcatggaatgtatatccccagatatcacagatctggctctttcccagatcatttgggccttggctcaaatatctcctccccagggaagtcttctctgaccatccctcttccacaagcccagctctatcccatcacccagtgtgtcattatctttctgtaactcatcattatctgaaattaactcctatatttgtttctttacatgtttacagtctgtcccgccccctccacccacctcccccgccccacaacacacacacacacacacacacacacacacacacacactgccacataagctctttgtaaatgtatatagggattttctgtcttattcacagccatgtgtgcaggcaacagagcagtacccagcacatagtagctgtagtaaatattggttacatgaatggatggatacgtttatagcgtatgtcagtatcattgctatcccctgtttcacagataaggacactgaagcacagcaacatttcatggccagcaattggcaaaatcagcatacgtgctcagtgtccgtgctctttgcacctttacattaggctgcctctcagcccagaccctgctcagaaagagctctcagacttcctgagatcaggctgatggaaaacagataactgatcgctagctttctagatgatgaatgtacagtagattttgtaggatttaaatagagagattggcgtgttgggaagtggttaggaaaggaataatcacaagcattcaaaatctgaaacccactggactggaatcaagaaaccctggtgccagccaccaatacccttcatctctgttatgccagcctccttgcctcagcccttgctgtcctttggtctgtttttaacaccccagccagagcggccatttctctgctcagacctccggtggcttcccatctcatcacagaaacagaaatgaggatagggctctttaagagtgcaaactatttagaagttgaagggggcagatagtgaactgctctgtgttctcatggactctgtgagacatggggtttccatgctgacaggactttcattatacacctctccgtgattttctgcttagaatgcattggctttcccaacttggcattattctttaatgaaaaaattataggtctaatttcaaaaaaatgaaatgtatgcaagctttcctgcttctgtcacttttttatttctgtagcacataaatcatttccctttttaaaattaaatttcgcttgccatgatttggtaatgggttttcaaaggaggcagagtagccaagctcttggcacaagagccagctgtactgcctgctcaggaaatcttctcattgctggctggcgtgggccttgattccatcatctgggctttatgttcccttaggaagttgcctagaaattctgtgtcttaaaagctctccttagagtggctgttttggctctccaggtgccatcttggaggactaaggaacacactgtgttcagcagaagaagattggtgcattctaatgctccttgagtgcttatacattcattccttgggcaccaactatgtttaaggcagaactccaggcattgttaggatgctagtgtctgctctctagacaactgaaaaatcaagttgtctgagataggacatggagcaagaggccattacaaatgttctttgtaatcctcttaaaaatcttgcattttacccatgagcgacctcagagaggttaaacagcttctgaagggtcacagacctggcatgttgctgaagtaggggttagcaaagcaaaaccccacacacccccaggtctactgaccccaaggggcatgcttttctgctacaaatgcaagaagcctagagctaagagtcaggagttattttgaagtttaaaggagaggatatctgccaaagctttgtccatgggaaagtttgccatataacagacactacgaggcagttggctaagggcaaagtgaggaggtcaaaccgtaggtgccaccggagttaaaagatccataaaagagagccctaatgtcagaggaagcctcttagaggaaatggatcttcaactggaccttgaaggacacaaaaaggaggaagttatttcaggtgaggaggtggaaaatactctggactttgaagctcaaagagattgtttcctctgccatttttagctttctgcacagacaaaaagcagcctccacaagcaaaaactctttttcttttcctagaagatgttatattcccccgagggagtgagtacttgtgagtcctctcacagacccccatcatggttagaacccaggggaagtttcttggaagaaaaatcaacttgtttcttattaaattggatccttcccttgggcctatgagaaagaaaaggagagaggcaccaattttgcagcagtggtaaaggagtgaggtgcctgcttggtttcctggctgcttaatgggctgcttctaggctaaaagagtcacttcagaataatcatctttaacattttgcttcttgtcccttatgtgttactcagtactttttcaaagatgtttttccccctctgcctgttattaaagttaatggcttcagttgcatttctcttcgctagactctaagctccttgagggggtaagaatcaacatgtttgttgaaatgatacgaaaactctgctagatccgagagggcttcaaatctccatcatcttatctcttttcctggataagtatttcgtgacctcagtctttcagctttagctcattgccagttgatttcattctcaaggcagagtgccaaactcaaaagaactgggttttttctcaatatttatttatcttttcaaaccaaagagacattgttcgtaatctggtcagtgtctttagctaaagattgttcatttgttaggatgcttaaaagacctttgtagttctgcacaacctagaaggatgtcttccttagaaaatcaaggagcgtacttaagtcaggacaaatggtagcctgtatccagaggtcactaacaacctttccaacttgtaacacagataccagaattcgccgtggccaatcaagaaacagtggctggttgcttgacagcatacagggcgttgtcaggtttctaattaaatgtggctctatgggtcaggaatataatatagatcacagtttgggctggaatcatatcggaaagtgttaagtaaaaaaggctcagccagtataacgttctcatatggaaaactccttggtagatggtactgataccccaaggatcctttatggatcactggcttactgcatatgattgacagttgaggccttctcttgggagagttgcatggaagatcctagaaaggcaagttcataacacacaggattcagcagggcactttcctcgtccggtcccaggcatgaatattatatctttgaagtaggagatcaaatcttttaacaagggtattacacacaacaccagaaacatgactttatcaaggagctgagtcccgcttcatttccaggacataccccttcagaaagacaatggatgttggtactaattagttcttttgagatttgtcttttctgcagcacagttgcaagtaccatgctctagagaatgcattttatcccatagctgttgaaagagaggaaattgaaatgtgtcaggactagaacaaacccagggactgttatggaggccccaggaagttgccttgcagacccttggtgccagtgtcacctataggagctgaggaggtggcctcagagacatggagagtttggccccgccactcccaaccctggtaactgctcatcccaccctcagtcttgccataagaggaatgtcttgcacatgcaagaagatgcctcatacttttcagagcacctccacctcttctggcctctgcacaactctgtagaactgggagaacaagtgtccttgaccccaccaggaagttgaagaaactggtcaggtgagtctgtggctacacgttagcagagtagtgaatgaagctaaggggaaaccacagtgagactcgggcaccagctactcggcctttgctcttaatgccatcccccaaaatgtggcccagtgctgaagggcacggcatcacagctgtgattatatacagcaaaccctaattaaccagaatcttccataaaccagatgctccccctccttcatccccttagtaccatatttcaaggaggggaaaaaaaaaagtaaatagtaaaaacagcttatatgtttttcaaaatatttttctcattatgaagttatttctattacgaaaagtacaagtagagtaataataataattgccactcttctgtgagcatgtaccatatgtcaggccttatgttaagccctttatatacattatcttgcttaatcattacagcatccctataaggaagctcgcgttaaccatcacttcacaggggaggaaagagcggctaagaaaagttaagtaacctcagcactttgagaggccgaagtgggcagatcccttgatcccaggagtttgagaccagcctgggcaacatcccttctctacaaaacaaaacaaaacaaaacaaaaattagccaagagtgatggcacgcacctgtagtcccagctactcaggaggctgacgtgggaggatcatttgagcctggtatgccaaggttgcagtgagccaagatcacaccactgcactccagcctcccaagcaactgggcggcagagcgagaccctgtctctattaaaaaacaaagagaagttaaataagccaaagtcacaaaactagtaagtggtcaagctggattccagttcaggtctgtctggcttcaaagctggtatgcttatctactctgttgcctccctaaacatcatccgccatctcatcagtgttatcgatttccctccagtctttttcaaaagcactttcatttacttgagaacattttatttatgcaatttcatatgttaaatttctagttattataaagcaaacatttccccatattcttataaacattttataaactccattttaatgattgcctaatattacataaaatgaattgatcacagtttacataatccctttttattagaagtttatattgtttcctccacagttttgttttgttgctgttatgtataatatataattaatactataacaaacatctttatacataaaagcatcagcacttgatggattctaggaatctcttattgccaagattattttccttccaagcaatagcagagaaatcagataatcagagcctgctgtagacctaggtatcttctgagaaccagtgctcagaatgaagatccagagtttcgcctgggctccaaagcacaacaggaaaaaattttcttgagtgaatactgagcacaagcaagaaagtaagctcaggcggtgattttcacatgtgcatcaatttcctgaagcacttactaaaaatttgattcttggggtctgcctcagaccttcagaatttgaatgggtaatatcatgtaacccactttttttaatagacaaaaattgtacatgtctatcatgtacaatgtgttgttttgaaatatgtatacattgtggaatggctaaattgatgtaattagcacatgcattacctcacatacttaactttttttgtaataagaatacttaaaatctattctcttagcaatttttaagaatacattattaactatagtcaccatgttgaataagagatctcttatgtctcttatgtaactgaaattatgtatcccttgagcaacatctccccaactcccccaactccagcccctggtgaccaccattctactctctactcctaggaattcaacatttttagatgctacatgtaagtgagatcttgcagtatttgtctttctgtgactaccttacttcactccacacaatgccctccaggttctttcatgttgttgcaaatggtggcagaatttgcttcttttttaaggctaaatagtattccattgggtatatatatatatatatatataccacattttctcttttaatttttatggatatataataatacatatttatgggggttcatatgatactttgataaaaatgtaatactttgatacaatatgtaatgatgaaatagggtaattgcggtatctattacatcaagcatttatcatttccttgatacactttattttaaaatctattcatcctttgatgaaaacttaggttgactcatagtcttggctattgtgaatagtgctgcagtgaacatgggagtgcagatatctcttcgacatattgatttcctttcttttggctatatacccaatagtgggattgctggatcatatggtaattctatttttaattttttgaggaacttccatactgtttcccataatggctgtactaatttacatttccttgttaccaatattttaatcacactttatgcacacttaagattgagactcaatactgtaggaatgcttaaagttgaagttggttgcagtggtaatggagaatggaagttgacaaagtaattgttaccaccagctcctcccataattgcttctgttcgggtgtgatggaggaactgttgagctggtgctgacaggaggcagcgtgtggtaagaagtagcggctgaaggtagggggtatgttccttgggtagttgcagatgggtaaaaggctttgctaggtaaaagtgcaaagccctgattttggaggtatatactctgtatgctattaactaccaagaaattaagaaaaagcacagtgtactagaaagggcatttgggagtcaggagaactatgttctgaatatgaccctcatacaaaatagggagcttccatgactcagttaacctctctgggactccacgtcttatatatgaaatggaatgtcggaccggtttttgcacttttttggatctcaggtccctttgagaatcagatgaaagctatgaatcttctcataaaaagtgcatgcaaacataataaaaataataatagctttgaacaatgtcattagcaaaaattgacatgtcaggcaaatacagaacattctgcatctattttccaggatttgtagggtatatgaaacctcagattaagaactcctggactgggtgatctttaagaaccttttctgttctcacatacttgcattccatcaatgaaacaaaaaaggtgtttccaatgattctctgtaaacgttacacttcattaattagaacaactcatttccttagaattttaattcatgaaaatatgaaaataatgacattagatcataccttttattgagagcataccatgtatcaggcactgttatgtgcctataatttgtgttcctaagagataaccacttaatgaagtgttagtaggataaatacttcagcgaaaggcttattgaagccaaatttttctaggatttattgagcacctactatgttcattatctcctcgattttcacaataatacttaggtagggattgttaccttctctggttttacagatgagaaagctgaagttcagacccgtttaaggaagtccttcaacacagctgctttagtggagctgggattcaaaccctgctcttaagctgcaaagcagtgctcttacgggttgtgttgtgcttcttttcagtagcctatcaactgttctaattcatttaaataatgattatgagaatctgacttgagctcaatgggacttttgtcaaatatatacagcagtgctcctatgggggaaaccgagtacactcttcaaattcacctgcgtagtctttgcttttccacctctgaacggtgtgaggttttttgttgttgttgttttcttttttgagacagagtcttgctctgtcacccaggctggagtgcagtggcgcgatcttggctcactgcaacctccgcctcccgggttcaagagattctcccacctcagcctcctgagtagctgggactacaggtgcccaccaccatacccagctaatttttgtattttcaatagagatggggtttcgctacagtggccaggctggtcttgaactccgacctcaggtgatccgcccaccttggcctcccaaagtgctgggattacaggcatgagccaccgtacctggcctaacagtgtgaatttaaacactgttattcacttcagccttatctggcatatgtggagcacttgccgtaggtgaattgttcgactaagactcagaggatggtggagtttgtgcctttaggagattcagcattgcggctaaggttccatcactgtacgtagctggctctattctcataggtcagtgtgctgtttgcagcctactgtccataaggcaaactacaacccacgggccatgtgcagcgctcagcctgttacagagttttattggcacactgccacactcatacgcttacatcttatctatggctgtttttgtgctatgacagctgacttgagtatggctcacaaagctgaaaataccaacactctgaccctgtacagaaaaatgtattgacctctgatatagaccaatgaggttcattaaattttaagacatcatttctaagatacaccatttttatatgtgccacattgcatatacaataaaaagcactgctgattaacaactgtaaaatgccatcaattgagatgccaccaattctggagatattgaaatttgaaccaaacagtgtatcttacaattgaaatttaatacttttcaaagtgatgtttgagattgagaggcattaaaataaaaccctgtaaatacggattgtcttaaagacaattttaccctgcccataagtcaaccagtctgttgctccccacgaaacctatactaacagaccatgtgataggacccagtgaattagaaaagcactggcttcttggcatctgtcttcccaaagactgttgctaataatgagtggaagaaatattttggcattgtcctctgatactattttcaactcctgttagtataaatatttggggtgtttcagtacagtgggttgtgtggcagtaaaattgttagttcttttatcttagggctggcatatttgaacagtatgcctgttcttaaaatgtgttatgaggctatgtacaaaaggctttgtagtagtttggaatgggaggcttctcagatgttgcttatggttagattcttactagtctgaaaaatatgctaattatatactagcctctgagcagagagagtgaactcaatattacaattttaaacttcctcaaaacaaaaacaggacaccacgtaaggggaagtagtgattaatgcataaacagtatgtgcctcgtatgtgtacacaaattgtcccttatgtctacatacgtttgtatattcatataaactgcccagacagcaaacatatttgaaaaaataagccatgactttgggaggccaaggtgggtggatcacctgaggtcaggagttgaagaccagcctggccaacatggtgaaaccctgtctctactaaaaatgcaaaaattagccaggtgtggtgacatgccccgtaatcctagctactgaggaggctgaggtgggagaattgcttgaatctgggcatcggagactgcagtgagccaagatcacgtcattgcactccagcctgggcaacagagcgagaccccgtctcgaaaaaaaaaataagtcatggtattttgttttgttctgcttttttttttttcttcaaaaatagaaatttaggaattctgagtcaggccacatattatttggctaattcagctgcagagtaagttattaatgacccccagatgttgtttatagtgattggaaatgtttggttgtgaaataatattttcttttttgtgtgtgcaagtgatatttcttaatatgctctacagcatctgaataaaagtttgatggcagaacagtttgcatgtccaatgtaattgcttctaagtgagctcttcattcttcacatttttagctctaattgctttttttcccatatgtctaaaaataaatatttgcaagttttgtgttctgctactcattgtaatacataaaatatttgtacactgagcaaaattcactgataatgttcacagtgggctatttagagaaagtaaggtttgtgtgtagaggagataaaatacatttttattattcaatagtataaatgccagagaaagccatttatcttactttgaaagaatatttttaaagaagtggccagatatttgacctctgagatgatttaaatagattcagttggaagaaaagatccagtgtcaaaaataatcgggttttctatataatagatattttaaatgatctctgcaaggtggcaattaattttttattatcagggacagaggccccactatgtagattatctaagtccctgacttcctgggcagacctcctctcccttcgtttgagtttattccagctcattagcacctccatccgaaggttggcagagaaaaggagaggaagaaaaaatgaaatcacttctgctgctcttaatggcccttggaaagaatggatcatgaatgaaacagaaaccagtgggaaagataagccattggattttctgtgttttcttttatccttgccttccttcgtcaccacagataatcaatagttggcttaaagacttttaaatgaactgcacattggaaggctttgtagttgtaataccaatatcattattatctttacgtttccaaagactgggtgggtgccagagaggtaaatattgcccggtctccatgttggcatgagacgcgttcctgacctttttttttttttttcaaacctgcccctcccccgcccccaccactgtcgtcttttatgcacagaaggtaattttttgtgggtgttcagatacaaacatctgcttgaccaccctgtcttgtgattatgtcttatgatcctgacctggtgatattttgcattaatgaaagttggctggtttggtcttccccatcatatttacttcttaatgtgttgctatatttacagttcaccaagaacaatctgtgacaaagatctgcttttatcaggacagctgccagattcataccacatctccaggttctgttagacatcacagtaaagtaattctttactgcttgctttacttgagccatctttctaatgtgtattcttgaaagtatcctggctgtatgaatctcaaatttcagtcccttttttagaccaccatgcagcccagaggtttggagctttgtcttggaagctccttccatcaatcagaataccaaatttacattgttaggttccctggaggtgttggagctctggattcagcaattattgtgaataagaaccttgcagctagggtgagtgccaacattccaagtgctagcacaatggaaaagagaagtggtttatgttagaatatggtcacattcttctgattaaacccactcaaaaaagacaacattgtaatattttccaatgactgtttatcatgaattacgtcagccttcgtttaaattgctattatttctccttaatgcttcttggtgcctgcataatttacggcactggcagcctcgggactatgaaataacctttcacaaccaccgtacaatagtgaagaacatggcgtttttgttgttaattattataggactcctttaacttttacaaagtgacataaaatattgttgaggcatttatgattcaagctacttttacatggatctattttgcttctggctagttcttaactaaagcaatcatttgtggttattaggccgccggagatattatgtcagaactggtttaagagtattattatgtatcccatgtcatacactacatgtcagcacttgaggctgtctttcaataaaaacaaatgtaattttagtttgtgctcttttagggattggccatttataagccaacctgagttcattcgaaggtgtcccaaccatttaggagcttgtttcagccttccatcatacacttttagtctctttcctgtggatttaagacctttccaaaacaaactttggcaaaggtttaattcagagtgaagatttgctcctagggagccacagaattagcaaggactggttaatcgcccagggctgagctcgttctgattcccacattttgtgggttttcttacagatttcctaggcagtgagtcttctaattgtgaccctcctaactgtgaccctctgaagagaagcgagtctcagcccatagaagaccctgccttacattcaaagaggctaccctaactttctggcgaggagtcttgagtagaagggaggtggaaacaaaaaaggatgggaacatgtttgagtttccacaaagctacacttccaagcaaactttgaattaatatgtcactcccctgggttccaaatactatgcatattttccagtccttgcttatttaaagcaagaaaggaagggcgtgccagaaagttttacaaagaatgaaaacacattaatgactcatgtgaacaattactgattttcttaacatataatttcttaattactgtcaaccaaaataatttgcatgataatatttttcctcccctcccccatctgtgtttaaaaggcataaaataatgatcaaagagtctgtttgatcaatagtcgggaaatttaactccttaattcttagtggattgatgggactttgacatcggatattcttcagaataatcacctccaacacaatgggcaaaatgagctctccagtaaaacaaacagctttgaaaagagctcaggggcattttctttagcttgaattcaaggaggaaattgtgacttttatgaaacttgcataaatttacatgtatcctgtcagagttttaaaattagacaacatgcctgaatgccctggaaatgagtctgccatccagatttagagtgcttttagcttttttaattaaagacatttcacaagccaacgccagagaagagaattaagcattacataagaacatagcaaagtttgagatttaatgggtgaatattacgaacttataaaggagataaaaagtgtgaaaggagcggttattgggagttttctacattttgttaagtgtaaaaaatggaaaaaatgaaaaggccaagctgccatttgctgtagccctcgttctggaactggttcaaagctcacagaactgactgtgggactgtgatgcttgttaatgagcatttgtggcagtgcactgggatcatgggtttgtcacatgaatatatatatatatatatatatatatatatatatatatatctcagaagatagaagacaaaagttgttgctgcagtgtgattgtgagaaacacaaaacaatcatcctgaagactgcatttacatagagctcagtgccaagtcccacaaatactcactctggattctttaataactgctgatacatagttatcgaaaattgtttttagctgcacatgctataccatttaaaaaacttagactaaatactgtcagctcttgtttgctttcctagcatgttattcatttattgagaaatttggaatgtaaaacatctgggaataacttggtgtgtgcaaaggcatctttaaaatgtgtatatttcagaacttctttggagtatttatttagaaatatgggaaaattctgtaaacatgttctggaatatatgtagcatttgaatatgaaagaggaagttggcataattgaaaacctaaattcatcttctataaatattactctgtcagaggaatgggtttctgaaattagagaatccagattatggtcagcgatatttaccaagaagtatctccttttgccctggacagaatgtgtgaaccagaaacatccattctggccctttctggggtgtaatgtggtcgtgtgacaataacttggttttttctacaacaatgtttatgtctaaataaagaagttaatttatttcagcgtttcaaggcatgagttggagctgtgcaaacccaattgcttagagtacaaccactgtggtgttaatagctccctggtttggttcaacagttagtccatatattttatagccgggtctttaagaaaccagtgccatcaccacaatcatagcaactgggagatgacacaacatggaaaggagtcagagaggagaatttgttaatgatttatcaattttctccttttgggaaaagtaaatgtaataccgaatatcacataactgtttttacttcttctaaatttcacattttgtaaccattttagtagctttaagccctggcactgtccccctgtcccatgttctcttctttactgaactacaattcatataagtggagctcatacaatgaagtttgcccatatagtccagtgggctggactggataaactctaacgtcctccaaacaccactttctggagattgcaaaacccatgtgagcaatgaggttctctagatggtgtgcggatttccagttaaggggcactcttactgtaaccactgtggccatgccatcctttggaaaaccttacccatttacttgtgtctcacagctgccctcctttttgatcctgatagaagcaggaggaagataagggggaaggtccctggagaatctcccactgacctgtgcactgggaggatggggtggagccttgggaatttcacacctttcgcaggaaagaggagctggccctctcctgttcctgggtggtaacctgggattcagtcggtgaggtagagagcttgttaacaagactccatctcactttgctgtgttgcttttcctttttcctttttgcacaacaaattccactcacccttctatgtgtccacaagcctagtccttcctggtcatgtgacaggaacccagtttttttctacaacaatccctcatttgtgacactggctgtggatttcctatcattagagggagatcatcaaaggaatattaaaattaatgtgctttccttgagatattccctgggtcttgtcttgtaaaaaactgaaatgacagaaaagaactggaagcaaaatgtaaattgaaaacaaaccaaaaaaaatctcctcattgtgaacgattcacagagctctcctttaactggagtacaaggttaaatttgctcattgatcagggcagcagaacccgtggtgcccgtgttaacgaacttcccatctgttttcttacgagttttgataaggtctttagtcaatgctggaaacaagtcaaagaaacatatctctgtgtttgtctctttgccctgcttggactttccacacactggagcaagtctccagcccctttcccaatacctagtggatgtggcagatgatcagtcattcagagaagactgtttcacaccccttactatgaacaattcttatctgttcattaaagtaacacttctctgtggacgtgcttggttagcaaatagctgaatgtctgaaagtaacaaaatgcttactagaatattcatcaactcagacttcttgtgcatttgctccttagatttagggcaaggcactcttccccatattgcctcctttggccatcatcattcatagtatattaactgagtgggcctgaaagaagtattgttatcttgagagctccatgtatttgcatgtatgacacagaatccttttgagtcttctcacaccaactgaaccaaatcctatatttatgcacatgtgagcaggtcactgccacattttgagtcatattcttgtaccagaagaataaagtactgcagagctgaaggatttggtcagtgaaaggttgatttggaaagtggaagaggataaggaatttaaagcagactgtcaagtcagaaacaacagactcttggtgagattaggaaagaaaaaaggaagtgggggaatacatagctgcaaccttgatttaaaagacaagtagcgatgtgatattaatcaagcaaaaggaagccttacttataaaatgagtaagaatggcactttttaagagagctatttctgatctccaaatcaagccacaaatatttattgaatagtgactgttctgccctgaactgtgccctaggcacattgaaggacacagactgtttgggagactaagtaaagtagtcgttatgatcagggtcacatacgtgtagataaagtggtgttccctttgagtcttggataccgataggcttctgtatccacacaaagatatggaaaactctgatttaagtgcctgccccctctgcagcttcactttcaagccttgatttccctagttttaaaatggggatgataatcctctcagcacagagtgccttattcatccatccatctgtacttctttctgtcaaggccatcgttcatcaattcaacaaatatttagggataacttattatgtaccagataatccatgaggccctgattaaaccttatggaattaaatcgacatgactcatctgccctaattctagagcctgggaatgtgactagtaagcaagtaaatagatacatttatatttgtacacatacacacaaagagaaatatagaacttaagagactcctaattttgactaatacaacacctgttgtctttgtagcagccagtgattactgcacatgctcaattcttgagtttaatggtaacacaaccactcctttttctttgaggcttatttcagaaaccagagtggaagggaacctttctgttgagtttataatagcaattacaagctgataagggcaaaccattcatcaaaggatcatacctcgggactttatctctttgggtcaaatgtttcctgattgatattgactaccatatcttaagcagctttgaacagataagaagctaggaaagaaattcctttgaaggagatttgacaaaattatattttctgatttttttttctttcgggaggcagattaacttcccattgttcttactaagaagtacaaagttaccaaaccaatgaactgaagaaaatctagaaaagttttcacgggtagatattgattgagtttccactagagacgaatgatcatctgtattgttattcttttcgggttctgaaatggcttggaaagaacttttaaaatatcgagaatggctctgtaccaaagacacttaggaatagacaagtatctaagaaaagatagctacttgattactacatataagtgccctactggaagcagtgctataagtaaaagtcttgcaggttaagtataattcgttttcgtagaacattatttgtagaagcaatgttttaaaaggtggggagggtaggtttctcaccatggacctgatagccagcttttaattggaatggccataaacattgtaattaatcaactatgtactcaattataaagtatataattgcattctgaacagtaaaaagcttccgaaagtgtatataaatcaactaaactgggcaatacagtaactgatcacataaaattatatttaatgagatgtgtcatctatcacagtgttttccacacagttcttatcttacatctttgtgattcatttgtgctttatttttattgcaacaaatctcacagtaaagaaacctctttatcttggccatagaattcagtgacattactttgggcagatttataatgggtatctttaaagagagtttggagacggggagatgtggggtcatttctaattggctttctggaaaggtgatctggatgtgtctgtctgcctttacttattataaatttccctatcacaagcttggctatttgtacttaacttgtggtcatgctactatatccacagttggcatctgttgcctggaaattagctagatgacctacgtttgtgtgcttcctgcgatagctgctaggtgttacaaaagaggtgtaattagaaaaacatgctaaatacaaatcactcttgatcaagtcactgcatgttgagaagtataggtataacttgtgaccatatcatagctcctttatttatgtagtttcttcacattttatgtgtacaatcaagcatgcctgctgaccaaggccagaggtggagtggaagcgaaaaaaaaaaaaaaaaaaagcttatttgcatttttaactctggcaaattggaaagatttccaaaatattttgataaatatattccaaaatggctttcactgagtggaagttcaaaaggtgttcgtatctggtgaatacacaccaaagaccttgcaaattctggcacatgccttgggatggataataaagaaatagctgagtaactgctacagctgttagctggctttctaataaggtggtgataccactcatttaccaccctctttcactctttcagtcgggttcagattccaagtgccttttccatgagtggagttagatgcatgctgagtacttatacccaagccttgttgcaagaaacacaaccatatgaaacaactgaccagggcagaactgccaaatggagtgagctgaaaaccttctcttccatcatcctgagagctcatgtggttattttgatcccccagtttcctgtattacctattagcagatatgtgtggtgtgggcaatgagtgtgctcatttatttatgtgtccaactgacatttattgattaccaactatgtaattgtgtgtagccccatgtgaggatataggactagtacaataaagaacacaatccagtgctaacctttgaggcactcacattctagtggtgggggacccttgacttaagcaattgtaacagtatttaagtactccaatagagctaaatgaatccttcttgtcagattccgtagataaaggaatacttttttaaaaaaattatatttatttccttgaatattttactggaactaatgtaactgacagactggcaagttgtacaagtgactaatatattaatcccactcttcccttctgccttgtgggatcgtcaagttgagtcagggcttaaaaatggagcttgatgagatttgctctaaatatgttgactaacaccactttaacccctaaacatcacatgcaaattgattatgtctctttcactccttttaaagacccaaagatgcacctagttaataacatgctctatgtccttaataaagagcaggctaattaaaaattgtttgctggctgaaaatgaataaatgaagagtcatatattaaaataggcaacttcagcctgcagaaggagccaaataaaagctagtggggaatgaaaggaatattttgagccttttccaccaaagatgaaacatatgcatgacaagttgtatcacagtgacaaggtcctggggtaagaaggctcttgacaggacgggcagccagggttagtttcaccacctccatgatacaaaaggaaacagtcttgttttcctctctttcttcctccatctctcctagtccttcctatctgtcaagccccatctggccacagctccacaccagcctccttgaatctgtccaactcctggaggcctgcaacatgaaaagtcttcactgtagtgatgcattagcctcacagtatctccttttttttttttttttttttttttttttttttttttttgagactgagtcttgctctgtcgctcaggctggagtgcagtggcacaatctcggctcactgcaagctccatctctcgggttcaagcgattctcctgcctcagcctcccaagtagctgggactgcaggagcccaccaccatgcctggctaatttttttgtatttttttgtagtagagacggggtttcaccatgttagccaggatcatctcaatctcctgacctggtgatctgcccacttcggcctcccaaagtgctgggattacaggtgtgagccatcgccacctcacagtatctcttaagaataaaatggtccttcccttgtgctttgtacagccgggcagtatgcaccttttttaacttcttgcactcgtttctttctcccttaaatatgaaaccctgtgtatgtccttcccagaaaagaaacccccttatcattgcctcacccctcagtctggccaatttctccttctattctggagatctcaccttaaacatcacttcctcaaagaggtcttccctgacattccagtgagttcagcacccttgtgatgtttcttactctcaccctttcataacactgatccagctcaccttgctgcatctctcttttccatgccaaaacctcagctttatgggaggaaggagaaagggcatcctggaaacgccttgtccctggtgtgcatctgcttatcctaggtagccagtgaatgttgaagggatggatgagttaactctaagtcacagaaaacacacttgattctgcgtccctggaaaacaagaatcctatctcatatttctttggttttggtcacaatgctatttggtgcccaagaaatatttattgaaaataattcttagatctgttgtgatatttatctcagctaggaatgagaagagtttcctttaatgatgtgggggatagggagaagaatgaacgagcttgggcttgtttgctttcttagtttgaagcagttacgcaagtacaaaaatactagtttgtagtattgagtgagcaatcctgtgttaagtgtgggcctgttgtcactgcattctgcttttcagcctctctccttccaggccactttgtctcagggaacaaagtctgttcccctgtagggtattgaggcccactgctttgtagaggcaggggacgcagcaacaagaagatgaactctggatctcagtctgcactcattgtcactcaccacctgtgtgctcctgggcaatgactcaccctctctcagcctcagtttcctcatttctaaattgacaatcatgatactactcacttcaaggggatatattatatatatgaggattaaatgaagtgctgcacataaagctcttagaaggggctgggcatggtgactcatgcctgtaatcctagcactttgggaggacgaggcggatggatcacttaaggtcaggagtttgagaccagcctggccaacatggcgaaatcctgtctctactaaaaatacaaaaattagccgtgcatggtggcgcatgcctgtaatcccagctacttgggaggctgaggcaggagaatcacttgaacccaggagatgttgcagtgagctgagatcacgccactgcgctccagcctgggcaacagagcaagactctgtctcaaaaaaaaaaaaaaaaaagctcatagaagtacagtacctggcataaaatatttgcaagagatttacaatacgcaccacagctaacctaaatcaagggagatctgctcgcctccatctgctctccaaaactgttcgtgggacactttgaggtggcagtgagtgcacagagaggcctaggctttagaatatccagaatattgcagagccacactattctcacctccatttttttatgttccgcctcctgtcctgcagccctaacccttatccatgtccacgtcatagggactgctccagttccgggtatgccatgccttctctttatctctactgctctccaaaagtcagcttggaagttgagaattatatctatctatgtagtatattttgttctctgataacaacttatttttttcctgtggcagagcaattatgctcagtatttttccaagttaattgcatagagaagacattgtctttgattggaattaaccaaaatgagaatatatagctaagaaagagtaggaagacaatattggatctaaggccaagaattaataattgtagtagctagtgcttatatactacttattatgtgccaggcactgatctgagctctgaatcatttcccctaatttacagatgaggaaactggttgtctgtaggaaccacagagtggaaagagtatataatcagcctagttttgcctgtaggactccatcctcatggacatttgtgttgcttcacttaatatccagtaaaagagggagatcacctcgtaacaaattctgcccttatttagttcagattttcgactcaatgtatcaaagtcaatattaatggactcaattaatcatgacattgaaatatcaaaaacaaagtgtgaggaaaacacactgtaaagtgaaatctatgtctcctttaacgatgtgggggtaagacgtacacagagcgtttggctttagcagaaatcttagtctttgatgtggaaaatagaaaagttcttgttgtttccatttgggtcagagaaagagatgatcgccctatgataagtttattgggttctaaagctagatgtaataattgacgagccacaagctgtcctgccctgaggatatgcaagtatgaaatacacatgtcaggaaaaatgcagggtttttcttttctttttctttttctttttttttttgagacagaatttcactctttgttgcccaggctggagtacagtcacgtgatctcggctcacggcaacttccgcctcctgggttcaagcgattctcctgtctcagcctcccgagtagctgggattataggcacctgctatcacgcccagctaatttttgtatttttagtagagatgggggtttcaccatgttggccaggctggtctggaactcctgacctcaggtgatccacctgcctcggcctcccaaagtgctgggattacaggcgtgagccaccacgcccggccaatgcaggtattttaagtaaggaaccgcacaacaggaaaagcagaatatatttaataagacaaatcccagttagcctaagagtgaggatttgtcataagacagggctgcttacatggatgagtggggggctgaagatggaagatctaagacaaataactgtaagtaaacaatttttggtgaatcatcttactccttaacagaagccagcaacccgtagtggccttcttctggatagctgcttaaggagggaaatattttaagtgtggcaatgtcctcagttttaaacaaattttccccatttttgaaaatgatcacacaattaatgcctcttgcatgtattcaacaatagttgcctagcaaccacgaagaagtgtttttggagcgcaaagggtctaaaaatgaatgaagaacaaatacagtacaacttgcagctgaaaatgaccgattttctgatatcagtttcaaagtacatcccccaggaatcaggcaagggctatgcatctttaagagtaaagaggtttgagctgggtgcggtggctcacacctgtaatcccagcactttgtgaggccaaggcaggtggatcacgaggtcaggagatcgagaccatcctggccaacatggtgaaaccccatctctactaaaaatacaaaaattagcctgtcacggtggtggatgcctgtaatccgagttactcgggaggctgtggcaggagagtcacttgaacccaggaggcggaggttgcagtaagccacgaccatgccattgcactccagcctgcatgacagagcgagactccgtctcaaaaaaagagagtaaatctgatctggcatctttagagacccactgaaatgtcctatttgtcttggacacagacaaagaggaagaaaagtctaaactacaagaaggacctcttaagtgtagattggtccacttttctgccttccagcaggactgctttccagctaatcccaaatggttgtgtaactaatggagttttgaaaaactcttaagaaggaggattataacaccttctttggtaactctctttgggattttgcagcttttggactgagaccacttggtaaagaccatgggttaatcaaggaactaacctcttcactgtaggtaactgacttataccattggttggctttcacagtcagcttatttgaaatgaaaagacctgagagatctttcagatgagaagtcacaagctcaggtgcccagagttgtcagcaaagaccctagcagaagaagggcagttgaagcctgtaagaaatcaggaagcaggaaacacccatgcacggtctaaaggagcagctgcttttcagctccagtcttcactgtgttgtaggaatatgagcccagagttgccagatctctcaactccttaagaaaagctagatatacctatttttctgtgaaaacctcatgattttcaattgatgataagaaaaaatcatgcgagctaaacaagctataccactggacagatttggtccagggactgccagtttatgacctcctctcttgtctaatgagcccctcattttacagatgagggaactgaggcctggtaataaggatacttattcaaaatcagtgaaaatgtagccgggcgcagtggtgtgtgcctgtagccccagctaatctggaggctgaggtggtaagatcgctagtggccagccagggcaacaaagtgtaagactctgtctctaaaaatataaaaataaaaaagtagtcaggtgtggtggcacacacctatagtcccagttacttggaaggctgaggtcggaggattgcttgagcccaggagttcaaggttacagtaagttttgatcacaccactgcacactccagcctcagcaataaagtgagaccctgactctgtaaataaatcaatgaaaacatgaactatttaatgtcaggaactatattgtcttctctgtgctaccccaactggactagcacagtgtcagacatctgatggcagtttaatatttaggccgggtgtggtgagtcacgcctgtaatccagcattttgggaggctgaggcggcagatcacgaggtcaagagtttgagaccagcctggccaacatggtgaaaccctgtctctactaagaatacaaaaattagccgggcgtggtgatgggcgcctgtaatcccagctgctcgggaggctgaggcaggagaatcgcttgaacccaggaggtggaggttgcagtgagccaagatcgtgccactgcactccagcctgggtgacagagcaagactccatctcggaaaataaataaataataaataaatattggatcggtgaatattggatgttagaaacaaaaccaggacttggtttggccaggacaaatcagaaccttaaatgtttcatcttaaatgactcctttctttccttttctcctaagtgacctaccctaacttctatataggtagaatttggtctcctattttgccacctaggggcttgcttaaagtgagatttgattaataggaatgttctactgaaaacgcgagagcaaaagccttcaaccctctatggggcccaaccttcctgaaagataagtttgtctatactgggaaccctacgaccaacaggttgccattcttcttggcctaccagattaaattctgttcaatttgttttctatttattgagttcctgcaatgtgctgaggcttgtgtatggtgatttctagatacaggggattccaatgattccaatgagcctcgggacttaagcattgaatggggattctccaagcacatttcagaaacatttaatgattaatttagagaataaggacacttggcatagtctctctctctctctgtctgtcactctctcgcgtgcactgtctctcatcctgttgaggcacactttactttgtggtaatttcctttcttcagtttttgccttgagatttaaagttgcctgaaacacagaatcaattatcaccaagataagttcttccttttgacaacccagttattgcctctatattggaagacttgtcagcatagacaacagttcaggctctaaggaagtataccagatgccttttgtcaaataagtagctttcctgcacttatctttcttcctgggctctacaaggtgcttacctctgtgctaagggcccaggtgtttccaaaatgtcagtaactctccaaccagcaaactgctggtctcttgaaatgcttgaaatgatgtattaatattacttccacgtgtccgtgcatataatagtgataataatggtattcaccatttattagtgtcttcagtgtgccaaataatgtgcaagccatgttgtctaatgttacctcattgatactccttacccatcataatctttcaagatgggcatataattctcttgacgaacggttaaattcagcccggagagagatgatgacttgcccgaggtcatatagttgccttatgtataaagtgaatacagagttgcctgctctcaaagcccgtgccctctctactttcttatgaaacttgggtctccaacagcaattttgccaacttcaccagtgctgtgatgatggaaggaaagatgacatatcttttttcagaaggaaactcaaggggccattttaaatggtcttccnnnnnnnnnnnnnnnnnnnnttttgcatgaggctatgtttaatttcgggatgtcgtccttttctggtgaagataatcagacgtaatgtcatctgcaacctctctgtgtgcatgatttcataaaactggtatagcagtttattattataaaattagtatagcatagaacaaacctgggatgcaagccagatgaaatagacaatgaatagttatataaggttttggaagcacatgtagtagaacacaagctcactgtattttcttctcaattgtctgctgtttgttaatgtttccttttcaacatgattgcatctcagtttaatagcacttgccatctcaggctttatggtgccaggcctgacatagttacatcccctctgtgctaaaaatattgcatgtatatatttaaccgcagctgacatgtttagctaatgggttactcaggagctatgcgcttatataattaagtgatatatgtaattttgtgttaacacatttgccatgtgtgtttccctggtgattgcaacgctttattctgtgtaaagtgtgacattttaattcccgctgaacaatttcctaccttgatttgccttgtttttgtggcaggggattattttgcaatcaagataaaagcattatttatgaaatttctaggctatcccattactgggaactttgaactgcagatcaatctcctattttattgatctttgttaaaaatctttattggaatttaaatgtaatctctacattacagatttgctcagactttcatcggtaggcacatttttttaggcagctctgcagagatggggttccttaaaaaaggaatcctcaccaggcagtctgccatcttccccagggaaattttttctcctaggtgttgctgactttttcttgttgtaggggctctctaggagagccagtagcccggtgggcttgagagtcttggcaaaacaggtgagatctgtgtgtccacagacaaggtgggtttctgttaggtatttaggtgtttgacaatagctgggtctcagagttacacagtgggcattacaatgtgggtgtatatgtcttccccttattaatggtgatggtgacctagggaaggtgctggagataggaaggtgaaccatcaaggatagcctagccacctggccctctttagcggcatttatgttctccagtgggatgagcagtcagtgcagtttaacaaacatttaccagactctactaagtagtaccagacactgatttcaaaacatgacacagagggaggcatttgtttagtaaacgtttattgaacacctactataatgatgctacagtgatcaagaccaacataatctctttagactgtggtaaggtacactaaccagatgatttcagtacagggtgccaggtgccaggatcaaagcatgcttgttttttgcattttttcaaatttgttattaattattttaagacggagtctcactcattgcccaggctggagtgcagtggcacagtcttagctcactgcaacctccacctcatgggtttaagtgattctcctgtcccagcctcccgagtagctgcgatcacaggcgtctgccaccatgcccagctaatttttgtattttttagtagggacggggtttcaccatgttggccaggctggtctcagtgtgagccaccacgaccaacccaaagcatactttgtacaggtattgacaagggttttctcacccagctggagatgagggagagtaaggaagctttttgttttgttttgttttgttttggctgggggtggagacagagtctcgatcttgtcacccaggctggagtgcagtggcacgatctcggctcacttcatgttctgcctcccacggtcaagcaattctcctgcctcagcctcccaagtaggtgggattacaggcgcccgccaccatgcccatgtaatttttgtgtttttagtagagacgcggtttcactgtgttggccaggctggtcttgaactcctgacctgaggtgatccacccacctcagcctcccaaagtgctgggattacgggcgcgagccactgcacctggccaaggaagcttttaagcgaggagttagggcaggagggagaaaagctaaaaaagaaaaggtatcgatgtcagaggaagcccaggaacaaaggcacacaggtataaagctgtgtaatgtgcttgggacctctgaggcatgagttactgctagaaggtgaggacgatgctccctagcacagtggcctgtggtccatttcttcttgatcccagaggtcctgagttcccaaagcccttcctcacccccaggagggctcctttgttttttcagcccagcctaacaaaagcaagcaggtggcggttgttgacgcccaatgccagagcactttcctgatggctttgcaagtgttttgctgctagtacctcacatttgggtctgagcaaacagctgggagtatggtgcacagaagtcctgccagaaggacctgcgcttcatgcactccaagtgagctttcttgcttgtatgttttggcatatgaacacagtgggaatgtccttgtcagctcccatttgactttattaattacagttccttggaaagtgtgtttcagtaacatggtcttgggatgacagggctcaccctgcagagacccaaatggaggtattcagggcccattgaaaagccatctgctgccaaggctctgctgctgatctcatgcaacagaaaccagagtctgtcgcagctctgctactcactgggtgactctgggcgagtggcaggctctctggtcctgtcttttctgatgtggagaatgactagctggtgcccgaggttttcctaaagctatggaattccatcattttataaatgactccaatgacgaatcctactggcataacatctatggtttcaccaactcttagcagtgatctttggttccagattcatgtgaaaagccaagaaccgctttccacaatttgtcttgtcatgactctccggctccatattttaagaagcagtctacactagcccttgaatctagactctaattttttaagatacaaaggaaatcattaagccccggaatattagtagaatatacggcaatatggatcaagtaatccaaagtattagcaatgttgcaagaggctgtcacctagcagctctgtattatgtttccaggccctcccccactcatttccctgagccccgaggctgtggttaataacgtcaaaagaatgttttaaaattgcccttctgttgattccagagagttagggccctcacatggttagagtcctgggctaagagtcaaattctaaatttaattccagcctctatgaacatcttagtcccatatttcctcaccatttagagatgtttcagttttcccatctgcgaaatcggcataagatgccttgctccacagaaatacttgtcaacagctttgccgtacacaaagattggcattgtattggggcaaaatatcatttttcattccataataggaattaaacaaaagccctttgagaacgcaccttgtgtaaacgccctgtgcttaaaagcctgtgaatttcagaggtcagcaaaaaccgccccccttctttattatttttcttaaagctaaacaagggtaactagggaattcattttggaatataaagacatgaaagaaagggtatttcagcttgcacaatagtacaaagaagaacaagagttgtcatgttttgctaaagaactcccagctgtttaattttatagtaaaattactttaagaactttgctaattcaaagacaaaatcaaacaactgttgttgcaaaactgaacttccacatttgagtggaaaagccaatttgagattaatctgcccctaaaatcatattataaaaatacagagcatttctgtaatgctggttggaggagtggcttttatctgaagagaagacacataaaagagaaaaatggtacatttactggtagtaagatttaaaaaagtagtttatgttctcatgtactttgccctgacttctcccccagctttctcttaagctcttcagtctgttttaataccaggtttgtttgctttctggggatgggcctgttaggcaggaaattgttgaaaggcatacagcagaaattttaaatggtgtttttaaaagataaatacccaattgggtaactgactattaaatttggagttcagaattttttaaaattttatttttagacaatatagaaagataaattctgtacctatacttggttctataagtcccacatgttgcctattgtcagaaacaaactgttccttatttaaaaaaaaaaaaagaaaagaaaaaaagccagtttttcttccatattagggaattattcagacttctttccttggttcctataattccaaaccagttggaacatcagtctatttttggtttaaaggagcttttaaaatgtgagcatgatttttttaagtttctaaatctcataaaaatcaatttgccacatatatagcagctatggttgtaaatatagtgaagtcattgtattgcagaaagacaaagttctaatttccatattacaaaccccacctaccccaccttgtccaatctccacataagagggctgaaaatgtaaattctaaaacatataaaacaacataaggttgtcatttgtggctgtttctatccaagatgaatgttgtcacctgtattggagtaaactcttttgttagtttctgcgggtttttttggtcgtcccaccgcatcccatcgactcaccacgagagggcaatggagcgtttgctttcagctaacaaagctagaaatggttttaatatcagctaagtgtttgaacttgttaaggatttatttctccaccttccgattgccatacatgcagcctccgagtttccactaacagcgaataatgatccaaataaagttattctgagggaaaatatagacagactggtgcagacaagagcttttgcccaaataaggatcccttttgtgcagaccccatgtgttagataaccatcaactgacagttgctcatgagttaataatgttggatgctgaaatatgcataccatgtgctataaaagagtttggaggacaaagacaaatacttctatagttagatatcagaaacataccagaggtgtgcagattgcttcgtggtacataggttgaaaccgcccaatcatttcatcaaaattagtacaatataagtatgatacagtagaatgtatgatattgattgcatgtttcattgatgttgcagaaattttggtctaagcctttctgcatgttactgccttaaatgctacagcaactactgccttctaagaaaagaaaatatttcctaagcttctttctatagccaccattgttgctcttttatttttaccataggaacccattttaccatgtgtgtgcagccttttgattggcatgtagtgtttggagggctgttaatgtctagttaggtttctgtgttgctgctgccacaggaatcaaaaagtgaggaggtggagggaatcagctttgattttggctactataacaagttgtttgggaggatgggacacagggcaaactgagcaccgggcagccgccttctcagtgatgcctgatggttttttggtgctaagaatgattgcggaaagaatgtttctcctccctgcccccagagttcaaacctttttgttctgttcaacttttctgggcttattggaatgccagtcttcaatgaataatctcatattttgtcataaatgggacctgaagcaggttggcaaagccaatgaggctatgcccctgcatttaggcctgactgtaactgacctctctatttattctcagatgaaatgtccaaaaagtcagaccattaacttactcaatagttggagattaagaagtgtctacttccaagcaactaaaatcactccagctccattttctcctattcagtttgtactggatgatgaaaatggcttacattatacccgacccatattgacagcaggagagaacaagtcatgaaataaataattagctagttccttcccctctctctctcccttctcactctctctctctttctgtctcttctccagtctgttgtcaaagcttaacatttactttgacatcttagttaagaaagttaatgaaataacatcttcatcagggccatttagtagccttgagtcaatgattaccagatttgaattttacagaagggagacctcagcttaagaaaaatttttagatactattataacattatatatatatatgtgtgtaatgtgtatatataactatatataacgtttttacatgactaccctccataacagtgaataaaatcttaaatgtattgaaacattgaatcgtgacttttgctgattattctagcttcagatgttaatcttgttctgtctgctccttaacacatatttccaagaacatatctataatcataacattgaattattgactaaaccagcatcgcccaagagaaagataatgtgagccacatgtaatttaaaatattctagtaaccacattttaaaaggtaaaaagaaacatgtggagttaattttaataatatattttatttaacccagtatattcaaaatattatcatttcaatatgcaatcaatataaaatgttattaatgagatattttacttttattttgtattaagtcttggagatccagtgtgtattttacactgcggcacatctcaatttggacttgacatatagtatttcagatactcaagggacacgtggctagcggtgactgtatcagacacagcaattctaaatagtcatagaaatgttttatcttacagtgaaaaatgtaaagaagctgtaacctcttctgggttcattgttagctttacattagggtttctgatggtatctgtgtgctgtttctctatagtgtaacaaaccctccctccaattgagtgatcactctagcttgccccacggcttataatctgcccttagttaacatgtcaccaggtattatcaaccttgttgctgcctctccacgcccactccaggccccaaagctcttctcattctgtaccctcaccccaccctgctccaagacacacgctcttctatacaatctgtgagtttgcatgaggttcttggtaccacagaagagtttttaaagtcattttccagtatcttggctccggtacctgcacaaacaaatgaagctcagagaccactgaggtacttagttggggatggtgctggtgccctcatagggaggaagggtgagagggatttgcctgaacaaagaaaaatgtctccgaatctcagacaaccaaaaatagtcatctttttacttttaagtaaaagactatcctactattcacattattctttctgaaaggtataaaagcacaaagtgagtgaaaagccccctttctgtacaaattcctttttggatctttttaaaagaattgggagcctatcacttgataactgtttcttatgtgtatgtcttttaaatattaaaatgtatcccatgacatactcatccaagtatgtcataagttaaatatctccatgttaatccacatacacaccaaaacaaaaacaaaaacaatccatctcttttacttatttccaagtggggaatgttttctgtagagaggtagcaaatcaattatcctcaatgatgaaatggaatatctcatttccaaacctggagaaatggctgaacaagaatgtcctgtttacaaatgagtttaaaaactgttctgatatttactgctcttacaaggctattcagtacaaaaatgttgctttcacttctgtgctgtcatgttcaatagtaacaccaaagaacatatcaatcatagactagaacgagcagatttattgattgtaacaaaaagaaaaaagagagagacaaaaaattaactctctttgtttaagaggttctatctgtacaaccttcagaaattgtggaaatcaaaatgtccttaaaacacatttccagagcagatccttaaacagccttaagaaaaaaagacaattatcttgttaatattatatttgtattatatagaaccataccaagaaagactaaatctgtatttatagaagagttttcaaaaaatgaaaacaggagctatttcaaagtcataagaaaaaaacacatagtatagcattgaaacaacatgcttattctcattgtaatagcttctgtgcatgatctccattgagagaggagcctggggcctggaaatggctcgtggacacctggcatctggagagatgaataggagaaaggagttgccaggtaaatgtgaaagtgggagtttgagccttgatggcattttgagagtccacttttggttttactgaatttgtgacttgacaggaccttgcagctagctggtgggtggcatgggctgagaaaacagaccctttgcgtgcagtatcagctcctagatagcaccaccgccacacccttaggtgtgagctaagtcctaagatgtccgctctgccctgatgtctctttatagaatatgtggaattctggctgtgcgtcgtggctcacgcctgtggtcccagcactttgggaggacgaggcggttggatcacgaggtcaggagatcgaaaccatcctggctaacacggtgaaaccccgtctctactaaaaatacaaaaaaaaaattagctgggcttggtggcgggcgcctgtagtcccagctactcgggaggccgaggcaggaggatggtgtgaacctgggaggtggagcatgcagtgagccaagatcgcgtcactgcattccaacctgggtgaaagagcgagagtctgtcccaaaaaaaaaaaaaaaaaaagaatatatggaattccaagacaaaggattctttccataggctcctgatcctcaggaaaacctaggctgtggtcttgtccatgctatggtatatagaccccattatcccaaagatgcataggctcttgcacagcagccatgagctaccacgtccacttcttacaaggggaccctccaccaagaatggtttcccctggaggatattgcagacagccaaatagaccagagagaaggtgagagttggaaaggtctggcatagatttcaatctcttttcctatttccagaattctccccttagagagtcaatcctctgaaaagccagactgtctcctcactcctagattcagctcccagattttccccttgtttctcaagcagtagtgaaaagcatctataatccctttcttctttgccagtgtgtttgtggacacccctattatacagacttctagaacatttttatattacgttggaattcactacatgatttcagaacaatatttaaataacgtgatcatttacatttctcccttgcctcaagacacagtgggggaacaaagatagaaatctgcctatcactgctggtaaagctgacttcaaaaaaggcttgcttgtgttttaatggcaagaatgcatggagtcacatgctttcaaaccaattagcaatacagatgagctaggaagtcctgttccatttatgggttgggggaagggtagaagtaaaataatctgtttttaagtgtttctgagaaatgaagacctccagggcagagagagacggcggatcaggaaatagctatgcaaatcacatgcctaagaaattactaaaaccttgatcaggagcattaataattactccagcattcacaagtatgaaacagagtgagtaagactgggcatgtattggaatggattacaaaagtgtttacttacatggtttgttgagcagtcaatgaagtccatggctgttttggacttaaactgcccaagcaatccaggtatagcaaaggcagtaatacattactctcattgttgactcttggggctctcaatgattttgacaaagaggcaaagtgacgacctcatatgaagccagcttctttttttttttttttaaatgttctttctaacaccacaactgctcacccttccaggaggaagaacaagcacttggattctgtgagagcagagttcattggaaatgctaaattgtagtttgtggttcaagcagtgtaggggtatgacttgggcaaaagcacacttggaaactcaaagtccaggtctttatatcgcatgatatccagtgtgatgagtgtaaaatttctctagggcacatccatccattagtgattggggttgtctgctcttgatgacatttgaacatgaaaagtgtttaaatctggctctagaatttgggttccagactctgggttcatttgctcttttttttttttttttttttaagagacaaggtctcactctgtcacccaggctggagagcagtggcacagtctaggctcactgcagcctcaaactgctgaactcaaataatcatctcacctcagcctcccaactagctaggactacaggcacatgccaccacacccaactaattttcgtagaaacaggggtctcattacattgcccaagctggtctcaagttcccggtcaagcaatattcccacctcccaaagtgctgggattacagtcatgagccaccaccagggcttcatctttttaatgcctttatctgagaaaaaataattactctgaagaggaaactgtcagaacaattgccaaataatgaaacttttgcagtattgtgtttccatatctattgttcaaaattcatcatcagagttagaacgtcgcgcaggatcaagttgtgcttgtcaatggcccagtgtgtttatatctcatacaatgcaattgcttctcaggcatttctgttgggtgtggaagactgattttgggaaaacagaatgaaaataaacttgaatatttcctaaattcgtatgtgatcagtgttttgtgaatttgtagaaagattcaaacaattgaatagaaatttaataccaatggtcactatatgaaatataactgtggatttgaaataaaaatttcagggacttatttatgaatttttaaatattggctttaagttaaagccaaaatgaggtctgagagcttctagttttcttttgttcccccacatatttgaaaactgaaattctgtaagagattatctgtgaaatgcctttctttcattacacccataaattttaggagtggctttgatcaagccttctgccattcttggtttctaagtcttttactcatacgttaataactttaaaaacattcgttctatttttgttgtaatgaaagaggaagtttccaaatagttaaaagggaaacattgaaaatagaacacagtaaatgataactaaattagggtaggttactcctcccccccgaaagagcaatgctccatgctgaaacttgccagggtatttttttttttttttttagacgaagtcttgctctgttgcctgcccaggctggagtgcagtggtgcgatcttggctcaccacaaccaccgcctcccgggttcaagagattctcctgcctcagcctcccaagtagctgggactacaggtgcacaccaccatgcctggctaatttttgtatttttggtagagacagggtttcactatgttaaccaggctggtctcgaactcctgaccacgtgatccacccgcctcagcctcccaaagtgcccagccagtattttaagattattgtctgaaaagaaaatgtgccagagaattgatatcctcagaggaaaagcattacagaaatgcagggtattatcagtaacgcatactatacatagaacaatgtttgtcttccctaatactgtgatcagtggagttttgttttctggctcgtgtttaaaagacacacgcaacttgcaaatcgaatgagttaacgctccgccgacttctctagacattgacctcgggggtcaaactcttaggaaaattgtgctggttttccattcccctgattccagtccctaccaacaagtaaatcctatctctgagtggaagctcacaaagaatttctcgagagaatatgtagctgtgttggcaacaagtctctctgcaaaatgggaaggaagagttgttaactgatgagtcaatccagcttttatagcagtttatctatcttcgtggtatttccaagagcataaatgctattaaaaaaaagagacggtcatgacaggaagaacacagtagaaaaaaacaggaacatttaagccaaaagcaatttactttgccagtaactggttacatttccctttgttttattattattattgcaagagttggggttgacataaaagtttcccacacctgcactgccctgccatgtaacttgtgtgaacccgtagtgaaataaatatataaacaaattgtctgcaactcagcttctagaccctttaagaaaaacaaacttgttttgctatattgttgagaaaatagactataattcattaatatttgaaggagtttaaaaagaaaaaacaaacatgggttagctgtcagagtagcctggagctctggaggtagcttgattctctgaggattaacacctatagaaatagcagtgacttcacaaaggtgaatagttgttaatttcttggcactgagtaagaggaacagatgggcagtcagaggggaaagattttttttttaaaccacagagatctttcactgattaggcagaagagtcagtggcccactggttaaggagggtaatatgtagggctctctgactaagttttattggccttagtgggagtcttgccacctactgctgggtcaagactaaaggggaccccactcgctgtcaattctgtcggacagtgtttcctgtctggggtgggctgcagcaccctcgtgctatgtagtacttgagtgttttcatttgcggagagctccctggtgactgccagcccaagttagtatgaatacttcattttgaggcaatgtgtgtgtgtctgtgtgtgtgtgtgtgtgtgtgtgtctgtgtgtgtgtctgttagagataagttgcttaaagcaggggctctggataaagtccagttgcctgtgttgaaatccttctgctgccagtaaccatttgtatggtctgagacaagtaatttcatctctgtctcagtttcctggtctgtaagatggggataaggatcatgccttcctctttggcttgctgtgagttttagtggaattattgtatgcaaagcactcagaagagtgacttgtacagagaaagtgctcagaaatggttagctactattattattcacttagctactcttattattcatgtataatactgaaaacattcatgcaaagagcatttactgaactctgtgataagccaggccagtgaatcatatacacacgtaaaagtaacagtacgtctattgctttgcactgttttttttctaataaaactgactgaagccagatatgctatcagtaagggtactgctctctccctagcagagctttttcttggtagagatcagtctcacctaaagaacaagagctggtctaattctggagtcttaggatttaggttctgtcagtaagtacatagcactgagctttcaaggagagggcaggtgtaggtccttgcagggtggctggaaggaggtggggctgtctcttacatgagtgaattaaagtccgcagacccatcccactcctgcccaccagcacaccataatgcacctgttttcactcactgacctagcaaatgacagattatgactctagagggacaaagatgtggcctggggaccagaatttttgctgtccccaaagccagtccttcaataccaaaactttacctggagtcttctgaatccaaaaggtctctgattcgattgcagaggcacctacccagtcctttgtgttccattccccccaccccgtactttgaatatttgtgctcttcagggtgtttgtgcattgcatgtggggactagattatagccttactgagataccaaaggcctttggtttcctgtctccattcccagtgcaaactcaagtcaccagtttatgtttccagagcataagcataagtagtaaaggtgaatgcagttttacaagtgcccagtgtgacaagtataccacgtgtgaggttggcgggaccagtctatgaggacaggaaagaacagtatgtgggcatctttatttccattagtcactttttcattcaacaaatacatgttatgcaatgcagccttttgggtgttgtgctgggcagataaaagacacatcccacagggtcttgcccttaaggattctccagtctggtataataatatgccaaaaaccacagctaaagtacaaggagtacagtgatatgttccataagagaaggagggaaaaaaagttcagaggggagagtaggagaggaatttgattttgagtcctgaatgactggtaggatttgcctaaccatacctgaaatacgcaagtacttgccttactaagaacaaagggctttttctcttgatcaaatcccatttagagtttacgtttgtgtgaccagaatattaggtgctagtctgttctaaatttgtaattctcagaatctgctgggggagtacatgtgcttctctgggttctgaaaacagctcaaagaatggagaaaataaacccagtttggggatgacttcttgtcagttcccggaacctttgcctttatttaaaaacagcatgttcgatgcaagttctgtcgaaaaggcctttgggatttgaaagcttttctagaaataaatgccttttaggtctaagtgcttttcaccaaaatgctaggaagggaagatcatagtaacaagtcttagaacagaggggatattgttttgtttgttttaatgaaatgcctgcgacctgctaccccaagttttgtttgtcagctttctgctcagctgttattttgataagggacttgaaagtacatccttccctcgcggtcattaaagtcttagcacttgggtcagttgtggaaacacttctgtgctacacaaagtcttctaaacaaaacaaatagtccatgccctggctccaggctgcggaccgtgtcaaattcatggaacgtggcatcgtgctctgacaaggagagcaagaggtcaggatccacaaaacaggccggatgaaatcaccatctccgtgcggggaggtggagagagcagagccctccctgccagtctggcaactccagcaaagtcctcaggctcatcccacacactcggtgctagtcactgctgtgtgtttacatgagtaatggagctgccgggggaggggagttgtaagcagagcgctgagcctcgcagctcgcattcggagggaagctgacatccacaccaagtcgagacttccagggatgtggccggggagcagtcacatgctgtagctttcatgagcacaggcatcagtcaggcagatgtttgtcgactggaatgggtaatcgctactttctctttgcttgatttttgtttgtgagcttgtttacctttggtaattccaggctggctttctgggatggactttcagaccagcgtttaggggaatgagaggagagagcgggtgtgggaaggggatcctaagccctaaagcctctttttaaacttttgcctctctgattttaaaggcagttctgctttactgagcttccaccaacagtaaaactgttatccggaggagaaaatcaaattagtaggattaattgtgtttgtaaaatgagtacagtgtaaaaatgtcctaaaaccactggttaactgcctaagtaagattaacaacaatcaagaaggttcatgttgtttagatttgacattgtcataatcactccttaagtaataaaaagtgtgggtgccttgaaaggtctgaaggaaattgtttagggtataattcattagcttggagtcattctaggggtggttggttagttggttgtttttaattttgcttgacttgggtgactgatgaagttaaatgtgaaagctgatgccggatagtcatagctctcaataaacagcagccttttccccctactttctgtgtagatcttaaaaggaacaagctcagcatcaaggatgaaatagaactttgatttgtatcttgtcttttcaaaagtgtaacccccatggaatcaggctaaccccagtgtaatctttggatgttatattaaataagccttaagatcttcataaaaatatattgaaaaggaaaagacagcatgctgatttaaatgtatctgtcagatttgttgagatttgaaacttgctggttgcagtattgttagtaaatatatgtaataatgttttccagcttgctgttgtgaatgcccctctctctatagctatctctctacttatctgtatggtaatttgagagaatgcccttgtctctgaatattttgtaaaagagatgttttcaaacatttcattactatgataccataagggcaggcatgtcacttaggtttcggaaagcaagatacaaaacaaaaaccaaagattgagctcaaagcctggctcagtttttcagcaccaaatgcttcttgtctaacaacgtggaaggacatttttcttatcatgatcctttagagctaagagcttcgtgttacttctattaattagacatgttaaagctaaatagattagctttgggaaacgtgtacagaaatgtatactctaccaatatgcaagccttcagagagagaagcatgtaataatgagggctgcctgccacagatctgtacatttctctgaacaattagaagggatcactgtagtgagattctgggtctttaataaagaaacccatgcaagtgaaaatgtatatcaattgttttccatttgttttcagcgccaaatcttaaaggcagaccacgcaaaaagaaaccatgcccacaaagaagagattcattcagtggtgttaaggattccaacaacaattccgatggcaaagccgttgccaaggtacggtcattcactccacggtattcatttcgttgcatctttttatttttgctttttctctttatctctctgtgcctgtgtcttggaggcagttttcaattcagcatctgactttggtattcagagcttttgaagctctatgctgtgcctgttcctgccacctcccttcccctggttgccgtgggctgggggaggtaggcattttgattagtcaacagaaagacttcctacctcccagtttggcctgttatgagtaaaggacagatgattaagcacccacgtcattgaggctgagatttcatagtgggtgacacaatgacatagtttactctgcttgtgtcaaaaatagaccagctgaaccgtcctctttctgaatgtgttcatctaaatgtgttttggagattaacagaggatgaaattagaaatagctagaattaatctttttagttatgtatttttcaaagtcacttctaatttacattagactaaaattaaagatacatagcaaaatatttagatgtatacatatgcccacaagcatttatatacttttaaagatctctgttaacatagaatgaaagtaaattctacgctgttgttcaagacccaggtcaattttttacctaagcattctttggaatcttgaaagtgcatgcatgcctgaagtattttgcacgacaaagggtaaagtatcactttatatttttagacttacctttctgacttttgtgggcttgggtcagatttccatggttctgtttactgcatttaggtgttatttttgtgctaaagacagcaatcgtccctttaggattttagttgacgaacagatttcaactgacaccagtttccagatcaaataactaaacttctgaaaatgggaccattttgattagtggtgaatttggaagagtctgatgtagaaaaaaaaaaacatgagttaagttctgtgttgacagtctactgtttctctgccatgtactctacctccttcccagtgtaatgaagtaaatcttagactttcacattctaaaaaatcttatctttaagcatcattgtttcattaggaaattttaaggacttttttgcttagaatttcttcatacttctaagattccaaagggttaagaagagatcaaccagtagaaatgtgtattttccagtttcttgctgaaaacaaatctctttccctaaagttattgttgttttgcacatttaactttctgcgaattaactccacatggatgccatgaatgacattttcttgtaagttggacacctcagccctagaactatctacctaggactttggtttccatcgtcttgaaggatgtcagcaggaacagttcattccctactatgtagtttgcaagatcctgcagaatggcgcaagaaggtttcaagaccataacattcagcagagcttgtactgcccatgccttctgttggtgcccagcccatccttcttggttgacagcatttgtttactccagcatattctgtacctgagcccggcaggataaagctccttcccatgccacttggaatcaccaccaaggtctgcttctgagaattttacagaactcatacaattgatctgaaagagcagacctccaatgtttctttccatggaaggcagctcagaactcactgttgggttcacaaagccgagaagaacaagagcctgctatacagatgggccgtatttgatgttcactgacttcttaacaagaaggatagaagtcagtcctgggttttctaagtgacgcctttactccatccccgcaacagtgctgcccgtcagaatctttacaaagagatggatcattcttccaccgttggtgttcaatggtgaacagatgaatgtcatgctgcagtcagctcctagggactggtctaatggcttggctcttttcagagtcttggattacagtcatgccttggctgcttccagtgggtctggcaagaccacttaagcaaaaagatcagtaggtatgaagtgtgacgagcttgtctgttgacaccaacaggcagatgtaaaatccctacagaatgaacaagccacatctgggatgaggacagtcattaaaaagcatgtgtgtcttaacatggtcttttctcatgaaacactgcagtagagattatgagtctgtgaccatctaatcatctgttgaattgaaagcagcatcttagaggacagtgagctgtttgactttgtgaccaagacccatgtgactgtttctttttaaaagtgcctcaaacagaccatttctaactaagcaccaacttcatgcagctccacacagcaaagctcttagagtgggacccactgggtttgttgtgttcatgactggaaaaataagtcaagtgatttgccggtcgccatcaaaacgttgcactccctcaatgagaacatgaaaaccagctttgcaagaccatgttttccaacggagagagaattacatggctccccaaagacagcaagtgtcacgtggggaggaaactaccagttctttgaagatctcatgactgtgttcagcccaaatcctgccatttttttctggaataatcttaaagcagtgaacctgaggcccaggcctttcatagagtgatctataacagaaatcttcatggcataggaccctaataaaaggcctacattgatagaaggcaaattatttttaatatcccgtatgcattttctgaagggcagaagtgtattacaggtggtttatattctaaaaggaacacaaaaaaggaaactgtggtgggaagtgtgttcatttaaaccataaacatactttctatatttcacaaatgtgatactttcattattttcaatatttttcctctcatttggtcctcagaactattcccagggattatcatttttgctttactaaggtagaaactgagggtcacctagcaagttagcaaccaaaccaagattagaactctagctttttgtattgctggttcagcacatcttactgccccagttgaaggctggattagttataactcaatcccgtggaaggatgtggttaatatcaaataggtggtggatcattgaaaacgttaaatgttgattctttaattagcacctcctcaatcattttggaaaccccaaagtacttagtgaactcaacaggtgtatggtgttcaggtcaggaaaaacagatctagtaattaactgtcaccatcaaaaggctgggctttcttaggtcaacatgaagactagctcccatttccactaccacctgcactgtaataatttaatagattgaaatgctgagaatgctttgggtaaatgtaaaaacatacagaaaggaacttgatttagtcctacccagaatcagaataataccctaaagagctcatttatcttaactgaaaaaaaaaaatatcaagctagaacaagaaaagaagcttctgtttacttgttcacttcttactaagtacctggcctccccaggagcagcatgctggcaagcccactgagattcaggacagagttcagtaggcagcagcctggcttcatttggagcctttgctatgtagcagggagtctgggttactttggacctggttcatgcacccctctgtgtcttctttctgtttctgagtgtttctacacagatgaggaagagggttaagcagctctctacacaccaaggagctcaaaccttattctccttttaacagtggttcttctgacctaataatataggtagttggcccattatcactgcaaatttaagactcagtcagttttgtacacaaacctgagagatctactcctttatgttataaaattggggtttggagtgttgatctaaagaatatagtcttgctgccagaaatctgctattttggatcacgaatatcagcttaatttctaagatacagttactctgtaacacttggctgcatttacttgttcaagctggactctcctttccagaatatgggttctttgaagggcaggagctaggtctgtagcatgtctgaattcctaacaccctggaaacaagcgaagcacatgatagatttttaattaatgttggttctttttctggttattcactgtccctctgttctcatcctactcccggatctattacccattctttcttccttgctctgtgacccctgaatgttgtatcattgggctccctcatgggctggctggcttctgcttgttcagccaatgggagacacctaacagatcgcannnnnnnnnnnnnnnnnnnntggaattggtagcgggtgattacatagagagagcagagactcgttgttcagtgaaatacggtgagtgatattatgttacgatttcaatattgcgaagtcgtgatgctcagagttgcgttagtaatttagcaagggaaggttaagtatttctgtaaattgatacgtactgattgagggccgatagagagtaagagccttgtaggaagaatttggactcgaagaaattgtccctgttaggtgttgtcttaaagaggcagaaataatagtgtagtggagtggattggagtcggccctatgcccaagttagtaagaaagagcctccaggtttcacctcctaacaggcaggaatggatctgaaggtttggggctccaagcctcgaagtaagaagcccctgtgactagaggagggagcattagcgggggcccttctgagccacataaatgcggcaagagtgcatcacaagttgtgtgtgaaagactcagtgtgcccaagagctaccaaagcctatctgctttacatactttaaaaatgaggtaggtacttccaaaccatacatgacctcactaagctctagtttcctcaactgtaaaatgtggctaaatatctcccttttacaattctcaggaacatgaaggtagagtatgtgaagcccacagcactgtatctagctcattgtaggtgctcaattgaaaactgatttccttcccctttgctcaatatacaataggaggaatggagctccttgacacattggaaaccccctagatttgtcttttgcttttcatttgataaatcacatttctaagtggtaggtttcgtaatgcctggtaataagataggctttttaattagaagtttgttttcattaccaatttaatatttgtattaagagtgtcagaaaagtataacatttaaaaccataagccctaaagtaaggctgcctgggcttaaattccagattccccacttactaactagggcatgatcttgtgatgttgtacatgctgctcatcctgtctacctccgtttcttcatttctaatacgaaaataataactacctcattcgggttttaagtttgaaataacacataaacagcgttgagaatggagcctggctgcccaggaaacactcaggaaggggtgggaggcaatacaaattaaaactggagtgatgttatgatttcaagaagccattaaattatagatttcatcagaactttagatccaacagcctaaaatttggcagtgaaaaatgatgacaacataaagtttcacgggatgttcgccttcatataatgttagagagtacaaaatctacatgggaaaattgttttagtcccatttccatagccccttaaaagttaaaatcctacctagaagccccattgaatcagtttcagaggaagttttatctttgcaggaccagtcgaaagatattaaactgtatgtgttcacttgagagaataagcaatgaagaactcctgcagagaatgtactttcctttactaaataagcatagtcttttatgttcttaatgcttaggaaggaggagctgcagggaaagaaaaagggttcgaaatcctgtaatggacagcattgtagaatatgtgggacatttttattcgtaacatttccccagcacttgccctcttctctcccgatgtcagttacggagatgtaaagaatattggaatgtacacattccccatgggcacacttgaactcagagtctgaccctttgtacttcccccttttacaattaaaatagctcagcaacttagcgttatatttaacgaccatcaaagtcctcttgtagaacatggcagtgaggagggaaagttaggttagccgctcgatatgccaagttccctgtctgcctacagtgtggaaggaagaacatctggagactttaccgccttttattttttaattatggagctttatactcactcttcttgggtttttagctgacctctactctttcttttgtggcaagttaacatcttattcttagagctgactgataaagcaagaagccctcattaaacagtgagatcttttgtttcctactgagggtgtacccccgcatcactcttgggtggcaaacagcagaggccttgctggtattgctgatgccagcatctgctggtattgacttgtttttcaaggttgctggagagaatagcaacaagagtggtttactacaaagaaatagacttgcctttcattttgatacaaagtataaaatatggttctatttgttaaggaggcagggtttgttcaaggacattaactgatgcttctccttaagaaaataaaatgtattgatatagagagacaaaagaatgtttctaccagatgcaaaggctatctctcatttcacatcaacatacttgtcaggagtctaaaagaagctggcatagtttggcaaactatgacccactggctggcaatttctgtcaataaagttttattggaacacagccacacccatttgttaacatattgctgatgcctgctgtcctactagtgttgaatagttgcaacagagactgtatgacccagaagcctacaatatttacgatgtgaccctttacagaaatttgacatcccctggcctcagacaattcatcttcagtgatgcctctgaaaagctattaaaagcagggataatttaccggttcacccttagcactcactgaaaagtgttgctggctctgtcactagctatgtcttggtaagcatcctggggctgtgcctcgtctgatgtggtatattttcccttttccaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagagtgagtatacttgttttcgtttctgaattatcagagctgctcagattctttgaattggaaaaaataattttgactcaggattatgttgaaatcctaatctggggatagtgctctctgtttatactaaatccataaatgttccaggccaagaattttttccctgcctttttccgctacattgttcccttctgggacagttgcagtgagatatttataggcttgaatccactgattatgactggaaatagacatgttgaaagtttctcatttgctgttttgtcaatcttgagtgtctgtgacgcctttcttgtgagataataatatgacgtagctttatcaggcacagatgttgcctgtgaaaaaaacagcttttaaaaggaggacatttaaagatggacaaaacaaccacaaagggaaaacacatttcctaagccccaaatgtgttaaaatataacaaaaatccaacttcagagaaaacaagaaatacacaaattggaacagagggcctaattttgaattactttgacatgtacatttaaatataagtgtcattgtatatttgcaaggagaacaggaaactcatagccaaacagaattccaaatcaaaagagaagaaatccagatcctgccttgattttgcaaccgaatatatattttgcctctgtctggatttagtggtgcacaaagcgatgagcctctggcttgaaatagtattttctccaaatgtatcttcgtagattaaaaccatgtgtcattttgatgaagaatgtcaaaactgtgtgttttacataacaatttacatacctaatagcaattggcactgattgcaggagaacactcgcagccattataaacttatataactacgaatgattacaatgtttgtctgaaaactggttgcttgaaatagaagtaaaattaatgtattatgaacagctttgttgcattatgcattggttcagattaaatcaaggccgaggcagggctcttgatagctctgaagtagtgcaaggttcaatgaggctttgcgaacatgttgtgtcaaagagcctttaaaaataaaaatcattttattcttcatttcccttaccaaggaatcacttgaagttcaattttcccctcatgtaaaaaaatcaaatccatagcagtcccattccatggtgtttggtataaatgaacagggttgctagcaatttggtatagttgtttaacagcataaacatatacaaactctgcaaagagaaatctgtttgaaaaaaatatatttgcaacatcacacaggccagttaggggactaagtgggttcatgattcaattcctctctgaatgaatgtcttccttcccttgaatctgttgtatcactgtggcctccacgtgaaatatttgttttcctactcactgccagccaccacatgttggtgaaatactgtatgaacctttaatatagtgctgccatcagacattctattaagaaggtaatcgtatattaaagtggctgttatttattgattatggagagttcttatatgagagaagctctatatattactgtttaatcaatggcgtctaagggtcgaacaagaccaaccccagttttgagagcccatgctttttcccaaagacatctaatttagcttctcttgctctgctgatgacagtaggactaaaactcttgcctttatcctaaaagtagaaccatttttgtagctttatgactgtttcttaagaaatgttttaagtggtaataatagattctgttgtcaaatgccctttgggcaaattgtttcctaagaacttagctctctggggtactttagtatttctttttttctctttctcgttgaaaaaaaaaatgttttaattgacatttcttggaagtatgttaatgcaatgcttatctaaatacttattgtccctctaacagttaacctttggactatgtttcaagctgctcaaaaactgggaggatatgaaacagtaagtgtttaagcaacttaaatgaaataattttgcaatctaacttttcccctctctttgaccaaaatggagaacatgcaagggcaaaacatcactgactgccttttcaaatggctctacacttttgggggtttattgggccgctttggaaacagtcccaattagttccaggtttggcaaaattgtaaacttgtcgtaaaaactacaagtggaaaacatatgtaactctcccctgtcagggaaattagttgggtctgtaattttttcccatgttgagaaagggctattattgtacaacaagccaagattgcataaaagaaatttcccttggcaacatacctgacatctgttcatgtctaatatgggaaatatattaaaggctttcaaaagtaatcagtattggccattaaggaatagaatgcagcagaatctcctctcattctagggcaaagaagctttattagacaagggtcagtgctgcataaacaggaagttatcaaacttattcggaacaggctctgacactctttatcagctaattctaactgacagcaatgggttatttttagcccacaggaaaatttgatggccacggatttttacagcatgtattttgaaccaatgaaacattacagcaacaaactgagattaaaatctttaaataagaaagagctgcataaatataacccacagagatgacatctgtaatataatcaattgacataggaagatgttgtcattgggaatactttctcctccacacaatgatcagattaagttgtgtagtttcttcttgcaattgaataagaacttattttttcattccctgagaagtaatctgggatatctctgtaccatagtaaaatgacagtaagacacacaaagtcaagaaaatgaaattcattttagcccaaacgtaataaccagtgcttcttgccagataaagcacattgttccacaaactaatataatggtttgatgtgcgggtcttgggatggggaaagaggacaagcattatgtggttcagataatctggtattttctgttgagctatctgctatgaattccgactaaaaattctttcatatgaataatatgtgcttgtaatatgtttcatatatggcgtatgtacacatgtttataaagaaatatagtcacatggactacatataaaatgtgcatttcatattcataaatttacttgaaatatttattttatcaagtgacctatgtaaaaatagtaatttttcacttagtggagtcttttgataggatcaggatatgaactccttgccactgtagctcatagtttatggcaaaatcttgagctaattatagccctcattcatgtaaaaaaaaatggtaacttattcagggttagtctcataaacgtagaagtcaacccaataggctagactttcaagtctagcttttaatgtttagaataggaatatacgtttttatatgaaccatgactgcagatagttatatgatattgaacaatattatgaaacgtcttttcacactctggaactttttgttattcactgatagggagagtgccaacaatttcacagaatcagtttttcctgcttttgtgtcttctgtatcttcacaaagattttttttccatgcaacagcaagttgatgtagaatgtacagaagaaagtttaataaatttcagggcatttgcagtactctttgaacaaatagtatttatccttttgttggatgaatgaatgaccacacaatcagcaaaacacctgaccacatatttactgagtaccttatgtgtatgaggcattgttttagacactgttagatgcaaggtttcagtcaggccagtaatttcagtccttaagttgcttaccatccaagagagccaataatgatcaaacaaggtggaaaaaggtcagtgccctacacaggtaaagtacttactcacgtagagatgagagaaggaaggcttgatggctctgaggccatttgggaagaattctggggaatggataaaatttagacatgaatgatggattatgccttccagaaagagagaatgaatcaaataagggaaaatatatggaggtagaataaggttgggcatggagagtttgaaaaacataaaatagagtgatgaggtggctgggacaagtggccctgaagggaagtttctagagagaaggatggagagaagatggaaccaagtgaggaaagtcctccgatgctagctccctgatgttaggccttcagatgctaggccctttcatgctgagcctccagatgctatgccctcccatgccatgccccaaagttattcattaggctgtgggaactatggaaagttgccagttccccatctctggtgataagagtcgcccctctttctggtactgtgtgggcgccttctcaatgggaaatttatgccctccttttaggcagataggcagataaggggagggcagagaactcttcctgcatctgttggttctctgttgccctcatctcaaaataatctttatgccaacgtggcataatttaggggtgacatattctgatccccttcactggggctggggaatatggaggatcaaattggcatctgctctccatctggtcatgaacagaattttaaaaggcatttctgcttcatcccttcctcatttccttccttccttcttcctttttctttctttctttttaaatgtttcatgctatagattggccctgcagatacttcagtttgccaccactattctacatttaagcttctgaacctcctataagtacagaatacatttttctcttggcatattttgactaataaaactgtgagatgttcaatgggcattgaattttgaagtcagtccaggagatgtacaaataatatccaaagtctgaaggcttaagctgtcatcacagagttactagaggacacttatctttgacatgatctgatatcagaaacgagtgtagacttgtagtcatttagaactcaaaagagatcttagagtcttctagatcagtggctcctaaaagctactcaagaatagggctcatgtttttaatggggaactttaagtggttgtttagacccccaccccaagatataaactgtggtggggcatgggcctgagaagcagagaatccttttcttttaagctgcccaggtgatgttaattcaaatccagtgataacagtgataagtaacacttagccaagtgtttcccatggctcttagcttcagagtgtgacccctatctaagtcaagtatcaaagatttttcttcatgccattactacagaaacagggtagaatactcatattccttcagctcaagagcagcagagagtttctgacaagtatttttgcatttggtaaaatggtagtctaagttggaactcagtaaactatttttgttttcaatgaggggaagtgtagaactgtagtactctcaaattattttttctcaaattggcctttgtgcaaaaaaaaaaaaaaaaaaaaaaaaagtatgcctgctgtgccccagttcatagcctcattttacaagcgagaaaactgaggcactgggagatgaaatgagttgcatgggatcatcatggctttcttcaaattctgactcactgagaatttggtacacaattgtctcaccctctgtagcgttgctgaaagagatttataaatgattattctttgtggctttccattcctagcaatcactaatctaaaatgcctcctacatatttggggcaatgttttggggaaaggatctgataacctgccttttgtagcatcttttagtctgttttgtagcatcttttagtctcttctttgtatttaacatttgtagcttcttttagtctgttttttgtatctaacatgagctttaccagatgtactaattactagctgagatttttatctgactcttgagaacaaaatgtgtgaattcaggagatgagtcaagaagtatggataatgtaaatattcaataatagtaaaaaactgcaagtataaaagctgtagatgtattgcttctgcggttaacttgtgattggataaagacatctctctggaatcccttctggttataaaaagaggccatcttaattggcttgtttttgtttgtggttataaactattccaaaccttctggtttgaattgcggattatggattatttcatttcagtcctctacaaccatcaaattgaattaaaaaaaaaaaaaagaggagcagaagtttcattgtaagcctttatagcatttgactaatggctatatgcagttctctcagtctcttctgcctttgctggaaatgtatagagtgtttcttcatccttaggttgagagagcataaatatattgaatggatttgatttcctacaaaacaatattctggcattttgattaattgacgaggacccttcctttgcaatgtacccaacttttccttccaaacattagaatgtggatcacctacatttgaagaggtagagctggataaatctttgctgatgaactaaaaaggctttcacttcagtgtctggtgaagcaattaatgctggaagagtagcttggggtattaccaggatgcagcatatggcggtggtttgctaaagtgatttccatttggctaaccacttgatggcaagccagaggcagtatctggagagaaggtagagttgggaaatgggtcttgagtacatcttgtcctcaaggcacagggtgatacacagtggtgccttctaagaatgtcagttagcaaccctttctcctgccaccagtgagacagggccattgttcttcatctggaagaagcctctttccttgctgaaaggattaggctttgacatcaaattctggctttgacatcatttttaagacatcctctgaatctaaccctagttttctgaacaggcaaagcctctcgcttaaattcaaaattctccaggccaaagatgatgtcatgtagttttgaaaggctccagttcctggagtactaccaggaaaagaaagtcatcttccttgaattcagtccaccctcaaggtgtcctgagaaagaagctgtttctcagaacagcccaggcaacattgctttcaggcaaactcttctgttgacttcgtatttcctacacattcttaagccactgaaagagtttaagtctgaaagatttctgatacctatttcctcaccaggctgcaaaaataccagaattatttcattcctgcagcctcaaagatagagaaatcaaggctccaagagcatgtcttgagctaaaatagtgattttccactttttttaagtgacaggatattttcatccaataaaactgtggaagggacagattatttttccactcaccagaccagtcttcttgaccaggtgggcagtgtggagagttactttcaggctacctttaaaacgctacctgggttctaaagacaatttattttttttgttggttttttgtttgtttttgttttgttttgtttgaggcggagtccctctctgtgttacccaggctggagtgcagtggcatgatcttggctcactgcatcctccgcctcccatattccagtgattcttctgcctcagcctcctgagtagctgggattacaggcacccactgccacgcctggctaatttttgtgtttttagtagagacaaagtttcaccatgttggccaggctggtctcgaactcctgacctcagatgatccacccgtctcagcctcccaaagtgctgggattacaggcgtgagtcaccatgcccgtcctctaaagacggtttgaaacccactatatttgtaagcaatgaaaattttatgaacatagtaggtgtggagtgcttttcacagagtctcttgggtcttacctacactagggagaaataactttcaaatgtcttcaaagtgagattaaatctcacatgcacctagattggtttgttttacttgggtgtagtctgctcagtttttcatcttgcgttatggttaattgtgtgaagttatgcttcccactaaattatgaaccttgaaagcagtaacatctctttcttttcgtgacaccatctcacactctaccctccctcccttccttcctttcacctccatatctctgcacaggcatagtgcccgaaaatggtaagcattggtggatggtgatgtgaatctgtcatctaattgcggaccttgaagaggaggcacagctcaaaagaaataactgtgtggatgaatttggctattttctttaggaaacaaagagccaggccaggcacggtggctcacgcctgtaatcccagcactttgggaggccaagatgggcggatcacgaggtcaggagatcgagaccatcctggctaacacggtgaaatcccgtctctactaaaaatacaaaaaaattagccaggcatggtggcagtcacctgtggtcccagctactcaggaggctgaggcaggaggatagcgtgaacctggaaggcggagcttgtagtgagccgagatcgcgccactgcactccagcctgggcgacagagtgagactctgtctcaaaaaaaaaaaaaaaaaaaaggaaacaaagagccagaagttctctgttcccctaaaaagctaatataatagaaggtcaggttgaaacacaaattataaccaggaggcctgaggcttagtgagagagttgatcaaactagccccttgattagatcaaattttccagctgattgaggctgggtactagacactaggaggcagacgttggttttattccagatggaattttaaagcttacccacatcgagagaggacattggacaacagaataaaaactataagcaagtacataattaggcacaattaaagcatgttaatacagaaggcggatttacatgaagccgggagatgtttccctgccctgttctctctccttattgggctctgagacccatcatgtgtttggacaatgggagaatttagacatttcttcctctagagtccatggctagtgtttgaattacatctagagaccaaaaaaacagagatgtgtgcctaggagacctgtgtacttaacagcatttaacagttgtgaagggcacattttatgactttcccatggaaagaaaatatctcaaaatggcccaattcatccaggccattcagtggaagctcagtaaatagaggaaccacttcctcgaagggccagacctgtcttcactccagatgatcctcactggtaaaaactgtatttaaacaccagaacttactaagtgctagggggctgacacagacccctggcctactgcacacagcttattaatgcccagcggtgcttgatgttggcttcctgtggctaccgtttcaaacctagtatgagatagattatttttccctcctgtgataatgcattatttattcctaaagggtcttttcttttctctgatagacaagtgtatcatagggcattccctcgtttagatggtaggatggggagggaggcgtggtcagtttcacaccctaaatatccccggctttcttgctcatcagttttcacaatttatattattttattgatatatgtgttcactcgttgattgtgggtatcccctactagaatacagtggtcttgcatgctggtctgcttttcattgttgcatcccagctgtaacatttgttagcacagtgcctaataaatgggcgatgtccaataaatttttggtgaattaacggatgagtgactggatggattctgatataattgagacttatttgtgactcggtggtgaacttaatatagaacttcttttttttttttgagacggagttttgctcttgttgcccaggctggagtgcaatggcgcgatctcagctcaccgcaacctctgcctcccggttcaagcaattctcctgcctcagcatcccgagtagctgggattacaggcatgcgccaccaccccggctgattttgtatttttagtagagacggggtttctccatgttggtcaggctggtcttgaactcccaacctcaggtgatccgcccgcctcggcctcccaaagtgctggggttataggcgtgagccaccatgcccggccagaacttctgttctaactagagatacaagtggttagggtggactttatgctttgagagtaaaacctcagagcactgttaattcaacccactaccttaaattgatgctgtcctcttagctagatttccccattgggaaagactcaaagctaaaggttgagaactcacagcagaaacagtgattcccacagttacctgcctcatttgaaggaaaaggctcccagagttctgtgttaccaacttgttacaagcatgggctattctcaggtcattctgatgtggaagctgctttatgcagtgaaaagaagtccactcttgagaccagaagacaaccatatggatcctagttttggtactctgctgctgtgtgtcattgggcaagtgtgcagcctctctgaatctcccttcttctgtgaatgagatttcctataacctgcctcacaggctatgggaggattatatgatgtcatggatgcgaaaatcctttataaaatagacagtgtacacaggagacacaaggatgatcagagtgatggtttcttaagtgattacagggccacacacaggctgttttctaaccctgttgtcacccccagggcccacaggtctcatctgagtgaggggaatctggaggtgtgtttcaaggggtattctagggtctttgaggaatcgtgtaggcacttggaggtatcctgtttcttctcccttgatatgtgggcctcagattagcccaagattatatcatttaaaggttggaggcagattgtaactaaatataaaataattatcaaaatacatattttgagtgttttgaaagggcgttgaaaccatttcttgtaatctaaaacaaactgtaaataaggaggattttattttcagttacacctgctagtagatgtaagaggtggttctgtctagtgagaactattgaaaccgattggtgcaagaatgcttcatgggaaattgaatgatgcacagctaacattgtctcgaggtcctatttgggcctgttgagaagggtttatgaaaatgaaggggttctttctatttgaaatagaaaaggtaccatttaccccataatatttaaccagccacctcctcctcctcagatttacaattacagagccccggttgcaagttgaggttttttaatttttttttttttcatttgattgctgcctttagccccttggtgaactccgctggcagcctcgtgggtatttttcaaaagaagcctcctgcttgactgtattaaattccactggcacctttgccacgccctgtcccctacacattcaaataacagagttttcccgtaaccctgttgagaaatgttcacgagggccgcagaacttgttctgtcttccaaatttcaaggaaatactagacttacttggatgtagtaaatgacatggtttccccaaattaatcatttgccagatcttgcatctgttattttgtaaaatcttaatttttgtacaaaaataaaattaaaggaaaaaattaaacaagaccatagtgtgcagctcagtatattacaagctgtttgtttttattcactcaactcaataatgtacgtagctagcattttaactgtggaatatgttagttttcatatgatttgatcaatatcccattttcttgacctaagtgaataaaaataaacagcttgcaacatatacagtttcagattttggttttgttttggtggttagagaagctggcataaaaatatagcctgaaatgactataaattccacaaccaatttgatcatttaacttaatctgtgtagtaattttatttattttttaaattggcaacacatctcatggatggaaaatcagaagatacaaaagcatgtttggtaaaagactcttttttacctctatacccggttccccatttccacatgcctcaggcaatgttaatgttgattcatctaaactgttgaactaagatatatttcagctaaaacctgattttattttgatgctttatcaaatgacttaaaggaacagggtatgagtatgagtccttgacaaacctacatgaatatccagggaggtgtcttaaatgaaacgcacttaggatgacaaaatacacatccaaaagtagaattccatttttattgtaaagaagagtgctgaaagcgagatctcactatgaaaccataaatcaccccatatactcttttggacttctctgtttctgggtttccagaacagactgttctcttctgactgttgcatatgtattgaagcctggcactatgaatctcttatgatgtaagattgaatttcccattgccattttttcagataacagcccgccgtcagtggaaacatatttatgatgaattaggcggtaatcctgggagcaccagcgctgccacttgtacccgcagacattatgaaaggtaagaaaccatttcatggaattgcttagttaaaagtgtgttaattgaaaggagcttctggtcaaggataagacagaggaagtctaaatgaccttttgggaaactgaaaatttccctctggcattttactttgcataccgccttgtgatttttagggaacatggctttctcttgttacaggggctaaaattagatgttcttttagtttggttctgtcatgtgaccacctgcctgacaatgccttttttttttttccccacaagcatagattactcaggatgttctctttaggctctcttaacatgagaacctttagcttctgaaaaatctgcaatgctactctgaggttgacattgaaaagtaagcacttctcataatattagcattgaaaagtaaggatttctcatagtaagagaaatggccccagatcaaatctgttgttttatttcatcctggtatttttcttctacggaatcttcttaccaagctctgtgtggcttggttttctaacaatttcagcctatttcagaaagatgatgaggatgcaaacaagaagtaatgcaaaattagcctactatgttgcatccacaggagtggatttcccgtttgcattaggactccattattcacaccgttaaagaccagttagcagattaatgcattatccctctatgcttcaagcccatacttaatttgtttaggtcattaccaacttccttataactggcacttccctttgggtcttatacgtacatcctcaggcaataccatttaactcatcaattcttagtcctttttttccaagttcaattttacttttatctgtattgcatttaactcagctttagtatggccgttcaacaagaatgtttttgtaataataaattgaattgggtttagtacaccatgaaaaattgctacaaagtattcccaaaggattgccttacttggcagggttgtaattcagaaggatttttaaaaattgataatagatgttcaaattattactctttatagcattgtttttcaatacaacacatcaatttttaaaatatgttatttctgtcagtgtttaatacaaaaactcacccattctcactgtatgtataaggtacaccactgatgtcctagtacaaagtagcactgatatctcaggtgagtgttccgaaaataatgtctaaggaaccacaggctacttgtttttgacttatgagtcaaggcttcattcagaacttttttttttttttttttttttttgagacggagtcttcctctgtcaccaggctacagtgcagtggcatgatctcggcccactgcaacctctgcctcccaggttcaagcgattctcctgactcagtctcccaagtaactgggactacaggcacgtgctaccacgcccagctaatttttgtatttttagtagagacggggtttcaccatgttggccaggatggtctcgatctcttgacctcatgatccacccacttcggcctcccaaagtgctgggattacaggcgtgagccaccacacccagccagaacatttttactagaaactctgtccctgttttcaaatagattctgttttgagagtggacatccctgtcctttatatgcaaatgccctcaacacctgaaccatcaaacataaaggagcagatagcaattaaagcttgaaaaaggagtgtatctcagctgttagctcatctagttaaagaatgaaaacatcaatcaaattaattacaaagtatcacatggtaaaaaaaaaaaaaagagagagagaaggtttggcatggagagaaggactcaacccatagtagtgtgtgtgtgtgtgattgagcaggtctgtgaataaaagtaggattcttctgaagattgtgtacttttgattatttacttctttcaggagattcctgaaagctttcaatcacattagaaaattttagtagatataccacaaactttagcaattaagaaacatgattaaagatgtcttaaaatttttctcttctctccctattcttgggaccagattggatattccataaaggtttgctttctcactcgattaaactttttgaagagtgatgtcacttttccaaatccagaatttggtcagtgtatgagtcagggtgcagtaaggaaaatggaaaccacactgggtattcaacaaagagacttcaccataggcagttgcttaaacaggggttggtgtgaggcactaagttaacacgggggcaacaactgtaagttccctagggtgacagaacagagaagagaggttggttgtcaccacccagaagtttggagaatgtgcctcagagctggggttcaggtccctggtaagaaggagtcacccaaccagcactgatgcttcgggagctcagaggtggagcactgcagagctgggctgaaacctgaggaggcggtgctccctggctgctgccagacctcagaggacacgcgctgaaactgctgggggactgttgaaactagaggctgcaacccactgctgctgttaatgcattgtggagttgacactgatgtgaacaagtgaaatggaaaggagattccttttctctccctgcctcccaggacacactgtttgcagaatagtaacaggaagatagctgacaaaagggatgtgtaatttacagaattccagtcctagcatcagcaagcagagtacagaagggtggatttggagttgaaagacaataggccatccgccaagtgggaaccccatatgcagagcccattttatgtgtggcaacaccaaaaattggcagtgtggagcctccaactgtgttgttggagcatagctgtcccagggtgattagcaaggtcctttacctttccttggtatttcctttttgccatctagactcctctcacatccttgtgatcagatgcaaccgctaactaccaaaatttgaagatcattgattttatttacaacagtgcctctctcaatgttcaatcaatcattctccaagaggaatcacccataatcctatgtgttgtggtggggagaaaaagctaggattaccgttctagatgtcttccttttaattggttctaccaaagaagggcagaggacatgcacatatatccaagaagagactgaagctctgggctaaaacttcatgattatggtggatttcattcattcttgctagtcacaggttgcatgaacagataaaacagagatgactggattggtgaaggaacactgttttcaagaagggtcaatgagttgagaatggtcaggactttgtgggcaaatatctagtctggaaatgcccttggaattttgtaaagccttccaaaccaaatcaggatgatgagagctcttcctactaggctgcgggttcttctgttctcattcttttcactccgataaagagaactgctctttttcctatttccctgccaccagctttgctttcctagaagatgaagaagtgagtgatctctatgcattatccactgatttatttttcatgcactgtggttcatgtttccagtaaacgttttcattttacaacaagaaaaatgtagccagttcctcagtaaaatgttacttgtatattagttgagcacttttggtttattaatgagtgcaataatgaaagtgtgggttgttgaaaagaatcaatgggtgtttttatttaaggcaaagcagaaatggtacaatgcttgtgaatacatcattgtcactgaaggcctgactcgtacaaacttgcctctgattggtttaaatcaaataggtccaagcacttcataaaaatgtctttgtcagccgggttttgcttccaaatctattcatctctgtcagtttttaatattagtaccaggctcctggccatagtccattagtactgtacttaattgctcatgttacagatgattaccaatataaaaagcattaatgttttcccatcgcaaggctgttgctatgtagatgtctcaaactcagcaaagcttatgaaatgtggttattctggacatttcttgctcaggatttatagatgaagttactgtagcttttgatgcaaagaaaaatacccacctcattctttctaagtggaacattttctttcttgtctaactctttacttaaaagtaaccagttcactttatttttatcagtaaaggaacaaaaaggaaaacgactacttttatggaattctcttagcttgattttctggaatagtaaatcactttaaaggctttgttttcacatgcagatttccctttttaaaaaatgtttttaaagtccatgcagggggaaaaaaatctttactcagaatgctagattactggttttaattttcctgaataaattacatggtctgtttctgtggagcacatgaagttgttattagggattttaaaaggagcattaaagcaaaagtactttatgatgtgcatttttgagtatttagaaaatcaaaatcataaacaaatgtatttgtttgtgagggaaattagcaactattcttcatcttcttgcacacataatgcctaatttcaaatccaaccttttgcttttaccataagcattccttggacaagattgtcaccctgcatggctgaggcagctttctttgcagggacttaaggtgagctgtacccaagccagatgtacttgggcagatactgggtgatagctggagcttctgccttttttctctgaaggtataaggtagagtgtgggaggcttcatgttttgaataagataagcatgtgctttaagttaaggaccaaaaatatatcaggttctaaggaacccacctaatcataccatggataaaggctggggaaggaaaggtgagttacagttctgtgcacatcaaggacatgattccatgtattcttgctcatttggacacccttggagttaatagatacgcaattcagaaagtcacaggccacatctcagaattgtatatttaagaggacccctagcaactccctagaccagtgctactcaaatgagattttctgacttgtccatgaactgttttctactagcccataacaagctaataagcacagcaattgcgaataagcattgatacacttacgctgaaatttgccagaataacattatgtctgttgaagctaataaaaacttggggcttgtgttttgtatgcctccttttgaattccatttttctagtaattcatttttatggttgtttacaaaagcatcagtcagcatcagatgggaaatttagaaaactcgtctttcacccaggtcagtggagaagctccgctcctacatcttggccacaaactcagatatttatggaggcaggtagcaaagatgagtgcaggggccacggctggaaagtgtgaaactggcacgcacagcccgggccagagagcccaaagggaccagcccacactgttgctgtaggtagatgccgtctgtgcgcttcctgaccttctatgttttcaagatatttttttaatgtgaaataacctaacttacaaacactggctccaatatttaaaaaaatattttatataagctaaatcaaacatgcccaggggcaaaatatagcctacaggatgccaagttccacaaagactgaaatatgcttgacactaggctctccagcctctgatacagcgccctgcagtgggagggcctagaggaagcttcagggttccaggcgctcttactctgctctacacactcttccgtgtgctgagcaaaacaccctctgtggcttcccattgaccttgccttgccttcggaggacgactcgccacatgtctgctccctttgctctgatcagcgtccaggagcttgtcaaagctcctctttcacttcaggtcttcctgttccattcaaccaagcctcagagcgtcagtaatggaccttcaccagctcggcttgctctcatgcaggcgcctccagtttgtgtcactcagaatacccaaagctactccagatgtggcatgtagtatttctcaggatgcgggcagtgtcagtctatcaacacagcctaagattacatttggaatgggcaagaagccctctcctactggcctgttgcattttcttggataggatagatttgccatttgattaactgtcttttttatttactgctgccctcaaaacccaatcggtgttttttggacatctgccatgtgcagagagcactctcaggggtaatgagaacatataaagcaaagagttgagaattggctggcaaacaatgaggaggtacccttgccaccacattcatagctgagattgctaaaggaacaggatgctgcttccggtgagcccgggttcagcctcagaattcttctcagtatggcatccccagggagccaccacgactcattagaactggaagatgccatgatccttggtttatctaacccatcacacatctgagtcaaaggccgtacacacatggaagagagttatatctatgtctgtggtgggcatggtggctcacgcctataatcccagcactttgggaggccgaggcgggcagatgacttgagacccaggagttcgaaaccagcctggccaacatggtaaaaccctgcctctactaaaaaatacaacaattagctggggctggtggcacacacctgtaatcctgactactcagatgtctgaggcacgagaatcacgggatgaatcacgggatggctgaatatgggaagtggagggttgcagtgagccgagatcacgccaccgcactccggtctgggctacagagcgagactctgtctcaaaaaaaaaaaaaaaaactacatctataaaaactagttttatgtaattaaaaaaaataagttcaacagggatcaaagaaggaagagagaaatttcaactgaaatgagcaaagtcccctctggaaaatgtgtataaaaaggtaggggctgtcaggaaagtcctaaggctgaatttccaagtcacataccccaaaggcaggtagtgtagtttatcctctcatgtctatgaactattatcctaaggtgcggtgggtagactctgcccatcctcatccatggtaaggttacccagtcaatggacttgcatttcctttcccaacactgtctttctcatggcagtcctgacctgtggcccctattgggcttacctctgcaacacggccaccctgccactctcatctccctaaacccacagagggcatcctagccctatcaacaaccagaagcccaggaaactgaaaacaagttgcccagagttaggctgactgaggttgtacagcttctcttccatctacactccaccaagcttgttcttacagggctctgagtcagttcaatgcaaacaccctacacccagagtagcttcatcttgtcatctgtaaagaatttctctccaaaggacagtcaggtaatttcatacacaagagccgcatagtctgtatcactcagcatgcctaaaatgctctgataactttccaatgcctggatatttcaagaaacttttagaaaggaaaacaaaactctagccagaccctggagtagaaaaactggtttctattttaaaaaaataaacaacagcctttgaaaaaaatctctatttaaaaattcttaaatttgcctctaaatgcaagttgtaattaatagaagttagagtttacactgttgagtgtaaaaacaccctcaggcacaaactaatcaagtgtgtatgtcatgctgtaaactacagcgagttctttgtttgaccccccccaaaaaaaaagcttgccaaacagcagtttttctttgtcgagctcctttattgtctcatttttgtttttatcctacttcctctgtcccatcctttgaacctaactatagtatttaagaaaccttgcaggtcccatgttttattgatagttttcatcaagcatgaatttaaatttgagaatagattaggtgtcttagcccttttctttttgataaataacaaaaggtttctacttgtgattttctgtcctcagggttttatcattaagattaaataactgtactctcaagcatgccactgcacaaacatcttttcagttatgtgagtaacagatgccttcacaaaggaactattgaaaattcagaaagcatgtttccaaaaaagaaaagggaaaaaaagtatcatatgacagaagaatgtaattgtttaccattaaagtatattcttaactcttccactgaaaacctcttggaacattttgtttttgtgtaagttactacaaagtttgaccaaaataataaatgttgtgggagaactgttgaacatttcagaagttctggaaccagtaggatctaacatgcatggggcttaaatgcaatagttgtttgcctatttttatattttgacactggcttccatcatttgtggggtacacatcacattgaaaacactgccatgttggctgggcatagtggcttaccctgtaatcccagcactttgggaggccgaggtgggtggattgcttgtacccaggagtttgagaccaccctgggcaacatggtgataccctatctctactaaaaataaaaaaaatagccacgtgcagtgacgcatacctgtagtcccatctattcagggagttgaggtgggaagatcatctgagtccaggaagttaaggctgcagtaagccgtgattgcatgagaccctgtctcaaaacaaaacagtattgggtttattattcttgaaataatgttcatctgcccttgaaatggatccatacaactcaattctgaagtcattgggcttttttcattgagaagagtcattgctgcagttgttgctggctggcattgtagagggctaggcaccatgcatggtctgtgttcactgtaataagcatgcattttaatccctgggacataacatcagccttccttaagtccattccaactttcttcaatgtggttgtcatttgaaaggcataggaacaacattagtctagatgctcttacatgtggcatggagacatcatagaaagccccaaaggagctttattagggagaccatgggaagcttgggcttggtaagattaagtcctagaggctggaattcatggaggatatgattctcaagtttctcttaccatccgatattaagttgggcatgatccaactagtatcactaccttttgaagagctatggcatggttattgtagcatattgtaagagtagttgcccagtgcccaagccatagggcttcttctgatgtaggaggttgaccctttgtggaatggctacatatgtattttataggcctgttgcctctgagaaaaggagaatgctcactccagtttctcaggtaactccttaggagctaggaattcacttaacccaggcaggagtgatctttcagtatctcctccgtgttggtatgtctccgtgttgatacatctgtgtatgaagatgcacagccacctttttgagatgaagatagctggactagcagaggcaggcagtttggtggtcgaactcaaaattttgacactaaatagctgtgtgccattgactagtcacttaatcgtttagctctgaacctcagttttgtcatccataaaatgagataaaataatatatctgtagatatttctttctgtaatggttgaaattaaagcatgcagagtgcctggtattaataagaatgtaatgcgtggtggtggctgttaatattgtaatgcctaatcaatatatatgaatgacctgaatgaggtttctctaccttcccaccttgcttctaacacagtcccctgaaatccatgtaactccagttcaggaaagctgtcatccttgagctaactctctcacactgacacatctttatgggagccgagccaccaccttgctgtgtccagtaccacgtacctttctttcttctcttcatttagggtcacacacactccgggaccatggagggaggtatcagaattatcagtgggcctaagaaacaactctcccacccacttccaggggcaaatggagagagcattaaagccttcaaaaagttttcttgtccatctgctgcccattgagtaggtaatgaagcccctgtgagcagatcattttcccagaaaagagaccttttgtggtgacaaatggttatatttcatcgttgttaatagtggactccataccttttaggtgtcttagcatagaatacaggtgatgctagttatacctacctcatttttaaagtatgtaaggcagtttggctttggtagctcttgggcaaactgagtctttcacacagactctgtgttgcactctgccgccattttgttggctcagatgggccccgctataggctcgttcttcatgtcagcgtggcttcttactccgtggtttggtgccccagactttcagttcacatccttgcctgttgggaggtgacactggaggcctctttctcacctgtcttggttatggggagagcttgtcacactcggcacactattttttctgctccactcaagttcacaccataaaatggagatcttctgcggctcacatctctctcagatggagcttagcttttactgtgctcaaccagggttgtgcccgctgaggaaacattctcatttctctgctcatttacatagcacatttgtgtatttggctgttgatttggttccctacccccaaaagctcttcttccacttttatggtcatggtctagcacctgagaggtgaacagtatgtgagattagaaaaactctctatgcttattggaactgtaacaagcatgtgtacctcatcttcagaaaggaaaaatataccttctattggctccatatttggtgaaagattccttcccatacttcacagtaaagttatattttaatttctggctgcaaagggaaatgtctggccaagctgtagaaatttatcaaggctggaatcaactcagaggtgtaatgactccatttggggtgagatcaggtctgaagtcccagttgaaccaatatgtcatttcgttgttactacaaaaaaaaagcctaatagtattagaatagtagtgccttttttttttctttttttgagacagagtctcactctgtcacccaggctggagtgcagtggcatgatctcggctcacttcagcttctgccactggggttcaagcaagtctcctgcctcagtttcccaagtggctgggattacaggcacgtaccaccatgcctggctaattattgtatttttagtagagatgggctggtctcgaactcctgaccccaagtgatccgactgcctccgcctgccaaagtgctgggattacaggcgtgagctaccacacttggccagtagtggcatctttgacctgacatgcaccaatgttatttccctctgcccctagaaaatattctgctccaaggacaccagcaaacctttaggtctggaatttctcactgatttgataccataaagtgcctatgcagtaactggggtgactttgggattcaaatacaaccctaaaagttcaccacttcttgcccccactctctggattcaatcagttccagacattattgtaataccatttttcaagctctgtaaatagatggattctcgtttttcctattaagcactgtttgctaaatattttggcccaaaagttcagtcattccatgcaagcattaatcaatacaggagacattagtggttactggttcagatgagatttgacattatttttcctctgcttctgaggaagggaggggaatgttgtgtaataaagatgaagggtcttttcttcttttgtacaaaatgcaaatgatgaggacatgtgtgatacacacttctctaatgcaaggctgctggtttttgttgagaaagagaggcaaggccctggaggattttagactttgtaaatataaaattatctgccttagtgtttaaaaaaataataaaagggagaaagagttggcaggttgccagattacttacattacagtaatagatttgctgacccctgacttctgctgtagagaaatgtattgaatttttcataatatcagatgaggcagatctaaaaacctagtgtactaagcaccattatttaacttgagatttagcaaagccgaaatcttttcaaaccagcaatttcatgtatgatgataatttagtggctcagatgctaacaaatcaaggttataatgctattgacttgttaattttaacttgggttgattttaagtctttttttttttaagaaagaagaatgaggaggggaaaaaatcttgcttttcacagtgactgaatttaataagaatctccgtgatagcaaaaggcccccctactgtttctgctttggggtggaaaatgttattcttgtattattcctagggaaaaataaaatctcatgctgctacaaatcttatgcctatggaaagatgttattttttaatacataatggcttacctatttcagatccattaatcgcatcgtaaataagcattttgctaatctgaaatgtgaaatctggataataataaaggcccatttatctgtccagctttcaatccccagactagatgtagatcaggaaggggaaaatctctggattttctaatgaatatattgcttctcttccccattacttccacccacctaaaagccagcccccattcttagagttgcagtccattgaaaatatttctcctgtgtaatgaattcttgggggctggagtgcatgtttgcttttatctgtacagtttagaaactgataaaatctttgctgtgctacaaatatttgagaaataatcaacctcaaggcgcaggcatggtgcattttactaaattctttatataatacaaacctactcagctttctacatagggcaatgttgacctaatctaaggctaacctgtttttaatggtaccacatgtacgttgaacgtttaaatgttcagaaacctataatagcttttgtcctcttgtactgtaaaaacttctaataatcatatgataagatcatatcctgtggggtaattgtgttgtaccatgacaggataactgaaaaaacattcagtgaaaattgcaccaaacggaaatcactatatgaagcagcgattgtgtgccgtgcgagaccgtgccctgttcttcaaagcttagctggtcatatttctacttgcttccttttagcttctgccttgcttgttttattttaggaggcttttttccccaagccactataattatctttcaatgatttagaagggggggaaaaaacactcggttgacctttacacacacacacacactctctcacacactcacacactctcatatactctctctggaagccttgaacaagtagggcttgtgtttggattcagttttaccttagtcatgcctctttccagatacaagaaacatttaattccagatttcctgcttctggctttaggcctttgaccagcaaagtgaaatgtattttttactgctgtcagccagccagctgctgagttgagtgaaggggagaaaaaaaaaaaaaatgaaagaaaaaatgaaaaaaaaaaaaaaaggaaccgaaatgagaatggtgccctgctttgtgaacttgcaaaattagaaaaggaaattaaagtctccttagcacccatctagagagccaggttggcccagggctctcagaacccagagtgaggggtccttgggcgtccatggggtgtctctcccacccaattctctgctttccctcctcctccttcccacactcagaggtaatgctgtcattcttctcagtaaagagggtccctcgtggtgtcaccatctccatcagaaaatgaagctgggggaagggtggtaccagcaaattgctatcattggaatacccagactacagtgttccttgagttcccatggcaacaaaacaaaagtaaaacaaacctatctgtcccaacaataaaatatgtttccattaaagtcaatttaaaatatctttccagtttaaaatattcaatgcattttgctcccagacaaaaatccacaacctgccaatattgaagaggataaagtccctggcagaaccaggcagaaaaaaggaattggggggaatgttggggactttacagatgagacagaataaattcaagtatgaacaggattgcttttttctctttgtgcttagttatgctttttattatataaacattaactgtaatattacagtgggaagcaggtatttggcagccatatattattttagtaagtctacatagggagggcagtttccagttttagcagctgtaacatgtttaaactcagtttgtaatgggatctgaagataactattccccatgggctctgttgatcttcatggctggccaactgccagatgtagggctccaaagtattattcacgcctccttgctcataccttgtccaagcatgctcagtaaatgaattttgtttctaatatgctataaattgggatctgattttcccatagttttattggtattttattaaagagcaaaatattaggatcacaaatgtccccacatccgtactgtcaaacctgaacaatcgtgtatggttaagcagttgagatccaaataacatagatagaaaccaattttaggatagcaaaccaatatccagaccaaggaagtttttgcctgggaatcttagtttaaaaataatcaggatccccaatatttgaacagacttatgatgtttataagccaagtacattttcttcattgagtcaacttgtcttatttaaaacaaattatgtttgctgtattaaagttcatatttttaaggctgagtcttatattaatcccacagtgagtcattaatcataccaaatgcattataaaaactttaatcactgaagttgaaactgagattgtaatgcaatccatcccttttaattacatcagctatttttccctttcagataaagagctacgtcgcaaagggaaaacagattaaaactagagctgtttgatgtttctctttttagagcaattttatgcagtttgtttaaaaagttatataatttaaatgcttgaaattttcaggcctctggtttttgtggcttgcatagtctgtctgccttccttctcgctggggcggtcttttacttagcacactaaaacagaactcctagtggagtcccctaccccactcagagctgtgggataagactaaactgtctcttggccacgctgtgcttgcctctcattgacctttttatcttagatgtttcatctctatcttgacatgaatgaaaataaaatgttttcagatgggcagcactaggttcagatctcacctctaacaaatggtatgactcaggcaaattgtttaacctttataggcctcaattgcctcatatgttaaaaaagagaataataataatactccatagggatattgtggagtttacataaaataatctttaaatgtacctggcacatgctagtacctactagaatataagcttcatgagctcagaggctttgaatgtttggttcatggctgtgtctcagtgcctagaacactgcctatagtatgtgctcaataaatagttgttgatggactggtaaagcagctagcattattgttgcagttttgttagcacttagccaggtgccatggggagtgatggtgatattgttaatgttggatgcttccattggtatcttggtctatagacccacaaaaccaaaaagaggtcttgctgagaagtattaagttaccaggtactgattttgaccaaggaagcagaacactaaagtgtagagtaagtttatagaagtatagcactgtcactggagatgaagtcatttaataatttgcttatattgagaaaagaaagtaaacccccatagcattgatgctactggaattactcaactgaccgatcatctcttctgttaaccttttagattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagcaagaaagaaaaagaaaatgccccaaagccccaggatgcagcagaggtgagttgctttgctccatagaaatacctctggaagacatgtgctgcctcgaggtccttctggagccctgaatccacagctgtgtccctgcacagttggatggcttgatgaagaaaccaagaaatctaagcttcacagttccccacatagttccccagttcctgaaagcctttcagcttgctcatgagatgaaatccaatgcctagtattgaatgagatagcccaggaatagaatctagaaagatacaaacatcctgtagaaaactgatagcaaatgctcaggcttcaagagaaaagggtccagagccacactaacatcaaagaattttactgtgaaaacatggcttcttggccgctccacagcccgtctatctgaggtgctggtgcgactttaaaacatattttggggctggacatggtggctcgcgcctgtaatcctagcactctgggaggccaaggcaggtggattgcttgagcccaggaattcaagaagagcatgggcaacatggtgagacccagtctctacaaacaaagctcacacctgtaatcccagcactttgggaggctgaggcgggcggatcacaaggtcaggagatggagaccatcctggctaacacggtgaaaccccgtctctactaaaaatacaaaaaattagccaggtgtggtggtgggcgcctgtagtcccggctacttgggaggccgaggcaggagaatggcatgaacctgggaggcagagcttgcagtgagctgagatcacgacagcctgggtgacagagcaagactccatctcaaaaaaaaaaaaaaaaaaaaaacaatatcaggcatggtggtgccccgctgtggtcccagctactcaagaggctgaggtgggaggataaccagagccctgggaggtaaagtctgcagtgagctgtgattataccactgcactcctgcctgggtgacagagtgaagccgtgtctcaaaaaaaatgctttggaggtccaggaaaggggaccttggaactgtggtgctgtatcctgcaagactctcctgaaaactttagagaagtgtttgtctcccataattgatttctgtgcaacagccatgggttgagaccaatttaagaaaatcttaagtgtggccgggcgcggtggctcacgcctgtaatcccagcattttgggaggccgaggcggtggatcacgaggtcaggagatcgagagcatcctggttaatacggtaaaaccccgtctttactaaaaatacaaaaaattagccaggcgtggtggtgggcacctgtagtcccagctactcaggaggctgaggcaggagaatggcgtgaacccaggaggcggagcttgcagtgagccgagatcaggccactgcactccagcctgggtgacagagagagactctatctcaaaaaaaaaaaaaaaaaaaaggaaaaaagatcttaagtgcatattatttataggggaattttgaaatggttcctatgaaaccattattatttttcatattaacaggtagtttctgcactttttaagcccccaacagccttttggtagaagccattacccccagcatgtagccagtcatgtaggctgatctgggctccatttcaacatgaataataaaaaacgctgctgcccattaaaaaaaaaaaaaaactgagcagccacatttggagacagcatgttctaggattcaaccccagagggaattttgatgctgatattaaataccccctaaaaaatcaggtttataatgaacacataagaggctccataattaaacactggtttaaattgcacatgtacaacacgcaccaacctcccatctagacatcaacttacccagctgactcttacataagaaaatagtattgataccaagattagaaatttgtgggttttttgtttttattaggtttcataattattttaagctctagtaactaaaaagggggaggaggaagaagatgatgcagattttttttttttttgagacagagtctctctctgtctcccaggctagagtgcagtggtgcaatctcggttcattgcaacctccgcctcccaggttcaagcaattctcctgcctcagcctcccgagtagctaggactacaggcatgcaccaccacacccggttaatatttttgtatctttagtagagacagggtttcaccatgttggtcaggctggtcttgaactcctgacctcaaatgatcctcctgccttggcctcccaacgtgctgagattacaggtgtgagccaccgtccctggccagatgatgcagatttctcaacatctgcaagcttgcaacataaatggccaaaagcaaggaaattccaagtgcatgcttacattccatttttccttgatacttttggcctggtgatttattatagggtttcagatgagtgtgttctattagctgccatatgtacacaaaacaccaggggacaaactgaggaccaaggggacagctgaccgttgaatatctccaatttggggattaagtttgaaatggttggtttgtgaatggtaggaggaatctttagcctatgcactgagcctgtcagcttggatgatgaccatgcccaagagtggagccttactccctggagtccatagaaaccctgaaagctgttaggctttgtgtttcctgtaggctgcaactgttcccttcagggagctgtaagtgtctcaggttttgaaagttgtcatgatgaggttatctaaacctcatggaatcttccaccctctccaaggttgaccttataatacgaatcacttctcacctccaacatagaacgatgttattagccaggtgtattttttctcattaactctatttggggtttttggtttggattttattgttttcatcgcttttagtttttggtgttttcaatatgaagcggtgaactcaatggagatacaaagggtgagaaattccctctagttgaatccactatattcaagtaatgggattgcaagttgcatggtgggaagttaacatttaacatactaagcagatcataaaatgtcttactagaaaaaaagtcctttacttttttctgcctagctttcaaagacttcctaaacctgttttacaacccgaagcatgggactctgatataactgcagttctacatcatagaaacttcaatgagactgagtatccctcattgccctgcgtcaaactatagccccataagaaactaacaattagatgcaatttgcctttttcccttgccatactcatttgtctttatttttgtgtcatgtataagctcaagagaccaatgtgatgattattaatgtagaagaagtaatgatatttgtactggaaaaggcagctactagtacaaaaaataaaaagaaataatgatgataagcaaagtctcttaggtataacatgtccctaaaattcagggttttttttttaaagggatttaaggaaaaatacctgtgaaataggtgtgatttcttaaaacttttgttcccacgtattcctaaaccagcatcctcaatcttacccaaagatgctaattggcagacccacccttccttccttcctgcctgcctgccttccttccttcctttcttccttccttccttccctccctccttccttctttttcttttttttttttttttttgtgaaagttacactcttgttgcccaagctatagtgcaatggcatgatctcggctcaccgcatcctccacctctggggttcaagcgattctcctgcctcagcctcctgagtagctgggattacaggcacccaccaccacacctggctaatttttgtttttttactagagatgaggttttgccatgttgaccaggctggtcttgaactcctgacctcaggtgatctgcctgcctcggcctccctaagtgctgagattacaggcacatcttttcttaacagagaagaacaaagttcaagggatgagatggaaaaaggaggggaagaataccagctcagtacaactgttttgtgactgctctgctaagacatgtcagggcagaatgacagcagttttgaaagggcttgtcagtcagctgggtcatagatggaaagttaaaatgacctcctaaggtcaaagtttatatggctgcataatgcagtaaatgagtcgaattggtacccacaacttctgtcagtagggtcacataaggagtgtgtctgtctcattgactataatttatttcattcaacagcaaagctatatttgcggtggcactgactgtctgaattttgacaacttcattttgggctttaatagaaatgtagtttgctgcaacctagaaggacttagtctcctctgtccctctggtagacaggctgccaagaaatcttcatactttgtcaatattttagcattatctgcatgtcatctggccctgagtagaaattattaacacttatgcattgctaatcttcagtgcatcatattgaatacattgggaagggatttgccctgttaaggaaagcagggagttgcaataggtttgttgtttgtcgttaacatggggttggttggatttttgaaagagaaatgctttaaaaaaatctttctcaggagtatcataaaacacaacatgtaatttaaaacccatttggataattgactgatttgacaagaagacaaccttagaattaaactatatattagaatcaaggagtgatatgattgtataccatcagtacataatactttgctattttgataggtatctcataagggactgaagcgaatatgcatatttcccctaatgtttctgtaatttagatttctttgtttagagccatgattggggagtaataaagctttacagaaacttcacgagctgattgacaagcctgttttcaagtaaaactgctgtgtggaatattttatttcatagcaaaacatgtctgtgtatttggttttcttctgactgtcttttgaaatatgttaccaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagcctctccagcagctacccttatggctccccaccccctttgatcagcaaaaagaaactgattgctagggatgacttgtgttccagtttgtcccagacccaccatggccaaagcactgaccatatggcggtcagccggccatcagtgattcagcacgtccagagtttcagaagcaagccctcggaagagagaaagaccatcaatgacatctttaagcatgagaaactgagtcgatcagatccccaccgctgcagcttctccaagcatcaccttaacccccttgctgactcctacgtcctgaagcaagaaattcaggagggcaaggataaactcttagagaaaagggccctcccccattcccacatgcctagcttcctggctgacttctactcgtcccctcatctccatagcctctacagacacaccgagcaccatcttcataatgaacagacatccaaatacccttccagggacatgtacagggaatcggaaaacagttcttttccttcccacagacaccaagaaaagctccatgtaaattatctcacgtccctgcacctgcaagacaaaaagtcggcggcagcagaagcccctacggatgatcagcctacagatctgagccttcccaagaacccgcacaaacctaccggcaaggtcctgggcctggctcattccaccacagggccccaggagagcaaaggcatctcccagttccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggcccacagagcttcactccttacccaggaggtgctgggcttatagagttagaagtcagtttttcttctaatctgagggtaagatcagtcccagctgtaggggcccagaagggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacataccagagaatcataaaaacaaaaacctcactggcagcaagctgccgaataacaacagagtctagaggacatatttgtgggctgcacagatattttaggaatttcagaaattagaacaggagccaaaatgatttacattggcgttggcactgattcctttaaatggtctgggaaagggggttgggaagaggatggagctcaactggccagaagaggagcagctgcagtcctgatagcttctctagcctcggtcttttgagtgataagtagtcatgttgttttcatccagttggtttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatataagaaagttgcactagattgaatggtcacagaatcggaggacatggaagaaaaaggaaacttcggtggttctgcagcagacatgggctaggtcatatgtggtttctatgagttcgtgtctcaaaaaaaaaaggagggggggcatctgtccccggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgcattgtttgagttcaaggggccttattattgaatggaattgcacaagcctttctttgtgcaatcaaaccattgttattggtagttctgtaaaggaaactgtggaatcgaattggcagtggagtcataaatctatttactgagtgtggcttccaagaaatgttgcaattcaaaatgcactaagtctgtgatttattggagatttggagattctaaataatatttttaaaaaacttccatgcaacttctggtttaatgtttggcaactccacatgataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgccctggtgagacccataccattgcaatgattatcttgagcacttaaagtccagtgttggctgttagtgtatttgatattctgcctgtctcctcatggttgaaatatgtctgaagaatagcagcataatctcttggctgtttatacttttttaaactttcctgtgttgtaaatattgtatacttttggtgattccagctatgtaacctctatgctctgtaaggtgattatttgtatatagcaacatggcccagtgatattatatagtttcccaatggagaggttattgagtaacctttgcattagtttaaacactaccagaagaatgctgagccaactataaacactcaattttgtatgttttccaaattgtacttattactgcttttgatactgtattacgtgccaatagtttcccaatcacatagcaggcaagagatattttgtactttttgatccactgtaatatttaataaaaaatgttactatctgtttccttttgggtgtgagtaatctgtcactcttcctgaggagcctgtggcctccccagaagactttccaccccatctgtccaaattgaatgataacagtaatgatggcaatgtctgtaattcactaaggacctagtgggtgcccatttggcaaatatctcttatcttcacaaccttatgtaaatatggttatacctattttacttatgagaaaactaaagcttagagaggtaaatcaactggtccaagatcacccaacagatggcagagtcaggatttgaagccagggctctcatctatgtacttcctttgtataccatcctcctccgctggtaggataatcagaaaagttatttatttatttatttgtttgtttgtttgtttatttattttgagacagagtctcactcggtcgcccaggctgagtgcagtggtgcgacctcaactcactgcaacctccgcctcccaggttcaagcgattctcctgcctcagcctcctgagtagctgggattacaggtgcgtgccaccacgcccagctaattttttaatttttagtagagacggggtttcaccatgttggtcacgctagtcttgaactactgacctcaggatccacccgcctcagcctcccaaagtgctgggattacaggcatgagccactgtaccaggccaagttattgttttttattcagtcaacaaagatttactcatgccccaattgccaggcatagtattaggagctgggaatacaatggtaaataaaatataaaatattgtctctgggagcttataaatcttatgggaaagagagttcatcaaatagtcattcctataaattcaaaacttcagtgtgactgagttccaggagaggagtttgaggagtataatgacacacaaagaggaggtggtgactaaagtgactggctgagtatgggagggaaggaattgggaggagggtaggtcaagcacagggtaccacatgtgcaaaggccctgaagcaggaacgagtttggcttattagaggaattgagaaaagcctgtggggcttgattgcattgttgaaggagtgaggttagagagcgtagcaggggccaggcgggtaggtcccaatagaccagattgatttgatcaattttctctttatcctaagcaagaaagatttgtctttttcaatatcatcctgtggctgttgtgtgaggggaacttaagagcaatctaacatgagtgaggtggtggtcatttcaatggggtgatggaaggtgagagtggacacatttcagaggtacttagaaggaggaatgagcaaacatggtgattaattaaatagggcaattgatggaaagatactcaggaagggttgaaaatctggggaaacactgcgtattctgaggtctgcatcttttaatcgtagacctggtggtgatggacaaagatttctgatcttttgttcccttgacctctgccccggcttcccttggctttgctcagcttatcgtgagttgaaatgaggcatttacaaagtaacaccctatttgttcccttcttatgagtcctagagagggaggagaggtgtggggaacaggacttatggtcaggatggctttgatagacaggaaagagtaagctgctagcaagcatgtcaccacaactcagaggagaaaagaaacatgtattttggtaaaagccacgggatccttttcctcatcgttattgactctccaaaggaccctgcccattcacatcggggtcagcaggagttgcagcaacatgttaggagcctcaccctcttcttgctggctgtcattctttagctaatcccgcacccgacaaacaaacacaggaggaacccccagccccatggtcccctggccctcattctgagtcatgtgtatttcaccatatcatgtgacttgctgtgagtacatcagaagaacgttcttccacctgtgacacattcagcatttgtagatctgatacttgattcctacgcgataggaaacattgtaagttatccattcttgccaggcgctggctggcggatactatttggagaagaggtgcttttgctaaagatgtcactcatagggcaaaagcaatgacaagcccaatgtctattctaggaaagtggccaaagttgacaaatgttttagggctgatagtgaccaggaaataggtgatatttatatcaacaagtatgtaagtggcagaaggtgggaatggggtcagaagtgacctctggccaggaacgatgtaatcccagctactcgggaggctgaggcaggagaatcgcttgaatcagggaggcggaggttgcagtgagccgagattacaccattgcactccagcctgggctaccagcgaaacttcatctcaaaaaaaaaaaaagcagaaaaaataaaaaggaagtgcagccttcaagattgacctagggaatataataaatcacattaatttgagcttcactaattcagaattcctgaattttggactctccatggtaattctcagggtaaataacattccaaagcacttgtttaacctgctcagaaaaacatattatttttattcatgctagccatagccacaggcattcagcctgctttagtaagaactaggtgttctgttccctgaagcacctgtacaagaactactagtactttcgtggtggaactactaatactttaattatcggtgaaactccctctagaacagaggtgttcattagaatttcctgggatggtggaactgctataatttagagttgtccaatattgtagctaatagccaatgtggcgactgaacccttgcaatgtgcccagtgtgatgaaaacactgactctataattctacttattttttattcatttaaatttcaatagccacatgtggctagttgttactctattggacagcacagctctagaaaggccaattggtcaatatgcgtatgtggatagacccaatgacagataagccaatatctgcacataaactttaacctaaacactaaagcaaacaacattgttcctctttttagcaaaactttatctattggggtgacgatggctttaatatttttcattcaaaatttatacatcatataaatttatacatcttatgaaaatatttaaccagttaaatgctcaataaactaatcatttagaaagcactaagataagtctacatttatggtatcttttaacccagccctgctgtttatgttaaatctgattgtgtgaggcttgaatgcaacttcccgaaagtctgtgaaatattcgatgtggtcatgttcaagccctccttcttcactccatggtaattcaacatttatccatggagactgggagggaattcagtgtgaggaacatgatggccaggtaggtagagggggacctagggaccaagtgtggaagaacacttaaccaacatatttttagtgttttggtcctagttcttcaaacctgggtttgttcatttatttctcctttacacataataacaacaactaatgatatcaatgacagctctatatgtgacaaacaatattttaaatgtttgtttggtattaatttatttgatcctcgtaacattccatcatgcagatactataatatattcccaccttacagttgaggaagataaggagtaactgagcttttgatgaccaatcaaaataggcagtacctgcccatggcattagaagactctttcctgaagtttgttcttactgtgcaatttctctctttctttataccccactccaaccctgaaatccaagaaatcagcacaaccactgagtcagagtgccctaaggtttttaaataaattaatgagggcaaaaaaagagaagacatcaataaacagtactaggaaagtaaaacgaaaacaatagagacttttaaaattattagaggatggtgttaagtttaaaaactggaaaagttagatgaaaaactgtttcatagaaaaatagaaattaacaaaattttctcaaggaggaacataaaagtcataactaagagcttgttcagtagtcaaatatttccccacaaaaaacaccaggtccagatggctttaagaactgtttcagagaattgaaaaagaggaaaatctacacaattctttttatgagtttattttgaccttattatcaaaattcaaaaaggatagtgaaagaaagagaaaatacagacccactgcacttataaaccagatgcagaaatcctaagaaaaatttcagcaaattataaaagtttatgcttatacctatttacatctatttgcacacatacagtgcatgtgtatatgtgtgtgtgtgcacatacaaatacaaaaatataaaaataaaatttgaaagttattgaaatattacattataacaaagaaatttattctgaaaagataaagatggtgaaatattagaaatttcattcgtgaaataatatatgaagtcatgtaggaagaaaagttggatccaaacctcaaacaatacacagatgaattacaaatgaattaaagatttaaatgtacaaaataaaattataatgaaagacttgaggagaacacggggtaattgttttataaacttggcatgggaaaagccatcctatgattcaaaattcagaaactataaaactataaaagattgagctataactataaaagattgaaaatttatctgaataaacataaaatttctatatgccaaaaataagcaaatttaaaatacaaattttactttgggaataaacttctgcaacttatatcccaaaaggctcatatctctaatatataaatagcccttagaaatcaagaagaaaatgggcagtaaaatgtacagctcttaagtgtacagttcggtgaattttgacaaatgtaaccatgaccaagaagaaactattgtacaattccattttggcagaacattttctcatgacactttctggtcagttggcccactctgacctagaaggcaatcactattctgatttctatcagcaaagatttgtttggcttttttttttagcatgcttttaaaacattcaaagcatttaaaagcatttagcgtgcttttaaaacacaaaggtatttactatcacagttttgcttttatttaacatagtgcggtagattttttgccgtattatatgaccataataggaaatgaaatgcataaggtttggagtggaagaaaatcagttgatatttttcataaacaataagactgttcatctggaaaatctcagaatttgcaggtaaattattacagtgagtgagagagctcagcaaacttgttatatatgagttctaaaaaaatcaaagaagtccataacatttttatctaccagtgacaattgaaatgacaatttttgaaatgtccataccaatgaaaagaaaaggtacctaggaagaaatctagcaaaacatttggaaagcaacttggcaaaatccagtgtagtggcaaatgcacttactgtgtactataaacttagcaagaacacttttagatatttcctgagaaccctcacacttgcgttagaaggccaaagtatggggatgttcattgcagcgttgattctcatcacacccagggaaatacacagacaaaaaaacaacataaaagttagccagtgaagaatagatacgtaaataaatgaaaaatatatggccccttgcctcaaaggacatgaggctagaagcagttcttacagctgtgcacatggattgaaggtgagtacctttctgcattttttatggcaaaattgtgcagatttcaagaacatcatgggaatgatttccaagcagggcttctaatccatgtgtgggcaggatgctgctgtgcttggaggagcaaataggcctgcccagagtggaagctcaggacaggggaggtgggagtctgcaacatttctcctgagaaactgaggctgcatagtaatagaactggtttgcttaggcccgaaatatttactttcaattcctttcccaaatatttgtgcatgcatgtgtgtatatgtgtgtgtgtgtgtgtgtgtgtatgtgtgtgtacacatatatatgtacagatatattccctgttgcattgtatataggtgtggcatacacaaacacacacacacacacaggttctgtgctaagtgtttctctttataacaactctctggggttatgttattataccttccttacaaatgtagacactgaagcttagacaggttagataacccaccaaacatcacctagaacattcatggcaaagccagaattcaagcctagactctaagaacaggttttaatacatcatctcttctatttcatagaggccccaaatagggaggatgatttgctgtgtagaagaaaaatgtcctgttgactccttgatccttgggcactgggatccttctgctgctctcccactttaacataatgtcaaattcctggaacgtgctctacccatgtgtgtaaactaagtcatattcatgaagtcaagctcgctttaatttggaaaattctgcaaggaaaccaaaaggcaaattatgtttgtgggcaatcgtcttcactagattgggcatcttcttaaatcagtgactagctcagatctggagaatcaatatctgggattgaaaaaatgggcttttttgaatgctctgatttagtgatctgtaatagtaatatctgttcatcttttattgcaatacaagcaaggcactgagttcttc

SEQ ID NO: 857 - DNA, 3987 bp, Homo sapiens
tcagaacgtcgagatggagcccaactcactccagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggagctccagctgttgtgggaagagaggaccagccggcaacttttatccagctctaaactttatttcctcccagaagacactccccagggcagaaatagcgaccatggcgaggatgaagtcattgctgtttccgaaaaggtgattgtgaagcttgaagacctggtcaagtgggtacattctgatttctccaagtggagatgtggcttccacgctggaccagtgaaaactgaggccttgggaaggaatggacagaaggaagctctgctgaagtacaggcagtcaaccctaaacagtggactcaacttcaaagacgttctcaaggagaaggcagacctgggggaggacgaggaagaaacgaacgtgatagttctcagctacccccagtactgccggtaccgctcgatgctgaaacgcatccaggataagccatcttccattctaacggaccagtttgcattggccctggggggcattgcagtggtcagcaggaaccctcagatcctgtactgtcgggacacctttgaccacccgactctcatagaaaacgagagtatatgcgatgagtttgcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactatgtttcaagctgctcaaaaactgggaggatatgaaacaataacagcccgccgtcagtggaaacatatttatgatgaattaggcggtaatcctgggagcaccagcgctgccacttgtacccgcagacattatgaaagattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagcaagaaagaaaaagaaaatgccccaaagccccaggatgcagcagaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagcctctccagcagctacccttatggctccccaccccctttgatcagcaaaaagaaactgattgctagggatgacttgtgttccagtttgtcccagacccaccatggccaaagcactgaccatatggcggtcagccggccatcagtgattcagcacgtccagagtttcagaagcaagccctcggaagagagaaagaccatcaatgacatctttaagcatgagaaactgagtcgatcagatccccaccgctgcagcttctccaagcatcaccttaacccccttgctgactcctacgtcctgaagcaagaaattcaggagggcaaggataaactcttagagaaaagggccctcccccattcccacatgcctagcttcctggctgacttctactcgtcccctcatctccatagcctctacagacacaccgagcaccatcttcataatgaacagacatccaaatacccttccagggacatgtacagggaatcggaaaacagttcttttccttcccacagacaccaagaaaagctccatgtaaattatctcacgtccctgcacctgcaagacaaaaagtcggcggcagcagaagcccctacggatgatcagcctacagatctgagccttcccaagaacccgcacaaacctaccggcaaggtcctgggcctggctcattccaccacagggccccaggagagcaaaggcatctcccagttccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacgtacttgaaaaaccagactgtgctttctccactcatgcagcccctggctttccactcgcttgtgatgcaaagaggaatttttacatcaccgacaaattctcagcagctgtacagacacttggctgcggctacacctctgtcatccgtgcaccccagtacaaaactgtaggctcagctctgcccagcagtccaaagcggcatggcccacagagcttcactccttacccaggaggtgctgggcttatagagttagaagtcagtttttcttctaatctgagggtaagatcagtcccagctgtaggggcccagaagggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttt

SEQ ID NO: 858 - protein, 1167 aa, Homo sapiens
MEPNSLQWVGSPCGLHGPYIFYKAFQFHLEGKPRILSLGDFFFVRCTPKDPICIAELQLLWEERTSRQLLSSSKLYFLPEDTPQGRNSDHGEDEVIAVSEKVIVKLEDLVKWVHSDFSKWRCGFHAGPVKTEALGRNGQKEALLKYRQSTLNSGLNFKDVLKEKADLGEDEEETNVIVLSYPQYCRYRSMLKRIQDKPSSILTDQFALALGGIAVVSRNPQILYCRDTFDHPTLIENESICDEFAPNLKGRPRKKKPCPQRRDSFSGVKDSNNNSDGKAVAKVKCEARSALTKPKNNHNCKKVSNEEKPKVAIGEECRADEQAFLVALYKYMKERKTPIERIPYLGFKQINLWTMFQAAQKLGGYETITARRQWKHIYDELGGNPGSTSAATCTRRHYERLILPYERFIKGEEDKPLPPIKPRKQENSSQENENKTKVSGTKRIKHEIPKSKKEKENAPKPQDAAEVSSEQEKEQETLISQKSIPEPLPAADMKKKIEGYQEFSAKPLASRVDPEKDNETDQGSNSEKVAEEAGEKGPTPPLPSAPLAPEKDSALVPGASKQPLTSPSALVDSKQESKLCCFTESPESEPQEASFPSFPTTQPPLANQNETEDDKLPAMADYIANCTVKVDQLGSDDIHNALKQTPKVLVVQSFDMFKDKDLTGPMNENHGLNYTPLLYSRGNPGIMSPLAKKKLLSQVSGASLSSSYPYGSPPPLISKKKLIARDDLCSSLSQTHHGQSTDHMAVSRPSVIQHVQSFRSKPSEERKTINDIFKHEKLSRSDPHRCSFSKHHLNPLADSYVLKQEIQEGKDKLLEKRALPHSHMPSFLADFYSSPHLHSLYRHTEHHLHNEQTSKYPSRDMYRESENSSFPSHRHQEKLHVNYLTSLHLQDKKSAAAEAPTDDQPTDLSLPKNPHKPTGKVLGLAHSTTGPQESKGISQFQVLGSQSRDCHPKACRVSPMTMSGPKKYPESLSRSGKPHHVRLENFRKMEGMVHPILHRKMSPQNIGAARPIKRSLEDLDLVIAGKKARAVSPLDPSKEVSGKEKASEQESEGSKAAHVLEKPDCAFSTHAAPGFPLACDAKRNFYITDKFSAAVQTLGCGYTSVIRAPQYKTVGSALPSSPKRHGPQSFTPYPGGAGLIELEVSFSSNLRVRSVPAVGAQKGGEHA

SEQ ID NO: 859 - DNA, 48652 bp, Mus musculus
  misc_feature (1)...(48652): n = A,T,C or G
gaaacctagtgtctcccagctcacctgtgaactggaaggaaggctgcaacctgtgtgtgttgtgtgctggaagagtccaaaaagacatagggcaaaagctcggtgtcctccttttgaaacctgtcgcctacatcaagcagacagcaggagatccaggaaacaaccagaaaccaattttttaaaacataggcttaacaaaaagaaatcaaataggcaaatgaaaagctgttctcatcctttaatgtgacagtgtggtgaggaccacctgtgatccctgcacttgggaagcagagtcagggggattgcagattcaagcctgtttccatttctaatgacaaacactggttatcaacagctagggcagggcaggaggcaggaaatgacagagagaagggacgatgggcgctttgtccaggactgtgaaatctatgcaggcacaaatggtcaacattgcttcctggatacagaaattgtatggttttattatgagtgcctcctaaaacaaatgcacgttaaagactaatacagtcagcaatatgaatagaaagcccaggccattcataagcagagtgagacattggggcttccagagccctgtgggctccgagaacagctcccactgtggtgcaccgttttcctgacggccttgctggccctgatcccagccctttcttggctggtctgtcaaagtgtgggatggcatctggctctgtgctaaatgaagttgacattagactttggtgcctaggaccagtactgaagctgatgactgctcttgggtcccatttaaggctcagatactcccactggactgacttgggcactcgggagcccctcagcgtcctgtctacagtcctgctcccaagatgacttcagagggcaaggaggccgacagggatgtgggacacagtgggggtcgtcacactgatgacgtgtacaccgtgcccggcgctctgcacatccttggcctgccttcacctgccctgtccatgggagagcagactaatttacccattgaacagtcttagggccaagagccttctgagatgccttaacgtcacagcccactgcagctccaccctctagccctactgtcaggtcatggtcttatttgtccgacctgcttttggactgtggtcatatgcctaccaagctgtgcgccagacaggccttctctctccacagcatgactaacaccagcttcctgctccctagtagagccctctgagagatagctggtgtcatggggacagggcaagcggagcacatggctttccaagttcctaaagcctgagagagctaagaaatgagggaagagctgagagggacttggcctggtgtttgcaaaacataagacaagatgccctagattttgtgggaacacaggtaggaaataattaataaatctgctgctaagagaagaaaacagagcggttggccttagagaggatgtgctaggacatcccactggtgaatgggacatgccagctgtggtccacactgactcagctaatgcctagccactcacctttcaaaggttctggaacagtcctcctggcctcctaaatgtgccagtccccacccccacccccaacacacacacacacacacacacacacacacacacacacatacacacaccaatattcccactaaatccatcactgagtcccctcagatttatctctctgacttgtgttggctttttgtggtttccacgaaaatgtgagatgctcccaggacaaggacaggttgacttgtttgttcagtctggtctagagtaggtatgccgtggctttgtgacggacaaacgggttagcagactggcagatgctgagagagaagttctgtgtgcccacacacagaaagagagaggaaagagaatgagggagggaagaggaggaggagaggaagagggggaggctggccatgtaacaaccctgaagtgcacctacagcagttattctgtgagattagaatggagctgggtaattcctgtggcttggtggcatcacggccatgagaaccttgtagcataacacattcctcgtgtgtttgtggtgacagtggtatacataaatttactgtggtgtcaactgtgtaagagagaacacgtagtaaaatcatctatggcactgggcatttgctgatgaaaatgagtgactgtgttacttacatacttactatattaacttttaattgttactttagagttcacccccacccccatcaacaccaccttttcttgttaaagaacaagttaagggctggagagatggctttgctttgaggagtgtctactgctcttgcagaggacccaagttcagttcccagcatccatgcctggaggcttgtaactgcctgtaactctggttcctggagagtctgatgctctttacaattgatgtaaacatccatacacatttgtacacacatacacacacacacacaattaaataaaacacatctttaaattaaagcagtgcagctttaatccactaacataaagcttgaataccccatgttcactgttctcttcacaacacagttttgtgtccccagttactctctttattcaccatggccccaggagcagtagactgcaccacacatatcaatagcctgccgtgtgctaggccacaccatttaggtttgggcaagagcagcctatgacacccccatcaggataacttcttcagaacatgcacattatcatctgtgtacaggtacttgtgtgttcccaagtacagtgtcccctgagagagcacatagacttgccctgtgacacttgagatgcagcagaaactagatgacccttcacagttctaagattctcaatggtggcccgttctccatccccatgggatgtggtttggatttcttagcttttccacgttctgattgctcagtgctcaagcatcatatgccagcttcattcactgtctctctaggactctgcttggtgagactgccaggttatttttccatctgggctgtccctagctgtgtggccatgagagtcctttcctattagaaccatgagtcacatcacttgccatggggcccggtagggaacagaagaagtggggactcccagttcaaaacaactattgaagacctatgccagaggtacactgtcacacagcgccatatgaaacccttcccccgagggcccaggagaggaaatgaagccggttttccaaacacaagaaggggatgatgaatatactcctgcaccactgagcaataattagtactcccccatgccatcaatcatcgacaggaagtgctttgagttgctgagatgatgaaccccagcttctggagggaatgagaatctatctttgttagagagaacttggggctgttgggagatcagagaatcggaaagcacagggaagaggccaccagcagcctcccctcaggctcctcctgcagaagagaaagcttgggaggtggaggagggtgggaggctggagggagagggcctgaccctgcagctgcttcccacacactgctggctgccagcacctggcctcatgagctccacagagaggcagagtgagccccgctgcaggcctcatctctctcccatcagacatggccccctaagggtatcacatggcttgaggggtgcagggatggccagacctctgctcctggtcactgcaatcttttgagaacaagaagaaccacctaatgcagatactcaagtgggtagagcaaagaaagatggcagagagaggcaaccttggcccacacacatagaaaaatgactacaggtttgtccatcctgcagggctacattgtctcagtcaatagatgtgagataggatgtttccaaggtggtactttcatcctaataaataaacccatgggaagccctcctcgttcaagggtggtccagcaggctagaacatggagtcacagagcctgagctgtttgggtggttctgggtagcagggagtgcagccacctcagagaacagaggcaagctgcccagtcaagacacactgtctaaggagcgaacttgggacaatgtgcctaaactcctatatgatttaatgtttggtgcatttctttttaagcaggaatcctatttttctctgtccccagggtctgtaagatagctgcatgcacagttttatagcagctgtacagaaatgtggatccatgcatgcatacatggataaacaaaattcaggatactgcaggtcataggtgagagatgctgttgttcagcagacctaagcggagagagtcctagctacgtctttctctctgtgttcctctgacttaggtaaacgttaagttcctcctcccactctacgccgtgcttctggggagaccattgagacaatgcttcacacacttcaatgtgctcagaagcaacagatgcagtggaaatacagattcccaaacacccatcgtgggtaggtcccggactacttctcttaggagatgctgatgatgcggggcagatgtgtgtatatgttgggtcacactgtgacatctatttcctccctgggtttcatcctgttatattacagcagaaaagcatcctgcttgtcccctcttgctctgtcccaaggtgtgatgggtgtgctgacatgagctagaattatctgagaagaggaaatgacaatttcaagaatgcctccataagatgagtctgtaagcaagacagtggagttttagcttgattaatggtgaatgtggttaattaataacagatgtggaagtgttcatcccacttcccagggtgacgccacctatgcgctggtggatctgggtcccactcagaaagcaggccaagcaagccatgaggagcaagccagtaagcagcatccctctatgacctctgtatcagtccctgactcaggttcccctgctgacttcctgccctgacttccctcagtgatggagtgtgacatgaggattgtaaggtgaaataaacccttcctcctcatgtggcttctgaccatgatgtttgattagagcaatagaaagctaagacaatgggtagtctttgttgtcaaagacttgtcttggcagggttgagaagcacccaggagattagtgaagcatacctctggcaatgtcagaggccatccccagaaagcattaactacagaagagacatcttctgcatgtgggcagtctcaccccatagaggtggggtaaaggggaagaaagagaaagccaaccagtgcaggccctgggtctcagagctgtggcatctggccacggccctcccaccttgatggacaaaatactcaaaaaccataagctgaaacaaatctttccctcctggaaagggcttctgttgggtctccacccgtctcctctccccaggaatgggatgtgggcctctgaggataggcagggcctgggatgctgagagctaagtgtgttcctttgctcagctttgcctcaggcatccatgttcagcatcaggaatggctggaaggagcaagacactgaagcagcagggtctctcaactgcagcctcatcatagaccacctgacccctgaagtattgccagcagggcagaaattggtcctatcctgtagccccgaacatggtcaaggtggaacatttcagagatagttccagtgtgtgaaacaccactcaaagagttagcagatctctaatatggacctccagcttgatgaggcacaaatgtctcaagggtcatccctcacacatgacctacctgaaccttcctgtcccctgccagacacatagcagttttacctactgcatgtctgtggaagccagacctcaagtggagagagttctttgtgagaagcccagctatttctttgcaccgtgagttagttttgaactttcatccttgcatccagacatctagagtgcacagccatgatgcccttcctgggtttgggcagatgggtgtgtctgtttagcttttctacttccatctagagggaagaaagggcagacagttgaatctctgaaggaccatgaggactttaccccagacacattgacatccagaagaccctctttagcccaagttctctgaggtcaggtcatccagtgttggccacagagtacattagaggaaggaagccatgtacagaaattaccaagtcaggctgaaaggtgaggacacggtgctgagttcaaggtcagggatgcctgacctcttcttccctacccttcataagctcctccgacaagggctgtgcagatccatcctatgagatgccacagagacaatcatgaaatgggacccactgtttcagcccagtgtgtgtgtgtgtgtgtgtgtgtgtgtgtgtgtgtgtagcaagggatggtcatatttcatggacctggcatcactacagttggtcacatgacctggcatcactacagttggtcacatgacctggcatcactacagttggtcacatgacctggcatcacaacagttggtcacatgacctggcatcactatagttggtcatgttgtctctccaggtggacactgtagaggcgggaatggcagaaagacaggtgagacagaaaatgaacagctaatgaggcaggagcagccccacctgcccaggactggcagcagacgtggctcatgtggtctgcatggacccagggtctctgctagaccatgaaaaatgtcccagacatcaggtaccagacaagtgcagctgaactccagtgggttatgttgacggcttcatggggggggggggggggaggggctggtaatttaccaatgggtgcagtttgcaggaccctggcctgggtcattgagcatctgaccaattatgcaagctaaaaaaaatcagcattgcaggtttatgggttgggtttttttttttccatcttctggtgccactactgtgaccaccccaatcatggggctcctgggccttgcacctctatcagtgtgaggaagtgaggctccccaaagtaatgagaggtcacagcagggacctccagcacatttcccccaggcagaggtgtcctccatctgtgcccttgctgctcagaaggatagcattgactgaccacagggccatcccatcccgggcagaccttacactttacaagtggcagcactgaccacagggccatcccatcccaggcagaccttacactttataagtggcagcactgaccatagggccatcccatcccaagcagaccttacactttacaagtggcagcactgaccacagggccatcccatcccaggcagaccttacactttacaagtggcaaagtgttgaagatgctgctggctttctgattacctctgtctgtctgttttccttttgacccgagttttattaggtgcatctttaatgagcctttcaaaacgggctgacactaaagtgcacaggccctgccctttcccgtgtttcagggtagctcttaagaatctgctataattagaagtcaattaaattagaaaccattaatatgcctcttggaaggcctccaatacccagagcctctgtctccttccacagccacagtggaaactcatccctgctaaacctgctgtcctaaagcaaggtcagagctgtggacctaaggcaggagtgtgtgtgtgtgtgtgtgtgtgtgtgtgtgtgtgtgtgcacacgcgcacgtgcacgcgctcgtgcttgtgtatgtgtgaggaagcaggcccctgtctgacctctgctgccttggcctagcccactcattagggctgtagccagcctctcggcctataggctgaggctccctgcctcccctgctgcctgccctagcttgctccttgccagaaggaaaacaccaaacaagttcacaactgagggcaacctgggcgctttcatcttgcctcgtgggactggggtgcaaaagtgtctggaagcctggccacttctgacaggccacccagtagacaacagtgatctgtgagggtaactctgaggtacctgagccatgtggttgagcccatagaagactcagaccctgttcctctaggccttgccagggaccctggccaggtctcctgaacacttgcagaatgcccatcttcagactctcccagagtgaaatagcgctgtggtctttttctcattacaaagttcccagagtggaactaaactctctgctctaattcttggtccagggcagcctctacactctttcacttccagccaaaaaaacaaaaaacaaaaaaaaacaaaaaacaaaaaagatctctgctttaaggacagggtgtcactcagagcccatccctgtgcacacagacagctttacgaccacagccaagaaggtcttcccgacgaagtttttggtcactcaacagtggacatttgagccttgtgtggggttccagggaactcaaacctacattcttgtccttgcactggtggcctcacacatgctggggtgtcgtgcagggttgtatgtggggtattaactcaccaccgagctgtatccccagcccagaatttcagatcccatccatcccccccttaaacaggagtgtggacatttactgttccatggggagaaggcaggacaggaaggaaacaggttctgaaagctgtaaggtccaggctcatcagatatgcatcccacctgcctctctgcctgcttaaatgtacatacactctaattctagaacccagactaagcagactttaaatcttgtgggatcagaaaaataaatagacgccaatgctcaaggtctccccgacttcaccccacttgtgcactccctctctccgactcaaacttactttccttattttcaatacacagtcctttggctactttccttggtgtctttaggatattgtagggccaagttcctacaagtaggagaaaaggggaacgacagggaaggtgcctccctacccagcattcttttgtgtgctgttggaaattgctggctcccgggaccaaccgtaaggacaagggaatgtgggataaaggctctagtggtttcctgaggactcagtttgttttgaggcttaagtcagtggtggattctggaaggttcctagtatactctacttctcaaagagaatatgctgtttgtaattaggttaccctcccccaccccacctggtgctaacattgtggccacagtgtggcatctagggaattgtctcttgttaacatgtaggaaaattaacactcatactcccaggtaaaacagcttgccttggaaatacaaattcccagttcacagtggaaaaggtgagcagataacactatggcagagccgtagagaagagagtagagtactagatgggagtactagagtagttggtgaaagtgtgtgaatccttgcactatggctatgctctatacattaaatatttgtatgaccttggacaagtcacataagctctccggccttcagttggttcaactataaaatcaggcggctgaactgcattatctatctgactcatccattctaatgagcatccagagagaaggcagacccttccagtgggctatgagagcaaggatggaccagactccaacagcatctccaagattcttctggtcctgcatccaacagcatctccaagattcttctggtcctgcatcccaaccagcaggaccagcccagggcaccccatagttaaagcttacacaggaccactcttccaattgaaaagcgtagtgaacactgccttaagctcccagcttaacagcgggccctaagtgctcagccatctctgggtgtgtgtgtgtgtgtgtgtgtgtgtgtgtgtgtgtgtgtgtgtgagtgtgtgtgtgtgagtgtgtgtgtgtgtgtgtgtgtgtgtgtgtttctatggcatggcgtgatgctggtgagggtgcctgagctgcctaagggtcatcagggtcatcagcctggagcttaccttagagtcttgtctgttctttgggatgcaccattccctgtgctgttggatggaaagctactgttatccacatgacaaaggtaaaggcagcaggaccacctgatactgatgcagtatgtcttttcaggtgtacttccaagagatcatggcccacgtcggggactgcaaatggatgtcctggctcccagtgctggtggtaagtgtttgaatgcctgctcccactgtacaggtcctccagaacctacaggctttccctcaggccacaaccttcactagctgtaccacttcacactgcctcagcctcatacacctaggcttccccagctgtcaaaagggcatgaggacaacagtacccctagttctaatcggaccattctggggctgtagatagaaatgccccctcaatgcctgtcagtgaagagttagcctgtgtgatggacccacagctgaaaaagaccagaaagctcttgtcctctggagctcctcctggaggagtgggttgggaaagcatgagactgagcgtctgtagcacccagatgtctagagactcaagagaaggggaaggtacctccttcatgaccttaagagaatccaaggcagaatgggtgtggggtggggataggttcagacagcctgctcaggaggaagtggttgtaaggatagctgcagatgggaggtatgagtggccaatcccggtctctctggtcactgtccccacataacagctgcatcttcggaaggggtggaggtcaagcatcctttctgtggcaggtgtctctgatgtgctcagccaaggcggaggactccaactgtggtgagaacgaataccacaaccagactaccgggctgtgccagcagtgtcctccatgcagaccaggggaggagccctacatggtaaggaccagcctgtgcccacgaggtctggggcacaggggtgtggactcacagcacattaaactggcactgaggaggaagaggtcaccaaggtatacgcaccagggctgggtgatacgagctgcagagcccaatgcactctccagatgtgcactcgctagatgtacactccccagatgtacactctccagatgtgcactccccagatgtacactccccagatgtgcactgcccagatgtgcactccccagatgtgcactctccagatgtgcactctctagcatatttctcaggtgttctgaattctggaaaaatggttttgtcctgacctgttgtgctcatagtctgattgtaagtgtggtgtaaatgttctccaggaacaggccatcagttctgagaggtgcccccccccttctgtggaaaggataaacacacatgctctttgaagcaccagaaaaatgtctgaggtgacagtatctgggattcttccagagttctgagaaaacttgggctcctagtgaggcactccaagaagccagtggacctatatttaaaggacctcatctgaggctggaggctgtcactcagcatcaggtggtagagaggaggaagcttgtagctactgtaggatgggcagctgagactggaaacagtgcacccaccattgtgcagtccactgtagtcacatgttgtgtgtcctcgtatcccttgtctccctggccagtcctgtggatacggcactaaagacgacgactatggctgtgtgccctgccctgcagagaagttctccaaaggaggttatcagatatgcaggcgccacaaagactgtgagggcttcttccgggccactgtgctgacaccaggagacatggaaaacgacgctgagtgtggcccatgtctccctgggtaagtgtgggcgtgtgcctccgggctgacccctgaacggtgaggaacactgaccctgtgagcagaaccccacaggcgcaacaggccttcacaaagtgtcatgcccacctttgccaccttctctggggaataacaacaggatggggaggcttgtcgctgcccatggccaggcaggcagccttcaggcactgcatttgtgcctgatatggggcatcatcatagaatagcctgactatgatgtatagcctttgtaaaacaagccggctgaacacttacaatgaagcattttagaagggaagtaatccagtattctacaggaaggtattatttttggcgttctgggaaatgtgtgggtaaaaacctgaatcctctgttatctgtgctttccactctgctgtgttatataggtctcccatcccatcaccccaccactccaccccccaaaaagcaaagtgagaatgcaattggtctgagagacaaaaagataaaaatctttctgttttcctgatagactgcattagcaaattctgcctagaatcagaaaattcctgtctggacacccaatcaatacacacagctgttgctactgcctccctctagtggccacagcatagcatgtttctccagactcccagatgaagagagaagcagggtgggaggagggggaggagatagaaggctgatggtgggccctggtggtggtggtggtgatggtggtggtagaggtgaaggtggtgaaggtagagatggtggtggtggtggcagtggtagaggtgtgatggtgtaggtctgggtggaggtggtagcagagatggtggtggttgactggatggtgctgatggccatgatgtggtgagcctaggggagtgggaggagctaattctagtggtgaacattaccttttgggaaggaagtacagaaagacaactccaatgtaaacataattgtgtagtaaattcactattcatcacacacacacacacacacacacacacacacacacacacacacacacacggagagttcaatttcattatagagaagtatcgtatttcacagcgtccctcactgcctgtgacaatggtgacacccaccccagtttcccagagttctatcttcagctcaggccacctcctgagctacagactcaggtatccaaatatttgccaggcaatcatgttcaggtcactgacatgattcaaatgtatttgcctagcgaatctgtgaaacagtagaacctcatcttgtcaccttatccttccgtatgctcaagagcagagccgtctaaatggagagggcggtagactacttcctttgaaaagatgagaaaaaaaaatgtgtttctttttgcataattgttgcaggtattgggttgtgggactccccaaaaaacagcagcagcattagaaccagaatggtctctaatatgggtccccatatacctgtataagcaccactgagagaccctaggcttgccgctgattttgatgaattcatgtattcattggctttagattggtttttttcttggttcaaacttatgatacacaacaaaatgcagagcacctggcagtcacccgcgtaaggcacacccatcccattgtgcgtcctttggagggaaagaaccttctgtgtaaacaccgtttatgagccatgtgatagctggattatttcttttcctggggaagcagcaagcatcttcagggcctggtcctctggttcccatggcctaccgtgaggagttcacaccaggatgtgtggagatgctagaggctggtggagccagatggaagcattctagcaaccagcaccaaactaactgatgcaggtccccacgcagaaggccaagtcagggaaggatgcaacagggctcagtggcagcaggatccttttgacagcgtcaagggaaatggctgaggagtgaatagcctgggacctagggagcaaggacctcagtatggagagcagaggatctgggacagaggccctggggtggcaagagtctcagggatgcccagcagctagatgggggcgcaaggtgaagaataggtgcagaagactcactggtgtttgccctccctgtgccggtgtggatagttacatatgttgaaatgtcaaatacaggaggaagaaggatttggtggggatgtggagacaggtggtggccagacgtaataaacatctgtgggacacccagaccaaactcacccatgtggatggttggagaggtgtgagattcaatgtgagtgatgagtattagtcacactagagccattggtccagatgggatccaagaagcagcctcacagagcagggagcatgggccagtgcatgctgaagctcccggacccacatgcctagctctccagcgactgtaggagagccccgtgacagcaccccatcaggggtccataaagcaattgtcatcctgttccagattatcgaaaaggggcagtgactgtatgcagctgctccactaccaggtagagctacagagaccttttagctaaaacagacatgcctgggaccatacagtgactgtacggctcaagtcagatggcagctagtgcttaagagctgactagagagccatggagacaattttcctggtcccgatatttaccagaaagcatccaatccccaaaacagttaacaacagtagtgagcctgctttctttagacgcttcaagcagatgccatttacagaatgagtgctggggctgtacggattccagagtcatgttcccaccctgaaatcttaagttctccttctgttctgtgcaacagtaactttatcttcaatacctgggacagatcgaggtttgggagcgagagagggggcctatgtttatccctgtcccggcatgcattacatcactctacaaacgtggagtaggtttataggtagtcagttccccatttagcttgcagagagatatatctgctaagtcagtcattcctgaccctgaagcctctaaagagaaagggtccacttccctagttcctcttagaaccacgacttcttcactcggggtctcaagtgccacaggagcaggacccacttcctgttgcgtgccctaaacttacagaacaaaatgaggttctcatgctgtcacagaagaccatgggggcattttggcaggctgggcagattagctccatgaacccatgtggttatgagccaggatgtagatttacctggtgtttgtctttttaaggctgagagctggccctctccccaccttgtggtttggcgggtactggctccctttctctgctctgtacgcacatgtggcccagacagtcactgaacaatagcagcacacggggctttcctgttatgaaaggtctgtgtgggagacaacaggaggcacggacatggcagcagggaaggggttagatttcataacctcccccgccttggcatcccctgccctgggtagctcctgcagccagttctataccagccactgcttttacagaagaggcttagcaactaactgcccatgggcttggcaggctgtggaaaggaatcttcaggtcactggttgaagggtgtaggtgtctcatgatccagaacatccactgtaatcttaggtgatatgaaacaggaatctgaagggggaaatcctttcctaccatcttagaggatgtcagcctgaatgcttagatccttgtttaaactgacttttgccctgattagataatttagggcagaaaaaagcagaaaagagaaagagagaaggagagaatgcttgaggtagtgcccagctcacagtggctcagcttagctcccctccaccccacaaattatgatggctctactcattaaggagaaacatcacttcagcctggcttaacccaaagttagtagcgagtcctcccatgcagccaatctgcctttcacctccagagcagaacttacatgagacaagctttattaggaagtaggtttttatgttagcagatgcaacctaactgtaggcaaagatgtgtgttctgagcctgctccaccagctaagtagagagctgggtgcactgaacgcattttctctttaacaatttctttagcttacaatcttatcagaatgcaacctcacggttaaggccaggagcatctgtagaggaaatcaaattaagaatgaacgagtaagggatcacatgtttacaggaagataaatggccttgacccttgctgggccacaggtgttcaatgaacacttcagactggaggagctctgggagagccgaagataggccagtgctctccactctcctctagctgtggacagaactctaaatgccaaacttttgttcgtttaggttagtgctgaaagaaaatgtttaaaatgttctctgggctggagagatggctcatccagtgcctgctgtacagcatgaagatctgaattcaaatcgccaacatgcacataaaagccagaagtggtcatacgcatcacagagacaggaggagccactcagctcattagctaagcagtctcattgaatcaatgagctcagtgaaagaccctgtctttaacaataaggcagaaagcagaccaactaaggaaccagatattgacctctggtcactatacatttacttacgcactgcatacaaatgtgtgcacatacacaggaacatatacataacaaaacacgcacacaaattcttccagcaatacatgctagaacacggttgtatgtctggaggcatttgacacgtgtgccaggtagaccatgcaacttctaaacagattcttagagccaacccatcctttaaaaatgtctatagcagggctggagagatggctcggcaaataagagcactggctgcctttccaaaggttctgggtttgattcccagcatctccatggaaaactgtaactccaggcttaggggatatgacttcttctcctgacctccgacggcaccagtaatgcatgtgctacacaaacaaagcaggcaaacccaagacccacacacataaaataaaaaccagcaacctgctcagcagtgttccttcattaagtaactttgtactgcttggtcaagtgcacagtcagggccagggcaagagcatggagatggaaacattcagagccccctgggggaatcagcaagagacacctagatgggactactggtcaacctacagcagcaagtacctacctgcatgccaagaaaaggctacctcagcacagacagcaacccttgactgagcagcctgtaggccttgcccaggtgctaaatacccagatcttgagtgtgtagcacgtcatcaaggccagatggtccacacctctcctctgtgtgcctccggagccttacctgtgacagagcctgatatccagacataaccgggacattcaagactctggctttgctgcctttaaaggcatgtgtgacctagtattagagctttcctcagctcagcactctgaactgtggagcagaacacagtggcattcattgatttgcccagtcaatattcaccaacaattgtccttccttagtgcccggcaagaggtatgaacaaggcttatccttgttggcccccagcacctggtttaatgagatgggagagagaaatggtgtgggcttgggagatgttagaaagctgtaagcagagctgaatggacaactggggattacccatgggtagatcctccattgtctatgtgtaatccattgcttcactgacaaagatggcttcttagggggccagagggtgtgtttgggagctttctccagaaggcttaacagttaaactgttgtggcttctccaagggtgtttttgagattggttaattaatgtttgcgagatgctcagggatctgaggataaaaggctttgaggaagggtaagcaattacaaccctgatgttactggtaatggtccaagctcaggcgggctgggacactcaggcaggctggggtccagagtgtcccagcccaccctcccccaaggagagtctcatcttaccacccacagccatctggagggccttcatggtaaacagctactgagaaagaagttaggaaacaattgcagttggatccaccagcagagatggcttctcatctcatgagttctaataactgacaccagcttcctttatttaattagacttctcacaatgtgataagtggcctcacggtcgccgtgcaatgcttgtttatggaaaatggctcacaccaagatatgagtcaaaatgtcaaagagaatcactacaggagggacgcggcagctgctgagggctggatcctttaaggggtgccgtgtgagacgtagccagaatcctgtttgggtttaaaggactggaagcagcagctactctgagtattcaccctttcctccaagtacaactgcagacaaactcaatagttacacagatgtctttagccccggggcagttcattgtatcagtacctggtttctctggggagagggtcatctccaaggctacctgcagtgacctgtgtggccaatgtagttattttctgactctgtcactgtcatccactcaggcaattgtggcgtcccaaagatcccgaataggcattttgcaagcaaccccaccaacttaggcagggtgacagtgataggaagagacacagggagctcactggtgcccacatgtggtggtgcataggtacttcctctgaaagccttcatgacagttgtacacactcacacacacacacacacacacacacacacacacacacaagcacacatgtgttaaacaaaccctttaggaaagaaagaaagaggtgggggagggagggaaagagggcgggggagagagagagagagagagagagagagacaggtcccaaatcatcttagttcagtaaaacagaatattccactttagggcatactaaacatccccccaaggaattgagggggtcctgagggctagtggcctctcaagtcctcagtttctaccaagttttctcatgcctggtttcagtcatggcctagtgacatccagggtgtgctgtgcagtgtctcccactcatttgcctttcctgtgtcttatcttgcctcctgtagctactacatgctggaaaacagacccaggaacatctatggcatggtctgctactcctgtctcttggcacctcccaacaccaaggaatgtgagtactcagcccttcaccagaaccactatctctcttaagtgcattagtaatgaccccacggtgcccagaatgtggcagtgttgcgttaaggaaaagaaatcaaagaacttccccttggagtaatcttaccgagaacaagcccagatctgaattccgctcctgtctgtctattgtacgagcctgaatctatgcctgcctgaaggctgtcttgtgaatctgtctgtctgtccctgtggctgtgtgtgtgtccctaacaaagggcttcattctctcttgtattgagcagcacagaaagcatcacatacggaagggatgagggaaactctacagaaacgtttgacagagttttacaagggattcagtcactgactccaactgtcccatataacaaacgtgactacatgtgtcactgcagacagacctatcgacctgtatccatgttgtagccagtatttatggtggacatgttccataaggttgtttccagcctatttgctgatttgggcatttattatcataacactcatagtcactacagatgcattattactcttgggtcgggggcatggaagattacagctatgtattgtctttggttgtgaatattgactacacagggaaatctaagacatggtaaggttggttgtcacactgttcttacaatcaggttaaataaacgggctgaacacacagtaggatagcattcttaagtcctaagtgacctcatggtggggctgaacacacagtaggatagcattcttaagtcctaagtgacctcatggtgtattattagttccagctgtcaggaccaacaaaagttccagtctttttagtactggtgtagaaggaagccaattccaaggcctaggtaagattagcatagtaggggctggcgatggaggcagctcagccatggacagcactggattctcttgcagaggcagccattcagttccaagcacccatctcagggggctaacaaccatccggctcaaggagatctggcctttataagcaacacacacacacatatacaataaaaataaaatctttttataaagaacaacacaacaaaggtataagcaggggataggctttgctgtgggccagatttttggagagatgttaagactatcagcagtacctcagacaagtcacttaactgtatgatctgtcatagagagaaagagaccttaagactgcacccactcaccttctgtgacctttaagaaagctaagggagctgcagataaaaagatattttggaagtacaatcaagtgcgaagtgacttgaagctctcgtgtctacgtagcatcacgcatgactgtgagaaatgtagaaatactcacaagttatcaagaaattgaatagtttccaaaacttacacataaactatcaccttcctaagtttataaccctccatggggctgcttcttttctggtcttacctacgatctttcatttgtggggaagggtctccttctgttccaaaaggatgtgtggtttcttggactttgccacatggcctaataaatgttggggtgttctgaagctggggcctgcatccaaatgtcaagcttactaaagatgtgttagtgagcaactcagatctgctgaatggaggtaggatgaaggatgaccaatagcctcatctctccacgctacaggaacgatgatcacgtgactggccaggatgcctgaaggcaggagttggagaatcagaaggccaggccattctctgccttctagctagtttggcaattggaatagatttgcatgtgtttaaaattgaacttcttacccatcatatgctaattaatttacaaagtggaggaggccctggggctcctggctgccagcctgacctgtggtaaagtcagctgcctgctaatgtatcttctgtcaggggatctacatgaatcaagggcctgataattctgggatgaggctcttgcctcagtggaggatctcaggaccacaccacccagcaggaaaggtcctttgcctatggcacccggcaggaaagcagttagctgtcttcaggggctgtcccagagatacatattcttccctagatgcctggctagtcagaagagcatccagtgtggggtaagcaagcagagtccctgactcctagagaaaaaaaaaattcaatgcatcccttatcccttcattgcttaagggataagctaggtcccaggaaggcttcattgtaggcttttacagtccagcaagactacctccagtcttggctctgggacctctcaagccggtctctaggcatcttgcccagcccagaaaccagtctgtgacagatgggtaggatgagcactccttcagtgggtctgagcctccttcagaacctatctttctcgaccattacccagagtgcattgtgactagggagattacctagaatggtagccgggtgaaacgagttgacccacatgctcagtgttgtccacagccccaccgtaggaaagccaaacctcatctttgtcgggatcttgaaatccctggctggtagcctaggctgcacctcttcctgaacggtggatttcctgggccgcgtagaaccaagttgtcattcctggtactctgagtcaaggaccctggggcacgtggtattgcagctacatgcccagcggagctgagcaggcagatggccaggtgcgggacagccagtccagctacatgcctgaatccgcttgagggtctcctcagcaggaaacacaggggtcggggtaccaatcgttctccccatccgcatgactgagcctgtgttggcattctccaagaatctgccgcctctctgagcaatgagcagaggaataggattcttatcgccctcccatgaaatgcttgagacagcatccatttctgagcctgccttggagtctgcgggtctgacattgggtgtaggttaaaggccccagctccagaacctttctgcctttgttagagtgtttatcctgccttgtggagctctggctccatccctgccaccacaggcttgcccagcaaggtgagttcatgctcaccaagcctttccacactcgtgtcataagagtgctactgcattgccacaacacaggccaccagaaggctctcgggagggacaagaaagtgacacgcgtttactcataaagtagaataaaatgtccctgctcctgggtggctgggctgctgggtggcaggtcagttgggcctttgggctgatggtcatctccattaaagcatagagacagtaaggtttttggaaccactttagtgtctgctttctctaccatataactgagacaatacccacacatactagggttgacaatacatcaaaactaggcagatacaactggtgtcttccctacactgaacttgtcagcagctgagctgtgtacagcctctgcccaaagccctgaagcaaagcccctcccctccagccagtaccagccccactgggagagcttcaggcctttattcttctttgccatctgctgtcacagcacactggtgagtccacattagaccaaaaggacatacaaagccctttggtttgtttttttcagtaaaccaaagagcaaggtgcacttgagcaagatgcttctgctacaatttcctttctcccatgttgtcctaagaacgcaggtgccggggcagctaagtatacggagcctatgtttagagggaggcaggaagtcgggaatggagaaaggtgtgcatcccatgtggtttccactgagagtttccacccctaaggaagcgatctccttctctggacctcagtttcctctaagactttgtgtgacaagatctccgtgaggacacatgggactgtacaggcagtgtgtgggaaatacccatgtaagtgctggtgacatagtcagtgtggtgagcagcagcctcagacacatatcagcagccctgcactcccaacagctcatctgggacagagtagttagaggggacacggacttaacacactagaagtactgtgttgtggcagtaacagtcatgacgcctgttctatagtctttttttttttttttaaatcatgtgtcagtggttaagacccatgagttaagtcaagaatagagtgttctcttaagaaggaacacacagtgaaatgactggactatggcatacagtgagccaaagactgctcatgtgagccttagaacataaataggaaaccctggcctcccagagcatggacccagttgtttctgtaaagtgccacgggcgactattcacaccaggctatcccatgtgtctgatcacaccagaacatgccacatagcaccaaggatcgggtgaggagcagattcctgccgagcatgtctgggcagaagcaaaggctacgttctgctctcacttctagcaactagtgagtatctgacaaccccacccatcactcacagatccaccgccagggtgtgtggtgtgtggccaatgccagggctgaggggcactgccttgacaactctaatagtcaaatcactctgaaaaaatccaaactgtttacactctatagagaatgccagccagcctctaatacgtactggcacatttataaattgtgtggattaacaacttcaaaggccccttatatgccatcatctctttgaacagaggtataactccactaagcctggtgcttacagctcactaagtccctgaggaaggtgagctgagccgcagctagactggcaattcagagtgaactagacacatctgtccctaccgtctggtctagtctagtgatggaccttgagtaaagacctctacccattttctggaacgttcatccttaccaggtgctatcactcatgtcatctgcagttgactattcagagagattgccatggtggagcaaatgaccacatgaggacataggtagtgtgggatattcctagctgccagacatcttgatagtgaagagtcagtcagtatcagaccagagtacaacctgatcccggagaatgtgtctgcaaggagcctagtatgctgctcttgggaatgtgtgctatagcagtgcttccatgatgcgacatgtggattctgatgcatcttctatgcccacccatgttccttgtaaggtaggatagtttatagacccatggcttgtgaaaggtgtgcagtgaagagtagcaatagccgagcactctgtgctggctcccccccccccgtctctgtctctgtctctgtctctgtctctctctctctccaagttttgccaaaacataggtcatacacactttactttacatgatatagtgtgttcataagattagcgtgcatgcatctataactctggtgtgtatgtttcaagggtttgggataatggagagcaggtgtctgtcttctctgggggaatttcccaagcattctgtggaacgacaagagcatcctgaagtcattaccaggggcctgactctgtctaccgaggcctgcaggtgccccattgcctagtctcataccacactgcttcttctacttggtcttctgggggtctgactgccccactgttctctatggtgtgtaatgatgggtaggcagttgagcatacctttcagcttagggatgggcagggctgggagcttgctctgctcacatcatgcctcccttgtgtggaagcggaggacactgaattgggaacaaaaaagaccaaataagatgtggggttttgttttgttttggtggtggtgatggtggtgtttgtgtgtgtgttttacttactgtactcagagcagtcctattgaatttgtttttaattgtgttacattaagaacattccttccacctgcctgaaacagaactgtcgctgagaacatctgattcaggcacccatgcatttatttgctctgagtcgcctcagctcggtctttgctgaaatagcagctccattctctcttgccagctctgattctgagaagcctactggcagctcatgggttgctgcctttagaacctgcatggcctgcaggcctggctggatccctgtaattctgctccgtctgcacgcagcataggtttcagcatctgcttcaggatcccccccgagggaaacgtctgcctccctacagattctggaaggaccctgaggtctaccacagggaaaagatgggatggaggtcatgaggacctgaagggtttggtggtaggatgcctacaggtgtttggctccagcctctggcttggagaggtctaccttctcgccatacctcatccctactcaccatctctcatgtagtcagcagagcatccttggctggagagtacctggcaactcctgcagcctatgtagcctggactctcccctgatgccagtaggagttcaggttggggaatgtccagtatatcagatcaaggcatagctggtccaagcaggtagcagctgcggcttgggaagatatccttagcaagtagcagcctgcaccagtgtttggcgatgtcatgtaaccagtcctcccgggtacaggggcatttcataagtctgtactcaccaagctaccttcattgtttctttctagaccataggcctgggtgtgtttgcgccccagccccaaccctgtcactgccttggtctgcaagtcctagcaagaagggacaagaaaagacagagattgctggcgtccgtagacagagcccttggctttttttctctccctctgcccacatatcttaagctcacttgagccccttaccaaaccaacagatctgtttctttgcagtgccctatttgttttagagaaagcaaattagattctattcaaagctgggtcaggacagtccatctgatgacatgtgacagctagtttccttgacaagaagtacaaatggcaggaccctggatcttgccttagctggctggagcagctgccaatctacagaagacttggtggggtctgtgagcagggatgggcacagcctgaatgtctgtcatttgataggttagcatagctatgtagacaggaccaccactgggggggggggagggactccctcagcagttcctccctaagagtgacccccaaatataaactttaaaagcggaacatcagccacaagaaagcttccagtcttcccccagaaagaggagagatcttatcctccctgggcaagtgactattctcctggctacactatagtgctatttctgtctaatgttgagggacaagccaccctctgagtaccttagcacctcacagatgcacagaaatccacctccagcctgccctcagcctgtgatagccttttgtactgccaccctgtttgtctgtctgtctcactatgtgttgaactaggtataaggatggaaacagaggcacttggtctctctccacagggtattgtaggcatacatttttttgcaacctactttaataagggttcaacctctcctctagcccaccacccagcagaggtagtggtagagaagttattagggtgtggaggaagtggacctgttgagcagtagttctttgggaacaagcttggtcttcttgggcagccgtttagtctcatagcaaacaccaaatatgactcagcagctgcagaccaatcctttcagcaagcagacaccaggcagctgtagttcaatcctgaagaaaccaccaggctcaccaaccggcctgaggtggggccattgaagcagcaagctgcctcaggaacctcatgagcagttcttgagcgagtttcttctctcgatggccattatcacaagttgagctcaacaatgctatgtaaggtgaaccaacacatgcgtgtctttagtgaagaatagcaaggcggagcaaaccaatccaaggctcagtgctcatctcccactgtcagtggggtcacatttattctccttcaccttaggtcctttcacatgtcttctatatccaaacatcctttcacctgtgtctgcttcaggaaagcagtctttcatgtgtttgctttagcagacatccttttacctggtgacccagcaaaacattatttgatataactaactttccaaagaactagaagtttccacctcagggtatgtacttagtgaggttgtcagctaattaggcagcacactccgcttcagtgggactgggcttctgttcctgggctggcataaggcagatggcaggaggcttcccacacagcaggcccgtgtttctcccagaacctctgttagactgctgcccctgcttactcctcactgaagccctgtggttctgtggactgacccttgtgtaccctccaggccaattctcttggctgggtggggtgggtgggaaggacatgacttcagggaggttggtgaccccacctgggcttacagctgcttttcagaagcacaggattactatatgaacctcttcagaattgagaaccaacaagcagagacagagagagagagacagagagagagacagagagagagagacagagagagagacagagacagagagagaagaagggacggagagaaaaggaaggaaggaaagaaggaaggaaggaaagaaggaaggaaagaaagaaagaaagaaagaaagaaagaaagaaagaaagaaagaaagaaggaaggaaggaaggaaggaaggagagagagagagagaagaagaaggaggaggaggaggaggaggaggaggagaaggaggagaaggagaaggagaagaagagaagaaggagaaggagaaggagaaggagaggaagaaggagaaggagaaggagaaggagaaggagaaggagaaggagaaggagaaggagaaggagaaggagaagaagaagaagaagaagaagaagaagaagaagaagaagaagaagaagaagaagaagaagaagaagaagaagaagaagaagaaaaatataaccccctttttcgttcaagggctaaggtcacatctgcatgctactactgctgagctgtggtccaaccctgattgtttttatccattgaaaaactcaagtttgacataaagggagttatttatcagagaaaaaacatgtactgtggtttatctgatagcaaatcagcttccatttttctttttttttttttttttggatacattttcttttctttctgttgtctttctttgttttctttttgtgacagagtctctctgtgtcagagtactctttagggaactttaaacatttcctctctgccccactccctgcaatacagtctagaactccaagttggttcatttcactgtggtgccttattttccagcctttgaaggtgatgctttgccagatctctgaggttctctcttcttctcgcaggtgtgggagccacttctggggtttcagcacactcatccagcacttccggtggcagcaccttgtctcccttccagcatgctcacaaaggtgaggaaggcatccagctttgggtcttccagaactcagagagctgagagtgaggagggagaggagacaatgaagacagagccctttcctcttgtcacttccctaatgtgacagagtcacatgattgctgcatgatcagctgcagtatcttggtatagaattgctacttcatgggtatcctggtactccagccaccttggcagggtgggaggtgacagtcaggagccagtgtcaacagtgatttacacttttaatactcatttccaatgacttttattctccctagctcattagaaatggaaatgatggttgagggtcactctcccctcgccatctcagtgcaaactcttgtgtttaacttatcccttctcatagagactcataaaactcatagaggagttgctctatggtttttattgccatctgattcttaagcatgtttggggttgggtctccatgagtcttggggtaccttcaagaaccctcaaagtgtcaatacacagcctgctacatcttgacccaaggtatgaggacagtatgcagacatactcacctcacttcccccagcactcgggaatagcatgtaaccgagaatagtaagacataattacccatctcccactcccacagttataaacgcaccagataacatcaaggagtctgaccatcctcaatgggctctcagctctgcacatccttccgatggccctgagtgccagatgcctgccactgcctctttggcaggacatttggatcttgcttcatgggaaccagatgtcctgtttagttattttggagaactgtaggaaggtttcagatagtccacacatccaaagcttcatcagggaaccaagcaaccagctccaggaataagcagcagcccagcagaagtggaaacagtaggagttgctgggtcagttcagccctctttaccctggggctcttgttaatactctgaagaggaggtgccaagtaaaaccaaaccaggaatgtaacctctagccggaggggtggccttttgcctgaattcccaagacagatacttgttcatgggcctctcttcatctgtacctttctctcaggatctcagggtaatgacactaagagtgagcaccccaggaatgacttcttgtttttgcatcctgctcttccaagtataatgcacatacacccagttggtagtgtggggggaagctgtacgtgagtggatacacccagttggcagtgtggatgagtggccctgacctagcagccaacacacggtttgagagccaggtccttaggccaagaatgatctatgaaagcattcctgtgattgtctctcctggtggcttggaggaggggcctgcaaacccatttatcctcctctccttgatgccagcagagctctcaggccaaggacacctggccaccgccctgattattgccatgtctacgatcttcatcatggccattgccatcgtcctcatcatcatgttctacatcatgaagactaagccgtcagctccaggtgacatccctgcacccatgtccctaacccaacactctgtcaccttctctgagagagccagggagctcatgccaacctttttctctttcttcaagcagcctgctgtagcagtcccccaggaaagagcgcagaagccccagctaacacacacgaggagaaaaaagaggccccaggtctgtacacatagcccacactgccccatgaacaatatctagcatgaaggtggggtatgttcaccttgtcctcaaacctggaagcccagtttcctgagcacctctggttccagggcccttgaggtggtagtgtacccacttgttctgtccccaggtggggacctggtcaccaaggatgtctactgaaaaggaaatgggaagggaggtccaagttcagtgccacaagctaactctccccaactccccaacttctattcctacagacagtgtggtgacgttccctgagaatggtgagttccagaagctgacagcaacacccacaaagacccccaaaaggtatgtagaacaggggctcacctatactcattactaggttgaacagtcccagtcccaaggatggagttaccatctgggtccttataggtccttgagcaggcaggcaggcaagctgtatcagcgagtgtactgggtgctggtgcctggcctaagaatgttccaagaatattagagagcagcttcccaccaaaggaggcaatgtaaaccagcactgaatttctgtttcctcattaaccacaggagctgggacaggtgtaaaatctgcctgctattccccacttgtccattcgccctgctcccaatctcccagatgccctgagccctccccccttctcttcaaactgaggagccaatatgaatcacaggatgcatacatgccagtcaggttatttagctgccagcagtgcttacattacataaagccagcaaccccagccccaggcctgagactggtcttgccacacccctaagatgccatccccacttccatcactggaccaagatcacacaccagtgatcaacagaactggaaccagagcccagactgtcaaccatctattaagggctggtgtaataagcctctgagagatttacctggctgcattttagcacattttccgaacattgggtcatagaacttacctctgttttaaaatctactgaggagggaagtcatttcctattgtccccattggacttggtccagcaacacagcatacaaactcctttctgctgggacctgtactgaggccttatagacaagtctgggaagggccccatatccctagtgttggtctttgcaactggagtgcagagttcccaagggttgttaagacattttccagaagagcggagtaccagaccctccttcttgacccaagacaggaccttcccacaatgagtcacgaattcctgccaagtctttcctacttgagaataaggactccagctacctggatcgggtccaggcactgtggaaggccagcctagagcattaacccatttggaaaattctagtgctctcaatactcccaacacaggcatctctgcatggtagaggtggatagtagatgtgagactactcaaggccttggaaaggacttagtttccacagcaccttaattctaactggtcattgttcagactctgagaattgtgatctgagacctgtcatacatgcaaggtgccaaggctgaggcagggctgtaagtatggtgtgatgccatttggtcccagcttggcccttccgtctttcaggacttttggttcctaaaagtagcaaaaagggaatggtgaacaggcaaggatgtgcccatggcttgagtttctcctgagaatttgagggactgaacttggggaaatatctcttgtttacacatataaatattatacttttgctcaaaaggtaaggccataagcctttgtctccacaaacagctcttggatcttggaaatgggtcttggaagctatgtggtgatctgtggaaacgccatgaggtgcttaataaagataccattatgtacttccatttgcctgccataattagtgatgagggtgggccagccacctccctcttaggccctcaagcatcatgacaaagtggctctgttagatggtttcataacttcttttttctttattctggctccagggctgtgtttgcatatggccttcactgctaacagtaacactcaaatataatgtgtggcaaatacaatccccttttctgaagttctttagctaaagcaagaaagtaagcagaatgctttgaaaaaaaataccgttttgctcttattttgaatggtttaaaggcataagctctaacccatggttgccaggtcttgtgtgatctgagctatagtcagagggaagcacatgaggggtgcatgatcaccctccctgcccactgttgggagctctctgtagctcccacaagtctcattctaatgacaggccacactagtcaagagtgcacttttttgtgtgttcttggttactctagaaacctggcatgaattggattccagccatctaatctcaataacttaacatgaagacccgtggttgtacttgtcttgctggggccaagtgcacaaatctagaacatactctgtgaatctttaccaagcatctgtggtgtcagaaagggtggagagatgtctaggtgtagccctttgtggtttcccctgcctctcggaatccacagcttcttgggaacccatgcagacatctataggacactcagtaccagaactgcttgtttgtcaggaaacaggatgtgcctttcttagctcatgtctccttacctagagctcataatgtgtagtaagtgcttaaggaataaggcagtgtgctgtgctgcccatacctgggtcggtgccgggacagcttatctggattggagcttcactaacaggtgccctggttgtttccacagtgagaatgatgcctcctctgagaacgagcagttgctaagtcgcagtgtggacagtgatgaagagccagccccggacaagcaggggtccccagagctatgtctgctgtcgctagttcacctggccagggagaagtctgtgaccagtaacaagtctgctggggtgaggctctggtaacactgcctgtggtacactggtgcagtgacttacagccatcagacaagacaccttatgttgaataagctccttagggcactgtttctcctaaaggtcccagctaggatgccaggcaaagcaacaagtcaaaaaataaaaaataaaaaggaatcttatcttaaatatactgcttatagaaaaaagagaaaagtgtttcaaaaaaatcattgtaaatgccagagaacaggaaaaaaaattcaaaaacataccatgcatatctaagcagttacacactctctcatgcacacaaacacacacacacacacatgcaattgtgtctatctgtgggttctatgagttgattaaacatatatacaaaaaagaaaatggtactaaagatgcatgcttcttattgtaattgatctgtaaactatgcaatgcaataactatttgcataatggtccatgtgttagttgaaataacttgaagatgatttaaagtacatgggaagatgtgaataggatctatacaaatagacattttacataggagtcttgagtaaccgtaggcttcgagatactaaatgtaaactcatgtgcatacacatatatatttctcttacatagcaatgttcagagggatttatcactaaagcatgctgtctgtggcatagagtgtgctctgaggccccggcatacagtccttctttagtttgtgccttgggcaacctagccaagccttgtggcaacgttgttggcagtaaagaaaattcccactgagatcctggatctggcctggtcctgtcctctaggtgcagtgcactaagagaacctggaatctatgctgctgccacaggcatgggctctttcacccagggccactcattgcctagctttgccctgtgctttctgccctggaaaagagaggcttctgtagctctgctagccgctgcatgcatggcttccctggtggccatctggtagccattcttctaaacataacaagggcagctctaacattggtgtcccctttaacacaaatggcacccctggtgcacacaaggaggggttgtatggaaacctagggacagtcttcctcttgataactttgggttatttctgtgtaaggccttagcacagcaagtatatctaggcaatgggaccaagccagcacaaacgggaagatttgtagtctttcccctctttctgaagatgaacattattttacttgttctttatagatccagagccggaggaaaaagatactggatgtgtatgccaacgtgtgtggtgttgttgaaggtaaggactagagaatcatctaatcctagaactgaaggtgtagtgcatgcctttaaatgcatatcccagcacttgagaggcagaggcaggtacatctcagtgagtttgaggacagcctggtctacatagtgaggtccaggcctgccagggactctgtcttaaacaaaaaaaaacaaccaacaacaacaccaaaagaaagagttattcagggctcactcccccgataatcttcccaacaccactgacccaaagccccgcatggaaaggggctcctgagtgaagaattgagcacattcatccatatctgatagaggttgtcagaatggctaaataaactgacttctgatgtggagggaaaggaaatttggtttctggtttagcctgaagcaccccatagtgctcctcttgcaggacaagcaacagcccagagtatgtgttgatggggacacaatgaaggggccccatatttctgtgcctacgttggtattgtcatcatggaaacatctgatggcacccagtagtcagtgccaatgggtacacgttctaagaagcacataggtttgagattttgtctttgggtcaacagtagctgtataaacacaaacaaaggtggttatggcatcagtaggtagacctatggatccagagtttctgtcattgatggaaacgttgtcatgtaagggatagctgtgcctagaagctgttatcttccctcttgagcttctcaaggcaagagggatcttccctccttccagagcagccacaggagcagcaagttcaggctgccttaagcaggcaggtaagaagcaactggataagaagcatcaacattccagtcagtaatcctcctacatgctacaaaatccaggccctaaattaacttctatttatcctggaagtaaactcctcactgctgaggtcaggggactttccagcctcatgccttgctggcatctctccatgcacctctgacctgattgaaccctgggactgaagagagtcacatgccgccactcatgtcccatgtgggagaggtgcaggccctaagccggggcagactggttagatgctctgtttggcctggagtaaccactgagctggaatttcagggccaagaataattcttggctgccttcagaaacctggcatggctccagaagtgcatgcctggtcagcctgctccatcaagcttggcatggtgggtgctgtaggctgcccagaagagtctggtctgggagttacattccagcaaccccaagccttttctctcttccaaagaatgtcttggctttgaaagatcaaacccacgggactgtggctttcaaattaatttaaaacttcaaccataagaagagccctctcgagtgggtcctgtaaggtggaagcttcaagcctgtgccctcaggtgctccttgacagcccaggcatgtgtgcctcctaatgccacagtaataagatgcagccaagcctgagattctaaagccagtatggcttggctcctatgaagaccttaatactcactaccttctcctacccaacctgcgccatcttcctcaagatcctattatgccaccaaagtcccccagttattttaaagtttttttgtattgcaatatttttcctacccaccccatctccccatgacaaagttctctgtgtaacagtcctggttttcctggatcttgctccgtagacaaggctgaccttaaactcaagagatctgcctgcatctgcctcccaagtgctgggattaaaggtgtggactaccatctagcttgtgatattcttaccacttggtaaggtgataggacaaagcctgggtgcacttctccaagcttctcctgatggtaacagctcacaaaacccataaaatcagaaccaagatgtcgatgttaacacagtagacagagaccccttccaccaccacaagggaatctcctgttctccagcccccctagtgcagccctatcaagcaccaatctgctttctcttactataattttgttatttcaagattattaaagtcaaattggggcctggagagagggctcagtcctaaagagcagtggctgttctgcagagaaccttgattcagttcccagcacccatgtggcagcttacgatcatctgttaactctagttccagagggtctggcatcctcttctggtctctgtggacattgtatgtgcatggtgcacaaacatgcttgtaggcaaacacccatatgaaataagatacacgttttaaaaatatttttgaaagttgatttatacagtatacactcagtgataagctggtctcacataccataattcagtagagattcctttgggttgctctgtacggcagtgtcatggcagtctttgagtagattttttgaaatttctgcatagatgatcggtctatgcatacaagggtagtttgattcctttctaatctctgtgtacttttccttttctgccttctctgctttggcatgatgtcacatttgagctctgtgagcagagccctggtcccaacctcagcttttagcagtgtactagctctggacttaacatcaaagtcacgttgacttttgaataccgaaccagaactatacatccctagaataaatgtcacttgtagtaaataattctctgttctattgttcaattctatttgttaatattttgttaagaatattgattgttcttggtctagttttgatatcagattcggaaatatttccttcttttctattttctggaagagactatttaggacttccattaattctttgagtacttactcgatgtgtactattgagctcccattgagcttccatttgtgacatgtaattctgaccaattcctctcttaggtctcagccccaccgagttgccgtttgactgccttgagaagacaagccgaatgctcagctctacatacaactctgagaaggcggtcgtgaaaacatggcgccaccttgccgagagctttggactgaagagggatgagattgggggcatgactgatggcatgcagctctttgaccgcatcagcaccgcgggctacagcatcccagagctgctcacaaagttggtgcagatcgagcggctggatgctgtggagtccttgtgtgcagacatattggagtgggctggggttgtaccacctgcctccccacccccagctgcgtcctgaagagttgtcttggactgtcttccctgggaccagctggggatccaatgaagtcacgaccgacagctgtgagtgatgctatcagactgccaaaactcaaggcatttcctggtgggtcactgtattccttaggctgccctaagtagttcattgagcactcaaatgaaccaaaccatgtgggaaggacacaggtgaagaatctgatcctgtcttttaaggaggcacttagtgagagatgggagcatggtatagaccgtgttaccaaaacatcacctaggcaaatgaagggatgcttttttaaaaagtagcaaaagttataagggtgatagagtctcaaggggttgaaagtgggaacatcctaatgaagaaaataacttcaaggttttagtaaaacggttacaaagtacaggcatcccacatccttcatggcctcagacagagcatggtttgctggcatgccctatggtttcagaggtaactcgacctgtgtttgcagtcacacaccatggtataagccttgcagtcactagtggaagaactcaccatgtgtcactgacatacaaggcgtgtgtctgtccagtcacaagtgtgggcagatctggcctccagcaccactcgcagccacagcagttacaatgtcaggcttgtcttgcttcaaagggacgtgcgtcctatctagagaaggaaatggtgacttgctcagagtttgaccatgcctgattcctgggtgaggctcgagtgagttcaggcacaacatcctgagccagtgaggggtggtgcagcccgagacgcagtacagagctggggtctgaggtcctgggcactgggagagtcattcaaagtgtctgtctcctccagacttagcttctcttagctgagagaggttggtcttcacatctgtagtcaggaatgttgaggctccagtgagcgaaagggtgagtgaaagaacacggaggcagaagagaagaggccagaggagcctccatggggtaaatacagtgtgggtggccacaaaaaatgagagtcaagggaaacgcagccgccattctcatataagggcaactgtaggactgagcgtttacagggcttataaacagccattgctcttggcatattctcttactgcacctgtaactgccaggaaatgggagccaaggaaacttccccggcagggggttaatgccaagctggctgctgggctccctcccagagcgctgactgcagagaatgcttcctttcagtaaagcctctggtttagaaggcggttgggtttttttgttttacaaggcctatgactgaacaaaggctttggagagcaatcagtggtgtgtttaaaaccatcaagccatttcccaccactgaatatagaccatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggcctgagccagtgaagtcttaattgtgaatattttatataattctgtttatgtaacttattatatttttataagctcaataaacatattgataaaaaggagacctacagactggcgccctgtgaactcttatgagtgtggcagtatgagtggaagtgaatgaatgtcactggttgatgtactgtgtatgatgagactatggggttgtggccatccataaatgaggtaggtaacatgttaaagcagggaggtattcgctaacaggggcagacatgtatggggaacatgaagaccacatggggcactcttttccaccttgccaccatcagttacaaactcactctgtcgctgtcccaaattcagtgtcttggagcacagtcacttctcagtctagctttggagtcagtaagggccagtggggtcagcttgcccagactgtgaccaggcctctgcctgctggacaacctcgagaagggcagctctgctccatcatccttcatcctctccatcgtccttcatcctctccatcatctttcatcttcatcctcttccacaaagcagccgaagagcctgagctggcatgaagctcatcatggcaagcccagaagccgagagcaggatgaaggctatctgaagccttggcctcagaactggcttcctgtcatttctggcttatcctactggcaaagcaaatcaattgtccagacccagagacaagagtaagaaaggagagactacccccagtgcaggaggagggacagaataacaaagagcatgggaagtaagactgtgttgattggccaccaacgcagaacagccacagttgagctgtagacatcctctgggtactcagagttggagaatggctcagtgtaaaggtacaaaactggtctggggtctgaatgctccagaatatcaggattttttgtttcccttaatggcattaagttctaaaatccttgtgtgaaggtaagaaggttataaagggaagagatggttaaacctatttgcctgatggtcaccctgaacatattacatcacatgtcctacaaacatctcaaggttctaaggattcaggttgctggtggtcctgtgtgctggtgctcctgtgttctgatgcttctgtgtttttggtattcctggtatatcctgttggcgttcctatgtgctggtgcccctgtgtgcatcttgctggctggcatcactggcaagggttatctttaattagggaccatgttcctcttctgacagcaatggcaagcttcttctctatgcctcagttttttctctgtacacaggacaataataatacagttttgggggattgctgtatgaattaagtaatcaatacaaagcacttcctctgacatggaatggtcaataaatgttcactatactcacagcactgttagcggctctttcaggctatgaaaaccaataaattcactgcaaagttttctatgtagtatttggttaacaaagattaccataagactacaaggagaattagtttcggtgtagaaggaaagaagaagttggctggactcttagcacacagattcttgagctccacaaataaattgtagcccttttatgcaaggctctgtctctaggctctttggcccaagatcatggcaaccactgcatgaaaggtacatggctcctactttggtctttaaattcattttccaaatgctagagatagctgccgtcaactaccctgacctctaataacaaaccaaacattcatttgcaattcaaacttcagtgaacaacaaggataagagagtccttcaaagttgcagtacaccaaacaaatacggttacatcttccagaattcaagtccaagctgccattggcttcttaacctaaagctttggtatcagaagggggctggaacaatcccttacagtgttgtgtggcctttgggctgcacaattacagagacatcatcttcagtggcactgtgtcaaatatatctttatcaggaacttacgtgattcttcttcaggaagggaacttcacacaatcatgacatgcctgtggccacactggcagggtagctcattgggtagagatgagtctaggaaggcctggtcctcagacatgaagtctgatgatacctggaggaaacactgttgcccagggagggaggaggtaggtgttggctccactccaccctaatatctcatcacctcaaggttactatggttttatttggatgcccccacctcattgttactgctctgcactttttttttaattaaatgggaaaatttatcaatataatggaatgtggaccagttctgacccatggggaattgtagttgcagtcatggctgtagggcctaggtcttaagcactgcagctatgtagacccggacctggtacatagtaccagaaattactacctggctatccacaggaaaaaatgtgttgtgttctcagaagcccccacactgctcctggctctgacccttttccagagtacacaccttagagatgcttagatctactacagaaccaagttaaactcaacttctgccaagtgcccatgaatggaagatctcagactcatagtcagtgaccagatttgcagttctgtccccaacctcccctaagtgggaagccagccccaaagggtgccagctcactaactgatactcagtcccttttgtatgaaggcccttactaattgggatgctcattaaaaagtctctactcctggcctcttctcttaaataactattggattccaactaagtgtataacattgcaggtttgtttatatccatttaacagtttcagcctgctttctccatgtatccagacaatggtcattttactaaagtttgtataatatgttaagtggtttattaaacttcagatatgtagtaagttcttgaaattttttatagctataaattacattactataaacactaccagcacttttaatatatattccttattcataattatttacttaggccaaatcacccaaacctagaggactagttaatggttattatcacattctcatgacaaatggagtttatagaaccttattttaagggaaataactaaaagatcaccactagaatttatcacttctggataatatggtagattagtatctgcttatgtaccaccatatgaaagacaggaataaaaaaaaaaaaagcaatagaccccattcctataaagacgcgctaaagagaaacatgcacaggtgaggcttttctcgacaaagcagcaggaaggccagcatccagctataccaagatgctccaacccctaccaggctaaggacagcttgtcaccttgtcaggcagagagactgtctgtgccccagggatgccaatggggctggggtggatgatgtatcagagaaggatgtgacatagagacagagctgagatccacagtgaaggcccttgagataacagccagaaaaggccaaacttcagccatcacccagacaagctacagggatcctgagacatgccatgccaagtttggtgcagtcccctgagggctgaccgggaagaggtccccagtgacagaggcaaacacagataagtgggatggggatggagcttgtaaacccctcagagactcggtcacagaaagcttcaggtgtgagctccaaagcatcgcagacaaagtgtaattgggggcaacggactcagactgggacatttgggcagaaagtggacttaactggcttgggttattagaattggcagccacctatagatgataaaaagataactgagtgtaagggggtgggcacgtcatcccaacaaggacacaagggtaccagcggacagcatgctttcagttttgtcttattgcaaactgtaattttctgtacaatgcttgggaggctttgctccacttctggctttggatctcacacagacagacaagcatgactgtcctgctctctatacctgctcaacagcatccctgcctcctccgtccttctaacacctctcattccacctcctaaatattcatgcatttgtctcttttgagacaaggtttatcatatagctatagctggcctgcaacccagtattggagaccaggctgcaaactcacagagatctgcccgcctcttcttcccaagtacacactgccccactaggctgactttacatttttctcatccagtccattagtaccacgatttctcaccctgctggggacagaaatgaagcacacaggctcctgccagaactgatgtgaaatcatggtgtttgtcaggcagctgccttccctgggaatagcagagaaggacagagtggggaaagcacatatccaccttacagctggacaaaacacagtatcacacacatacacacacacacacacacacacacacacacacacacaagggtgaatggggacagcttctcaacacaaagaggaaaccaccaaagtgaggtcagagcaacagccatgatcatcctcaattagatcttatagcgaaatgggtgttgagggagtggaaggatcctggctagccctgcaaagtgcaggtagggccatctccctctgtgaccctggggaaagaaggaggctgctggaacgcagggagcctacactaaatctatcacagtcctacagaacataggcagcacagccagacaggaccaggttagggcctctggtgtagacacagttcagaaccacaggctatgaaggagggaagagcagaaaggaggcccacgaagagactgtgctcctctgaggactgtctcaatcacctttatcatcgctaaagtagccgacatgttatggctcagggtttcaaagtgtttccacaaatagctgcttatgtgctatgagcagagcatcattagccaggaatgtagggcagaggccgctgtccttatggtagactagaaacatcatgggtcagaggcagaggccagggataactttaaggacagcctacctcccttggtgacctacttcccctagctggatcccagcttctaaagccctggcacctcccaaaacgacactaccagctgagaaccaatcaccagagaacaattcttattcaaaccacagcagggatgcagctgaagggactgaagctactgaaccaggtccattttgccttagtatgccaatcactaaaagcagttttgcaagagagaaagtttattgtcaagacatccaagtaggagaccgaagtctcaagtctaaggggaagggatgcttttggttgaggcacgaggaaaggtgactgcaggttcactaagagcagaggagtggatccagttcaggtttacagggctgatttacagtcaaccctccacttatttcaagcccacagtgggaagcggggatttaagaatcccaatacattgctcttcctccactctcttgctagggttctcactgggaaagcccaagggtcccaggccatgtaagacagacatgacaatgagcggtgacacccgactcagggagctgtggaccaacacacactacagggggtagcttgccctgggaaggatgcctaatggaactcagggcactttcttacctggttctactcctgatgttactgtactactgagctacctcctcagatccagtttgcttgatcttgaatttgctcaggctggaaggcctggactctgaggaatgttgctcttctcccagaatggtccttcgcagcaggctcagttcactggcaggactcaaaagcttattttccctgtcatcagaagtcacagggcatggctagaaaggactgaacatagagccacctgaaaagtactccttgccctaatgggctgagtaaggatggctgaccactgcagctgcaatccgagaagtcttcaggaagttgtatgtgctttagcacagagtgtactttgtcactgcccactgactgcacataagctacttcctaaatgatctcagggttctgccgtgtgtggggtgagcagtgcaggtgataatgctggctgtgctctctaagtcagccctccctacaggaaagcaagatagtcatatatacaaatgcctcgttgtttagacttcctgaaggcagttggtagacagaatgaatccaaacaaggaaacctgcttgacacactccagtgttttggtcttttcttttcatatgtaatgtttatgcgaaagccaaagcttatctgtttaaaacaaatggaacactttctggagtgacttttaaatgataatctacatgcattggcttgactccaacacaatgagctagcccttcatgtgtcttttgttcctgcacaggtgcatcttcaggaatctggcaatgtggcccaaactggggggaaaacctcccttccacttttcctgggagggaagcattcatcaataaatcaatgcggtacattagcacgtcccagcctctgtctgctgtagaagtctgtactaacaatactggagaccaacaactcagaaaggaacatgtgtcttctgatggatgggaaaattgcagtagcaccttggtggcttctcttgacaagcaaggcaggttgggccccaagaactaaggacagtttggggttcacacagaagctaatggccaggctggctcctagaagaagtggttgagtactcagataggtgtttagttactttttgttgctgtgattcaataccatgatcaagggaagatgtaaacgggaaagttaatttatagagttacagagtaagagtctataatgtgtggagatgaatagagcatggcaataggcaataggaataagaatctgagagctcacattattatccacatacaggaagctgagagagggaaggaggggggaggcaagggagagggaaggggagagagagagggaaagagggagagagagagagcaggaagtaggacaaagctataaaccttcgaagcctgtcccctgtggcatacgtcctctgccaaggctatactcccaaacattccataacaaacccaaacaatgccaacaactggagaccagtcgttcaaacacatgaacctaagtaggacacttctcattcaaactatggtacctgggatccatgaagacctttttattaggaggaacacgctctaggtaaatgatgagggataggtcatcagtttccaaactctagagctagaaggattaaaggaagtccctcttttcttaaagccgagggcctaacaggggctcagagttctgggaagtcaagtatttgtacaactctcaagaggttgcaaaagagagacagctgaccccaacccagacacccagcacttacagaaacacacagaagaccttcccttccctttgtggtttcaaattatagcttatctagaaaaaaagcagtttacttcccagttctgtcctggtgagaccctgctgcccatcccttagatgcaaagcccactcaaatcatgctgccctggctacagtgccattgggtcttgagatgcctctcttgctgttgaggctgatctgaattttcatcctttgtttccttctgtaaactctaagacttccagtgctgaaatccagaaagggctctctggaagggtgcagtcccatctggcctcttctttgccagggctctcttctctgtctcctgtatcttctttttcatctttctgagagtcactctgtcctctgtgttttctaagcttgcataatggcagatataatacccagagacctcaccctatctggagccacggtctccagctgcctcattccacctgagtggagaaagggtcttgcctctttattggcatgggtgctaatctcacatttttcttattcttcaacctgaactctggcaggcaagagagtcataacggatgtttcctcccaattttggtcattctccatgttgaaaacagagaagtaggtaagagccctgttgatctatcagtggtatcctgggacttcatttcagacctaggtcttccattcttcctcatagttccctcagaaacatctatgacactcttaggaactttgttccaatcacatttctgaccttgggtgatgctttaagtatggaactatcccttggtccatgtaggcccatttaggcctatataacgagcaatagcccctctgttccatgcagttactatagaaatcactgtaaagaatactgaagaagctaaacataaatctagcatacgacccagctataccattccttgacatatgactaaggggttcggcatactccagatatttgttcaaccatgttcattgttgctctattctcagtatctaggaaataaaaacaaacctaatgtcctacatacaaccaacccatgaatggataatgagcatgtggtaaatacacactacggaacactagctataaagaaaaatgaaatcatgagttttgtaggtagatgggaggacccataaaaggtcatactgagtgaccaacccagactcagaaagacaaatatcacatgtcctctctcattatagacccctggctccaaatctttcaatgtgcatacatacctgtagtaactacagaaaccaggaaattaaaacagagccattaccagactggggaaactgaggaacaatagtcagaaatagcagggtaccggtgatctggtcagagaaatgagaagaggggagcagggtcctcaggggacagaagtgggtaaaatacagaagatgggggaggggagtaaaagagagccatcagagtacaaatgacataacagggaaatgcagaaagggggcaagggtgaaggagataaatacagaagaaggagggagttgggtagaataacattaaggatgtctgaaaaacccacagtaaaccatactattaattatttaccaatatacgcatgcatacatgcatgcatgcacacacatatacaaaacaaacaaaaaaaaccacaaaagctccaacctacacttaactctatgtataaatacacacattcaggtttgtttttgtttttgtttttttcgagacaatgtttctctgtatagccctggcggtcctggaactcactttgtagaccaggctggccttgaactcagaaatccacctgcctcccaagtgctgggattaaaggggtgcgctaccacgcccagcacacattcagttttagtgatttttttttcctcatctgggttgatgatgctccctctaagggtcaaagaccagctaaacaaaaaaacctttcataccagacataaaggagccttcttttgagttgttggccagagatgtccaagagactcccaaacatacagcctcttgctgttgctcttggttacacaccccctccccagaggtggaaggtaaatcctgattgttgaagacaccatgcacttcataaacaggacccgaagtcccctgacctgaaagccacacccatccctgaggcctagctttcatgatatcagcagatgccctgcaagtttccaaaggagggaggcagccaacagtccaacccagttgtgacacccaggaacttcatcaacaaccagcatgacacaataaccctaagggtgtagtagtggcacacataccttggcagtaaccaacagctctctcattggacttaagatctgctcaacaaggaaagaccatgcctggtactgg

SEQ ID NO: 860 - DNA, 2739 bp, Mus musculus
caggtgtacttccaagagatcatggcccacgtcggggactgcaaatggatgtcctggctcccagtgctggtggtgtctctgatgtgctcagccaaggcggaggactccaactgtggtgagaacgaataccacaaccagactaccgggctgtgccagcagtgtcctccatgcagaccaggggaggagccctacatgtcctgtggatacggcactaaagacgacgactatggctgtgtgccctgccctgcagagaagttctccaaaggaggttatcagatatgcaggcgccacaaagactgtgagggcttcttccgggccactgtgctgacaccaggagacatggaaaacgacgctgagtgtggcccatgtctccctggctactacatgctggaaaacagacccaggaacatctatggcatggtctgctactcctgtctcttggcacctcccaacaccaaggaatgtgtgggagccacttctggggtttcagcacactcatccagcacttccggtggcagcaccttgtctcccttccagcatgctcacaaagagctctcaggccaaggacacctggccaccgccctgattattgccatgtctacgatcttcatcatggccattgccatcgtcctcatcatcatgttctacatcatgaagactaagccgtcagctccagcctgctgtagcagtcccccaggaaagagcgcagaagccccagctaacacacacgaggagaaaaaagaggccccagacagtgtggtgacgttccctgagaatggtgagttccagaagctgacagcaacacccacaaagacccccaaaagtgagaatgatgcctcctctgagaacgagcagttgctaagtcgcagtgtggacagtgatgaagagccagccccggacaagcaggggtccccagagctatgtctgctgtcgctagttcacctggccagggagaagtctgtgaccagtaacaagtctgctgggatccagagccggaggaaaaagatactggatgtgtatgccaacgtgtgtggtgttgttgaaggtctcagccccaccgagttgccgtttgactgccttgagaagacaagccgaatgctcagctctacatacaactctgagaaggcggtcgtgaaaacatggcgccaccttgccgagagctttggactgaagagggatgagattgggggcatgactgatggcatgcagctctttgaccgcatcagcaccgcgggctacagcatcccagagctgctcacaaagttggtgcagatcgagcggctggatgctgtggagtccttgtgtgcagacatattggagtgggctggggttgtaccacctgcctccccacccccagctgcgtcctgaagagttgtcttggactgtcttccctgggaccagctggggatccaatgaagtcacgaccgacagctgtgagtgatgctatcagactgccaaaactcaaggcatttcctggtgggtcactgtattccttaggctgccctaagtagttcattgagcactcaaatgaaccaaaccatgtgggaaggacacaggtgaagaatctgatcctgtcttttaaggaggcacttagtgagagatgggagcatggtatagaccgtgttaccaaaacatcacctaggcaaatgaagggatgcttttttaaaaagtagcaaaagttataagggtgatagagtctcaaggggttgaaagtgggaacatcctaatgaagaaaataacttcaaggttttagtaaaacggttacaaagtacaggcatcccacatccttcatggcctcagacagagcatggtttgctggcatgccctatggtttcagaggtaactcgacctgtgtttgcagtcacacaccatggtataagccttgcagtcactagtggaagaactcaccatgtgtcactgacatacaaggcgtgtgtctgtccagtcacaagtgtgggcagatctggcctccagcaccactcgcagccacagcagttacaatgtcaggcttgtcttgcttcaaagggacgtgcgtcctatctagagaaggaaatggtgacttgctcagagtttgaccatgcctgattcctgggtgaggctcgagtgagttcaggcacaacatcctgagccagtgaggggtggtgcagcccgagacgcagtacagagctggggtctgaggtcctgggcactgggagagtcattcaaagtgtctgtctcctccagacttagcttctcttagctgagagaggttggtcttcacatctgtagtcaggaatgttgaggctccagtgagcgaaagggtgagtgaaagaacacggaggcagaagagaagaggccagaggagcctccatggggtaaatacagtgtgggtggccacaaaaaatgagagtcaagggaaacgcagccgccattctcatataagggcaactgtaggactgagcgtttacagggcttataaacagccattgctcttggcatattctcttactgcacctgtaactgccaggaaatgggagccaaggaaacttccccggcagggggttaatgccaagctggctgctgggctccctcccagagcgctgactgcagagaatgcttcctttcagtaaagcctctggtttagaaggcggttgggtttttttgttttacaaggcctatgactgaacaaaggctttggagagcaatcagtggtgtgtttaaaaccatcaagccatttcccaccactgaatatagaccata

SEQ ID NO: 861 - protein, 455 aa, Mus musculus
QVYFQEIMAHVGDCKWMSWLPVLVVSLMCSAKAEDSNCGENEYHNQTTGLCQQCPPCRPGEEPYMSCGYGTKDDDYGCVPCPAEKFSKGGYQICRRHKDCEGFFRATVLTPGDMENDAECGPCLPGYYMLENRPRNIYGMVCYSCLLAPPNTKECVGATSGVSAHSSSTSGGSTLSPFQHAHKELSGQGHLATALIIAMSTIFIMAIAIVLIIMFYIMKTKPSAPACCSSPPGKSAEAPANTHEEKKEAPDSVVTFPENGEFQKLTATPTKTPKSENDASSENEQLLSRSVDSDEEPAPDKQGSPELCLLSLVHLAREKSVTSNKSAGIQSRRKKILDVYANVCGVVEGLSPTELPFDCLEKTSRMLSSTYNSEKAVVKTWRHLAESFGLKRDEIGGMTDGMQLFDRISTAGYSIPELLTKLVQIERLDAVESLCADILEWAGVVPPASPPPAAS

SEQ ID NO: 862 - DNA, 114931 bp, Homo sapiens
ttaaggaatgaaagagataagcgtaattgttaattataggaatggagctaacattacttaacatgcaaagctccagcctaagccccatgtttatgttacctcatttaatgctcacatcaatcctatgaagtaggtactgttatttttcccacttttcagatgaagaacccagggcttctggaggttaagcaagttagaagccaagccaggagaatgcagcttgtcggcacccaggcatctccagtcaaccacatatttcacatacttacaataataagaattttaaactctatagtcagctcgacaataagcactaaaatggataaatttatttgcaaaatcacatcttggaaaaacagaatggcttgagaccacaaaccttttgctgccgttagagtctgaagatcaaagcaagcttggggacagtgaggctagcagggaaccaggctctggtggaggaggcacgggcccagctttcagccttcaggctagaggacaccaactggccacctgggggcctgagccaggctgaagccattttttgtgtttacttgggccacacagataagttgccatatttaaaaatgggaagatgttacttaaaaaaaaaaaaaatccagatctttgaatttcttgtggagctctgtggtctgcatccaggaacacttggcaggggccagtgagagggtgccttcattattaaggtcagtggctggggctcggagtttgcattttagataaatcactgtagaggctgggttgaggaagagaaagtcagaagcaggataaacagtgagagagaagacgctgaaaatgattctgtgatctctccttaggaggattagtggtggtcctggctgattcaggaaacgaggaggattggatgtgttgagggtgttgtttccagcatctctgagacttcccaacgagatgttttccactccacgaatacaagaatcaaagcttaaaagacgaagcctgggctcaaaattaagtgcaggagtcgccaggctgatgaaacaatgagcctgggagaatatggagaccctagcagtgggaccctggaaacagcattatccgaggggcaggtcgagatgaatggcccacaggagaccaagaataaaccaggagtcaggtttcacagaggaagaagagatcatggtcttgttgcatggcattaaaaagctccaggagcataaagactgaaaggtatctactggctttagcaattaggaggtccctggtgacctaggcaagaacaatcccagagtgtagggagagcaacagttccggtagactgaagagtggatacaaccatctcactgcaattcagcatgacccataaaagacaatcaccatcattcagagatgcacactgatacttgccgaggctgaggacttagccagcttgctcatgccaggatgttcagagcagtgtcttgtgtttttgtttgttgttgttgttgctttttgagacggagtctaactctgtggcccaggctggagtgcagtggcgcgatctcggctcactgcaacctccgccctccgagttcaagtgattctcctgcctcagcctcccaagtagctgggattacaggagcctgccaccatgcccggctaattttttgtatttttagtagagacgggacttcaccatcttggccaggctggtcttgaactcctgacctcgttatccacccacctcggcctctcacagtactgggattacaggcgtgatccaccgtgctcggccacagagcagtgtcttaacaccaggtcttcaggctccagggccagatatccagccagccatcctgcctctttctatctgttaggtatgccaaaggttggaaatgcaggtgttctctggacatttctaaacccttactgaccatcatctttttttttttttttttttttttttttttgagacagagtcttgctctgtctcccaaggctggagtgcagtggcgcaatgtcagctcactgcaggctctgcctcctgggttcacaccattctcctgcctcagcctcctgagtagctgggactacaggcgcacgccgccacatctggctaattttttgtatttttagtagagacggggtttcaccgtgttagccaggttggtctcgatctcctgacctcgtgatttgcccacctcagcctcccaaagtgctgggattacaggcgtgagccactgcgcccagccatactaggacatcttatgcttcagacccactggctagaggttttgtttaaacagaatgaggagtttaggaaagtttctggcaacagagactagttacacacttgaatcccattttctgctcctggacacacaaaaacactgcactccccacccttacagcagtcagcctggaggcatgtgagtagatgctagccaactgaagtggtgtgccactgctgggcctggtcctgagcatcccatgtgctcatccaagcctttgctcctgtctgacctgagaagaggcagatggtggggccacaggctggaaggagtttgggtttctgagtcactgctggcaggagaaccatctggaaaagccacctagcccgcatcagatgtgacatgagcaagaaacgagctatgattgtattatgccaccgagacttcagggttcctgtgttactgccacactgttggcctgtgcagatggatgttgctggtaagatcactgattcaaaggcacaggacaacagcacagcaggcttgggctccatgctcatgggcaggggggaatggaagtagaagtttccacatactctctcccagtcagtgaatcccctagatcccgtctggggtatgtatttcattgttgaagtccatggcgcataccgttaatgggcctgcttaatgaggccagtgtcctggtggccactcacctatctggagcctttcttatttactttgagctgctcccaaggagtgtggttggacattaccagcccccttgaaggcatgagtagaggagagctctctagtgtccagcccagtttgggattgtgagaaactgtgctggacttaaacgtacatccctgcacctggggtgtaaagatccctaaactgtgtggcttagggtggaaccaagacccagactcagaccttcctggggttcaaacctggtcaacaccagaagcctggcacctatccccactgttaggcagcagggaactctcactcttcactccctcttcccaaatcagaatctttccagttagtcaacacttcatttccttggggaatcattttatactatgaatgataccccagcagaactgatatgaaagctaaaattgccataaagcagactttcttaaaccttgcttatctagaaaagaataaattgcatatcccaatttttcataatgagaaactgcaaattaattagtctttattaataaggcctggctacagtggctgaaagacatgagggtttattctttcccatgaatgaggcaggtaatttgggcctggtggggcagctgcacaaggggttggagctccttccgtcctactctgatgtctacccagctgtcatgttcacactccaggtggcagcaaaggggacgcatggaaaggggcagaacagcttcctcccagatgagttggcagcctttttggaagtctctgacacctgctgtggctcattggacagttctgaagcacgcggcaacatctaactgcaagggaagctaagaaatgcaaccatttagccaggcatattgctctgagcagagctgggagattcctgctggagaagggaggctgggaagaggtggcaggcagcagctctgccagccagggtgaattcctgttaaaatgcctgtttattcccattttggctttcttttgctgaccacagctttggggatctttggacaatgggttcatatccatagcaggtgaagagtaagggagaactaacatgccccctgcaagaacacattagcccttgtaaatcaatcgttcctctgccttacagattacctgcaaaatgttgtaataggtgtgatttttaatttcattaatttggccaggcacacctgtattcccagcaacttgggaagccaaggtgggaggatcacttgagcataggagtttgaggctgcagtgagccgcagtctcactacttcactccagcacaggtgatggagcaagaccctgtctctagaaaaaaatccattgattaataaatactaataaataaaacccaatgcggccgggcacggtggctcatgcctgtaatcccagcactttgggagaccgaggcgggtggatcacgaggtcaggagatcgagaccatcctggctaacatggtgaaacctcatctctactaaaaatacaaaaaaattagccaggcgtggtggcgggcgcctgtagtccctgctactcgggaggctgaggcaggagaatggcgtgaacccgggaggtggagcttgcagtgagccgagattgcaccactgcactccggcctgggcgacagagcgagactctgtctcaaaaaaaaaaaaaaaaagatatatatatatatatatatatatatatatatataacccaatgcacagataattttttatgtttatactatggacccatacttccctgcttttagatatccactggttaatagcatgataatcccatgaccccataatcccctttccccggagccatgatttatgatagaaatatgtacttgcctattggaaggatgaatttgttgattttcaaatgaagatatcaatatttcatatttctaaactcagttttctcccctcttaatttttctggtatagtgcaaataggttttataatactcttgtggtttcctttattagaaaaacatagtgatgtgtactgttgagctaaatgacaatattacagatcgtaaaaaagatttagtatttgaacctttgcactattcaagctcgtaaagccattctcagcgaggatcaatttcaattatgttttcactgcttacataatggaggtggtgggggccgtctcaaaccctggctggggagcagagagagcttaggccacgggagagggcatgcctttgccctgcacgaagctcctggcctgaagctttccttcatccatggaggtggttcattatggtccttcctttatgtgaccagagtcattattgacagctgtgttccaaatccagcttgcatttttaataaggtgtccatggggggaatcctgggcaaatgggaagtgctgtggtctgggtgtctgtgtctcccctgaaattcatatattgaaatcctaagctcctaggtgatggtatttggaggtggggtctttgggaggtgattaggtcatggaggctagagatggagcctcatgaatgggattagtgcccttgtaaatgacaccccagacagcggcctcaccccatctgccatgggagatgaccagacactgggtctgctgggcaccttgatctcggacttcccagcctccagaactgggagaaacaaatgtctgttgttgaggcctcccagcctacaatatttttgttatagcagcccaagctaaggcaggtagccaaaggaaagccaggcttttgtttaatcagtagcagggggtcagtgttcaaagtttagttaaataactaaatgcagaatctcattctccaatagggtacaatcaacgcaaagcccagctctttcctctgcctttgacctggagctgtcccatctgaatttatgctgggggaggacagatcacccaagcttgacaatggttcacatagcatttcatctcccggtatctaggtgacaccctaaaggccctccctctgtgcaaatactcccccagacttagtctctccctttcctcattttgctaaggatagtggcccattttacttctaaaacaagtttccatcattttcaaatcatgatatacttggaatagaatccatacccttttgtccagcccccacgtggaatgtggtctctaccacccttcctgggctgggctcagctgcctcccaggccagctccctgctttgtggccacagtttcctgtcagtttcctcagcacacctggctctgggccccacaggacctttgtacaagacctttggtccatctgaaacaccttctgcccaactctgcaggactgccttcttccttcgcaagtcttggtcaactttccttctcaacaaccaaagcaccgcccctcacacccccttacccccacatcagcttgctggtgtccgccgtatcacccaattccattctcatattttaggcacatttgcaagcctaggaaggtgtggttcctaagagagactttaaatcacaaatatttatattcctgttttttctgcctatggaactgtgaccacatgagtagcggggtgctctgagatgatactttaaaaactagctggccagtgctgaggagggcagagccctgtgaggttaccactgacagagctggggacaaacgcattttaggaaagcaaagaagccaggccaggtcagtcctgggagccactgtgccacgaggcaggggcaacgttcttccagaaaacagtcccagttgtgggacaaatttgaagctgcaaactctacactatagacagaactgtgatcattttattctgaataacttagtgggtgtcaccatgagcataaaaacatttcatcaaatatacacacactgtgttaggatttgagcaatgtcatttcctggaaggttttctgagatagacttcacctgcaggtaaccagaagtttacttgctgtggtgagttgttaggtgaaaccaattatatgtcagggcccagctgccagacaggagcatcttgcttttggagtgtttgattcccctgccactttttgagacagtaattagtagcaggaaactgtcaccagccaactgataatcccctcacatacaaacacaaataatccaggcatcctgtgcacccttgcttatcacggccaagaagtacttttcatctccatttcataacttgattactctatgcctccccaaacagagcataagcttcttgaggccagcgattttgactgttgttctcattgtgatctacccagcaactggaacagtaccggcacgtagaagacgtgacgtgcatttgctgcatgaataaacacatgaacatgatggcataggagaatgctactttgatggggtacatgggtatcaaggattttctttctgctcacacaacatgagatttgtaattaagacacagatttaaggtgagtccggtggctcacacctgtagtcccagcactttgggaggctgaggcaggaggatcacttgaagtcaggagttcgagaccagcctggccaacatggtgaaactctgtctctactaaaaatacaaaaattagatgggagcagtggcacatgtctgtaatcccagctcctcgggaggctgagaatcgcttaaacctgggaggcagaggttccagtgggccaagatcacgctactgcactccagtctgggcgagagagcaagactctgtctcaccaaaaaaataaaagacacaaatttaaaatcacgatgaccagaatatggctctgtttcactcactggaaattatctgatctgcaagataattcttaccaacccctgagtgttttttacagggatgggagtccattgactctctaaaatcacttgcgaagttttgttgctgcggagctgagagctggggccagcctgcctgttgtgcccctccataagactcctggccatgcatttgagcacacctcatgaagggggcaggtggctggccgggctgttatgtgtagcaagcatgtgttctaaattacaattcatttgttctaaattacattcatcatttctaaatttgttctaaatttagaacacagccccaggagacccccttcacccaaccatgttctgcagtcttgattcattttcttacttaaaaaatgctattgataacctgttgctatttctgcctcagtctcttaggaaatgtataaaacagaaaatcacatatcttcaaagctctggagctttacatgatgaagataagcaatgatttctcatttcattctttctcttaatcaactgaattaattatatactcattttcatttggatatgatgactaggcagacttcaagtataaccatccataaccttgcttaatgccatgatgtttggatttttttcaaagagaggaaaaaactcccttggcttctattacagcatccatattttgtgccattttaattttttcttgtgtcttttttctctctctttgggaaatatcagtatcattccttttggtaaattttaaatcaccacttaatttccaatagaaaaaatgttttagttacacctaaaataatcccaaacctcaaacacactgtgagcacaccagaaagtaaaaattatatggagtagaacagattagcccagaatacctcccattcattttcccaggttcctaatttaataatttcagtgactttaatttatcacagaccctcagtctgaactcggcatgagcagggtagacaaccaaacctgaaaattcaagttaaaattcttgtttgggagcttatattatctagattaatcatccacaaggatcaagtcagctaagtaactctggttcagcttaatctctgtggaggcagaattagtcctttacagtctaggtccttgccccagccccatacatttctgtctgcttttttcttttcttttcttttctgttttgagacagattctcgctctgttgcccaggctggagtgcagtggcacaatctcggctcactgcaacttccatctcctgggttcgaacaattctcctgctttagcctccacacatgccaccaccggctaatttttgtatattttttttttttttttttttttttgagacggagtctcgctctgtcacccaggccggactgcggactgcagtggcgcaatctcggctcactgcaagctccgcttcccgggttcacgccattctcctgcctcagcctcccgagtagctgggactacaggcgcccgccaccacgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctaatttttgtatttttagtagggacggagtttcaccatgttggccaggctgatcccaaactcctgacctcaagtgatctgcccgcctcagcctccaaagtgctggggttacaggtgtgagccacggagcccagactgtttctttcttaagctcttactttctcatgtgtgagttaccttgtaggtttccaaggcagaggggacaagatggaaaaggagaacacagaaatctagcctggaggagctgctctgttcctgtatttatctgtgtaggtgtgaatgagggagaaaatgacaagagaatgacattattttaaggctgttttcccccccccaatcatttactttttgagaaataattgcccaatactgaaaggtatgtcctttcaaaatgttgatgtttcaaatggcttcctaattacctagttatacggggggtgtgtatggttatctgaagttacatgggtatacactggtggtgtgaggtgtccagagagaggaaaggaagagcagtcctggtggctcaaaccctgagggatgtgcgggggatgggtgagaatgtgaacagacatgttggaagctgaatccgtgcagtggcacccatgcctgtagccatctcagtggggggtccttctacgaacaagctttgattaatgatattttaatgctagtttagctttttagcactcccacgcctaaaggctctgatagaagcaaggcccccacccctgcaaaaaaaaaaatccatgatttttacgcattccaacagatctcttaaggggcagacggccggagagccaggtgtgccagggacctatggcagcagggctgaacgtgcccgctccagcctctccagtgctgggagagacctctagatggtgcaggtgagtttgcaatgagggaaagcccctcggcaaggactgagtttccaaacttgcagacagggcagggagcggtcaaggaagagttcccgggaagccctttaaacggaaaggaagcggggctagtgtcagagaggtgtgccaggtcccaggcagccctgctggcccctaaggacatagagtacctgcttctgagagggctgccacggtggccacctgtgaagcctgtcacccagaactggatggtacctgactttcttcatagacccatcttctgctgggactgaagctgacctccaacagaagccaggtaagccctggtcctttcctctggttttctaaactcttcagctgtggccgagacggaggtgtcatgggctgggagagaggctgggtgcatttttgaaatgcatgtcatttttgggttgcgtttgaacaagctttaccgattgcagtatgtctgcgctaccagttctaagacctgagattgttcctttgttttagaaaaacatcagaaaccctgttttgctgttggttgcacatttggttagggagacaaattctgtgtgtgcttcacaggctttaagatttgggctactgaagcaacgggttcctccagggagcgtgaaaagtatgtttctcaggtttgcccctgtgcccggctcactggggaaggcaggcgcggcagggactctagctgggctctgtacctgcctccaactctgcgtacccgctgtgacctaagagaccttccaagtggggtttccagtcgtgtctgagaccccccatatcctggcctctgtgttggtggcgggggagcggggagagggagagaaggaggggagtgggtacctatttgtgatgattgaggttttcatttccagccaagaggttcctctcaacactctgacagaccgtggggtgggttgggctcctagacaggagtcggctctgattcagtcggctctgattcccagcctcctgcagcagccaagctttgagatgtcagctcagggagaagcgggtggctgggcagggaggtcagcaggcgaggttcccactgggtttccctgcccatgttgtgctgggtcagcaacaagagggacagttaaaatcaacaagcagggcagatgccggtcagtgggcaatcccacacagccaggggtacacgcatgtgaggagacgtacggagagacaggagcaccaccgtcctcttccccagtccccaggccactgctctgtggctctcaagtggcatttttgagacactttctaagcaagagtgaaagtgtaacaaagaagtgaagagccataatagactgaaggaaaaaagggatccaggcatctaaaatagagaatgtttcttgcctggcttaatactctgagatttgtaagtcatagccacttaaaacctttaaagatacattttgacagaggccaccaaaaagagagtgactctggtcaaggcttggaaataagcgttcgttccgatgacagtccacgtgtacccttcacggctgggaaagtttggcgatcctggtggcgattggccgggggtctccactgtacccctccccatccctaagtgggccaggctgtgctgtgggaggattaatttgtgacagcacagttggaggataatcttggaaggaccagtctttgggaggaaaaagtaaatacaatttccctgaaatgcttgattttcactccctggccactacctggtttcttgcttttgtgagctggactttcattttgttgggcatacacatttgtgaagcacagacgtgtcaggggctcatctttgtttctcaggcatcatggtaccctcttgcctagcccagtgcctgccattgggcggcagcccaacattgctccggagtgcagacagacctggtcttaccccatctcacggagcgcaaaacctacttgcctctgttaaatggggagcctcttctagtcaaagttcctcaggtctcataggcccacagacggaagctgggttacctgacgctcctttctgggtccaagtgagtgcgttttgtggtttccaaagaatagaatttattctcaaggaaatgcccaggaacccagcttcaaagactcaagcaaatctgaaattcaaatacaggagctgtaaacaggatggtgtttggcagacagccttgctgcttaagtggctcagcccctcagctgggctcagtttcccctcaccctcctcctagcctgcctagtgactgcctgcatgcctcaattatcctggatgacacctgcctgctcgttcctttgatgctgtttgaggctctgcctaggtattccacccaccaatagtatcattaattaacttacattaagcccacttagcacattagatcaattaggggacaaaagccccagccagcctttcctgtgagtatgccgcctccatctcaatgcctacgattctgtccttactgaattcgtatattgcaggaaggaattttttttaagtcccaaagattactattttcctaaaaaataaagcaaggaaacataagctgatgtctaatcatttaacctctgctgtacatttctatggcactttacaaagcgttgtcatgaatgtcttctctattttcccaataaggaaattgaggctcagagaggttcactgtcttgcccgaagtcccacagctcataatgattatgggaacaccaagaactggtctaggttagcactcagtatgcccaggcctcgtgtggagcctgtcactcataattggaggggctgagactagaacctgtgtcctctgcctccaacactgacacatttgcccccacaaggagatggtgcaatgacagccaccagggattataaaaataagagtggagtaagcaaacactccccctcctgtatcttagtttcccagggtcgtgtcagccccagacacactcatctcctgtcctcagaggcgagggatcaagaggaaacagtctcagttttgttctttgtgaaccctcctgataaaagttagagtgtttgtagtttttatatagtgaaaaaaactgtcaaatataggccattgtaggtggttcagtctaagatagtctagtaactaaaaaaaaactcaaaatggcatttggggctcaggcatcccaacagcccactggcccctgagacaaatgagcttgaccatatttaatttttcatcattgcccttagagtgtcacaaagcattacccaaggatagctgaccctgtacagtcaaagctatgaaaaaagctttgccctgggtcttggcagggatcagccattcattaggtcatgtattaagggatcctacaacctgaagtgtcttcagtcatagcacaccccaaggacatcatgcactccatgaaaatatgtccaatgaatgaatgaatgaatgggctccttcatccttcttgtcagagaaaggtcaccaattgttccaatgacacagttagggacaagggggctgctcaaacatcagcatcccctaagtcaataagcaaacaaatcctagttagcaaagctaccctctctgggggcagagacacctgttatttctcaaatgctggatgcccaagggtggcaaacacactgtttggaccccaggaaggagcagacacatgtgggtgaagctggaggccctgcttccttgcccagatcctcttgcccagacacactctggaaatgcccatcattttatacacctacgtacacatgtaaccagccaggatgcctttgttttccatttccaagaaaacagaggactatggaaaacaggtgggccgtaaggagccctacagaggaagatgcacctgtggcggtagccctgcctgcaccaccctgcgagctcatgccagcttaactcacttcacggtcaatcagacctactgctccaaacacagtaggaaggcgcgccttcacttgtgagtcggacgaaatcagcaatgagggcaataacaaccacagtcacgttactcttagtaacagccctgaggcccgcagtgtagcacagaagccaagcttagtggtgggcttaaggctgatgttgttaactgataccattcaatagctagatataggcaactaaaaggtgagcccaaatactgaaataagatacagtattagtctcctgaaaataaaaaagagttgattctgccaacaacaccttaatcctgagagaaagcactttcttaggatagaagaaagacatgcaaaaccagactgcaagcaaaaaatgagagggcatgcactgttttgacgactctcagatggttaccaaatctcttctcttaaaacttccatttgccatatttccaatcccatgtttgcacagaatcctgcatgcacaggaggaagcaggcaggatttcaagttggttttagtgcacattcattcattcagcaaatgttttctgggcatctgctacatgccaggcaccatgctgggatgtagtgagtaacacagtggtcccatgggtgaggagagagaacatccctgcactcacagagcttagattctgctgcagggagagaagctataatgcataaatccagcgccatgaaaaaaaaacaaacaaactagcagggcaggtagaaagaaggtgcccagggtagtagtgggggcctcttgggaaatgaaatagttgagtaaagacctggatgaagtgagggagtgaaccaggacacccgcaagaaaggagaccctggggtggggtgagctggagatgtcccagcaccagcaggaaggccatgctgccggagcagagggaaaggagggttgaacagaaggagaggagaggagaaccaggagcctgagcgggccgtggcaagggggctgggctctcattgagggtgatggaaaggcaaacagaagtcaagtcagggcggaagttcagccatggtggctcacgccctgtgttgttctgggacagtcagtgcccacaccaccccatcccatgccacgccggttgctgtaatttgcttctaaggagctgggtctccaagtagcctcttcctgggagagttggcttggctgaggtgcagggcaggaagggcaggcagcaggaagggtggcaggagaggaatgatccattttcaccaacacctgctcccttggccgttaacacatgccaaagggatccattctgagaaaaattatgaagaccctaacctgaaacacatgattacacttccaaaaatctgaaaatagattatcaagactcaataagttgtgcagagaaagaacacttagcaacagacatcgccgtcgccccccttgcagccctgctgggacactcccacagtcgcagagccactggccagctgcactcgcttcctcctcacttggagagagggacaccttccagcatcgggtgtgagatggagtggggacgcagtggctctctgatggctcagttggcaaaattgttggagaacgggttcagagatcactgatgcccttggccagcatgccagacctgttcctgttgactccatatggcctttggagttggagagaaggtggcttccctgccccgtcccgcacggagccaccagcacctggaaagtttgatttccttcctcgtatctggaagatggaggtcgattaggagggaagtcagtctggaggaggatacctgtctctgggaactccagggcagtcaaggcagacagatggatcacgagggaggagctggaagggcgggattgttgacttgatgtctggttggggtctgatgaatacaggaaagtggaaggccacggggaatgctccagtgggatgcagatgtctattaagttggctgattttatttacccagttagatgtggttttatggtttactgtttggattgaggctctgtgtccttgggtaataaacattacctctggccccaaaaaatcctaatccttaaaaatatggaaatgcactgagcatccctaaaaggtactttagaggagtctcaaggttcattttctttaagatttagtccttaataaagactcaaaatggctgttcctaaagcctcctgtccataatgaagaagataaatcagagtgtacactttggggatgtgtttgttgacatgcggcatcctctgcagaaagcctgtatctccaagaagcgtggccaagggagggcactgacagctgagtttagagtgggatttgtaagcagcacaaactaattgtgcatcggtagatttgcagagtgtggttttctgttgatggatttctttatgggcaataaaatctccaataagtaccatttacattcagcagaactctttttgaattttagctcattcttagagagatttggagagagagagaccatccctgcacatgcagcaggcacctggcctgtctgggtggccagtccttgttctgtggccactgtgaaccccgccaatgtcctagtttcccgccagcactcactaagcaattttgcttctcattttatgggcagacgtaaccaaagcaaggagacttaggtgactcgggacactcggttttgagtcaattctaaaaaccaggagaccaaactttctctagaattactgccagttggtttccaaattgaggtttccagatgaaaattattatccaaacagaccacacacagcactctgacttgccttctgtgcctggcatgtgcgagggaaatggcgctggagaatattatcctgatgattatcacagttgttgcttttgaaggcaaatatttattttgtgaagattgcaaaatgaagtacaacagaatgttgagctcctccttatgtttacagaataaacagaactgagacactggcaaacgccaatgtccctagttcttaaaggactggctgcatgcctcccacggcatcagttaaagcaggagcctctggagatggaggcctttggtggcaggacagcctcccaccagggagggtctgaggcttccacccacctccctgggttcatctctgtaaacagctctcccagtgtgggctggatggggtttgaggtggctgctttcctgtttaccctggaacatttctttgttagagaggccactgcatttgctgtaagacaacgggctctagatctttctcaaggctttgggagatctaatagaaataaaagacctggcccctattctcatggcctaaagcattgaaaggaggaaataggagagatagccaaattgcacggtgctgttactgagccgttaaacatctgtccctgccgttgcactgactgtgccctctttgaggacgggaagcatccgtctgttcattctctggcacctagcacagtggctgcacacagtaggtattcaataaatgttgaagaaacccacatttattgggcatttgttgcttccttagcgtttccgtcttaatctgcacagcagtcctgtgaaatagagacaatcatcactgcttcacacatgtgcagagtaaggcttggagaggtgaggtggcttgcctgagacctccctcctggtaagttcatggacttcgccttgctgtcgtttccatgggctcgttcagaaatgagagctgggatgatgtgggctgtttcaaattagcttgaagtctaaccttgtatcataactatctcgggtgtggggatagtatatatcgagcagaggtctaggtatagacagatgtgtgaaatgctaaacatggctgaactccccagagacacctcagcagacagccctgctggctagccccggatcctggacaggtgttgtttgggctgcaggatgctgggagctagagcggaaaatggaagcttctctttgtatccccaaggccaagagcagacctggccagccattcttctcacaatagcagtcataccagacctaagacgcgccagacaacttcaacctcaggagcctttcttcttccctgaagttggggtggactggtcctggtggggttggactggcatgggctagccacctggggcgggtgcggctctggaaagaatgctggcggcagggtggggaggagcccagcctcaggtggacacaggcccagagccagccccttcccgtgctggtggtggaacgtcagatcatcattgctgggtaacttctgtcacttcagttccccgagggaaggtcacatacttgcctcatgggaatattatgtggatttccgagagccaaggcaggcagagtgcttagagcgggccgtgagcacattggaagtcctgctcatgctctgtatgcactcacgggctgagtttaacgggtcagctcaacctctgcctggcagtcattccccacggtctagtccgtcagaggtccctgtctttccttggagcagtctatcaatttggccaggtttcaaaacaccatgaggaccctgcagttaaggggcagctacacgggggttggtgtggggacacagcaggctctgccagcccccatggagtatggtgccaggttggccacctccccaccagtgacaccgtgaccccactctggccacactgattcaagctcagggctgccgcatttgttccctctgcccaaaacgcgctggcccaagatgtctgtgtgtcttgctcattcccttcaggtctatgctaacacgtcgtcttatcagagaaaccctccctggccccacactgtataaaacagcagctcccacccctggactcctgttttacctttatccataacagtgtccactcaacgacttatacatatgcatgtaatatcacataaatatatatatgtaaatatatacatacacacataatatcacataagtattatatatatgtgaatatatatatatttgaacctagaacttggtgagtaataagtattagtttaaaatcacgacttgctgctgaggtgagcggcagggcgtgcccaccagagcattagtggcagtttcctccttgctctccagagcctcccaagggggcttttgctctcctcaccttcacagaggtttcgggatgtgactcacctgggcctccctgggattctctcactgcagaactgtccggaatcagtgaagcaaatagggaagagaatgaaatgagctggggttaaagaacaaccaggagaccttgaaatagtaaagtatcaggttgagaacagagaaagtggtgagtgacttgcccagccccccacccgaccccaccccaccccaccccacaccattcatttgaacttgacgatgggcgatctgttaagtgtgagtgtgtccatgatcactgatacagcaagcttgagaggtgaatgcatcacactgattttcaagtgtgaagaagcagaggccaggagactcacttgcacacctcatctcagccaggataatagagccacagcaccctgcttcccaccgcccagcagtgatgccaggtgtcccccctacccgtgtgctgcccgtcagagccaggctggctgtcagggcctagcaggaagcatgtcatgtcagatggccaaagtgaagaaactctattcaagggacccatttggctggtgacatgcgcctcagtggctcctcctctgttggctactgctgcctggacctgctcaagccctcctctcctctgcagttcctgccatctgcatccttcatgattaatctgaccctgggtagggaggcaggaggggcttctcttctccacagccctgcacctcagcagcatggctcagggtctccaagtccccagccgccacctgacatgcccctagcttactagcttgctttctccagcccccacttcagctcctggggtgtgccatgcgtgtgtgtgtgtgtgtgtgtgtgtgtgtgagagagagagagagagagagagacagagagagagaaagagaaagagagagagacagcaaccaaagcttgggatggggcttggaccaggctgggggaagtggtggggcagggggcagcccagggtcagccccagcaaacaagagtgttggaggagtgaggttcgccaaatggaagaggcaaatctgactaaacttctccaaccagatgacacctttaattctgcatgtctgggctctaaggcgcagattctccttttacccaacagcaagaaagagctgttccttaagtaagggtcaagtactcgggcagtggatggagaaacacagtgagaggaggggcagccttggcatcctcagatgtttccacgtttccgaattttcagtgaatctggttttccacaacactgaatgtttttgaagctggcacctctctgcttactgagtagatgcctaattggaaatggaatgtctgtacttcacacactacaccccctcctgcccctgctgagaactttcccgggttaatggtttccttttggaaagctttcaaatggtcttcgttggagtttacattatctgcttccctctgctctgtatgtggattatttgcctgttgggtttaatttaaccagatttgcagctgtgctaacaacttcattggtgccctcctgctttcagaatggattttcccgtcttttctccagcttaccgatagactgtctccataccaaaacctgcacggggttgggcattgtctgctggtgttctgcctcactacagaacctgtttcctctgaccaaacttcactgcatctcaggttctaactaggtcgctctaatattttaatatgaatagttaaaatgaattatttattaaaaatcactgttaaacaagaaaaaaaaacttttcctcggtgctctgaacctcagcctccttgggaggatctgcgtgttccctaagcccgtggctccctcggagctctaccctctagaaatacgttgcaaaactcttgaggcgtctaacaaatatgacaagcccacagattagcaaagacacgcagagtcgaccaagtttgatatttttgtttttttactgagctttttgtacttaataggagacctggccacctaataagatggtgattattggaaaccacagagatgtaatcagatgttctagacatggatggtgtatttaaccccttaaaacacttccacgccctgcctggatccttttctgcttcatagaccaatgatgagttcctaaaagatatgcacgtctatccccagtgaaggccgtagctcagcaggccctgtacttggcattacaggggcgggacctgtgtagccttgccctctggggccctttgctggtcttcctaccctgggctcttccctatgtcagtgccatttgtcgggagaaggaagaacgactttgaaccgcagccctgttctgtggatgaagttggctggagttcctctacgagaatagaagctccctgaggagtttcatctgcatccacagagtccatagatcctgcctatagataagagaataagcaaatggctgttgtttctttactgtgtcatttaatatgatgtcttgtggttgatgaaggcttaaaaagtgtgtgaaccagaagtagaacaagaaaagagggtgcggctctcagcaggaactgtcctgaggtggctgtgggtccttcagacactgaggcctgtttccaccctcagctctgaggccttctgttcactgaggaatctccagggctttgtcagcatttgaaacaacagtgactcctagtgagagccgggtcccaggagggaggacgtccagatgtccccagtccctcctcactccaaggaacagtcttccacttcaggaacactcaaaaaaggtgagctcctggccaggctcagtggctcacgcctgtaatcccagcactttgggaggccgaggctggcggatcacgaggtcaggagatcgagaccatcctggcgaacacagtgaaaccgcgtctctactaaaaatacaaaaaaaattagccgggcatggtggcgggcgcctgtagtcccagctacttgggaggctgaggcaggagaatggcgtgaacccgggaggcgcagcttgcagtgagccgagatcgcgccactgcattccagcctgggcgacagagcgagactccatctcaaaaaaaagaaaaggcgagcttctcaggagccaagctgagaggccaccagatctccgggcggcaaaggcagtgctgatggtccatggggtggtcaggggtgcagggcctgttggcaccctttagccttagccatctaggaaaacccaggcccgggccagtgggggccactggaatcatcagtgcctccttattggcgtcctgatcacagcacaggtgtctttctaaatgagagcttgttctttccaaactgggaagtcagaggtatttggggcaccctcagacaccttttcatcttagcatttgtcagtcctcactgtgcacccagatctgggattctaatgccaatctccagtgaaaggaaccaggactccttggagaagtggctgactccagagctggggcagggaaaatacaagaggagcctggagcaccctgtagtgccagaaagtaaagaggtcctaagaaaagaaaaagaagaaaaagaaaaaaaaatggtagtatgtctaagggacacacaaaccaactaaaagagctcccagtcaccatagctgagacaatttgagcaacaaaataaataatgtaatattgggttataacccagagtttaaaataaatacccatgtgttcacactgacaaataaataatggacggatggacaaatacataacagagaagaggcaggtctcccgtgcagaggaactccaggtaattcatgtagatgctgtgcccttgaggaggttaaacggataactccctcccttaagtgtgcgctccgcctggagacttccttccaaggagcaccggaaggagtcacttcagagtggggaatcctgccagtcactgcttcatcccagtgatcaaggccagcatcagcaatcctgagccatgctggtagcatggacccttcatgtgatgagaatggcacattgcctctgtggtcttcctctcaaacccatagccccagtctgtcacgagaaaaacatctgacaactctcagttgaggaggattctacaaaacacctgtccagtgctcctcaaaacttctgagtcatcaaaaacaaggcaagtcagaaattgtcttgttagccaagaagagcctaaggatgtgtgatgattaaatgtaaagtgggatcctggatgggatcctggaacagaaaaagaacgttaggagaaaactaaggacatctgaagatgtatgaacttcagttcaccagtattgcaccagtatttgttcatcagggatgaccactgtattgcatcatgtaagatcctaaaaggaaaactggtgtggggtccccgggaacactctgtattgaatttacaacttgtctataaatctaaaactgtcctaaagcagaagaaatcccttgtctagatgattcagtcaccctcctctttgccctgccctttccaccatccacagaacgccgtccagcagttgaggggtggccttgacttctcgagctcgttcaggagtgaccacaagacatcctgatgccgcacggagcctggccgacagtgccacccttctcttgctggaccaatgaatttgtgtcctcatgtcatttcctccgaccaccacagggctctggccaggggcttcgcaagctccttagctcccagaccgcacccctgttcccccggctctattttaggcttattggtgctggctgcctccccaaagctgctgccctgcttccagtgctggggtaggaatgagctgagcctacagtccacccacccacctcttctcactccggcatccatctggtcaccaagctaccgcgggttgacccaggctagggtcccaggttaaagtagacgcaggtcttgctctcatgtgctggcgctatccatgtctcgccggcccatgctccagccctctccctgatgctgtgcccagggctgagctgcacccacaagctcccttacccccagcctccagctggatttgacccatagaagacacgggtgggaacccaggcaggagcatggtggccggcaggggatttactctgcacctttctgcctgaggccgcagctgctatccctgtgttcagatcctctctctcctttgccccttcccacacaggctggactgcagctcctggagtgctgcaccatcatttgctcccctttggaccctgcccagcaccctcagacagggtccctgctgcactcgccccaggtggcacttggggctaggctccgtggaaaagcagattccacaatggggccgtggtttcccaggccaggtagaaaggcagtgcttgctgaggggacttgcagaatggctgcctgagaggctcaggggttgatgggctcttccttctgactcctgaatctccaccagagccctgcacacctcagaaaggctagagctccagcatgcagactgcaagtgttgtgggcaggcctggtgaggcagctcggggtggtgggaagagctagaccccagctctgccatttgctggctatttcaagttccctctaccctctcagtttcagtttcagtttctttatctgaaaaatgggaatagtatctttttttttttgagatggagtcttgctctgtcacccagggtggagtgcagtggcgctatctcggctcactgaaaccttcgcctgccgggttcaagcgattctcctgcctcagcctcccaagtagctgggattacaggcacacaccaccatgcccagctaatttttgtgtttttagtagagatggggtttcatcatgttggtcaggctggtctccaactcctgacctggtgatccaccccccttggcctcccaaagtgctgggattacagacgtgagccaccatgcccagtcatgtctacttttcatggtgtaatcattaagataatgttcataaacagggtaccatcgtgtctaagacaaaatacacagtcaatatgtggcatttcttttttttttttttttttttttttgagacggatcctcgctctgtctcccaggctatagtgcagtggtgtgatctcagctcactgcaagctccgcctcccgggttcatgccattctcctgcctcaacctcccaactagctgggactacaggcgcctgccaccacgcccagctaattttttgtattttttagtagagacggggtttcaccatgttagccaggatggtctcgatctcctgacctcgtgatccacccacctcggcctcccaaagtgctgggattacaggcgtgagccaccgcgcctgaccaatatgtggcatttctatttttcttattatttctatttggagaatgaatggacaggatggtcttactctcctggaagtggattgttgagccttttgtgaacaaaggtgatgcttacagctccgtaattggtttaaaatgggtaagagccttgtgctgaaaaccctgtgatcctcatcttgaatcccaagaaatgttgttatttacataaaaccaaaagtctgtggggcattcaaaagttgaagggcctttgagaactctgatgatgttttcgttattgtgagatggaagccaagcttgtggctccagccaaaaaatttccaggttttgtagtcggtgtggaggtcagaacaggcagcggtcaccatgtgtggcatgggttctaggacacacgacccctggaaagtgcatttctccttctgttcttccggaggcagccagcaccctgcagatgagggaagaagtcattgaggattccaggagccacactcacaggctggaaatgtccatggcagtcaagaaagaaagattctgccagggttcaggcccttggcatcctcaggtactggaaagcactggaaagcaggagaaatgaaggcaggaggcagccagcactgcactgagcccagacctcccaggtctcaggggctgatggcggacactctctctgcaccgccctcctgccctagccagccccctgagtcagcttctaatggtctgtctcacaacttgcagggaggcggcactatacacacatgctgaggccaggtgcggtggctcatgcctgtaatcccagaactttgggaggccgaagcaggcagaacacctgatgtcaggagttcaacaccagcctggccaacatggtgaaaccccatctctactaaaaatacaaaaaattagtgggacatggtggcgggtgccattaatcccagctaatggggaggctgacgcatgagagttgcttgaacctgggaggcagaggttacggtgagctgaaattgcgccactgcagtctagcctggatgacaagagtgaaactccatctcaaaaaaaaaaattcaattaaaataaataaaaaaataaacacctgctgagacctcttcctaagaaattctttggacttggagcacaggttgccttgttctgggcgtgcccagctcagagagctctagaagaaagttcaagaaggcaaagaggagaatccagctagccaaggttggggaggttggaggaagagtgaacgcccctgccggaggccccccggtcctcacccccttctgagtctcagcatctgcatgggctgtgagccattgttttgtgactgacaaatcagatgagggctgcttatttttcaaatgatcacgtcaagttctctgatcacagccatagctacaaggcaagcagagtggggaagacacccgtcacccttgtgcagacacttgttttaccaacacttggcgtgcagggcaaggcaccagcttctgaacccaggtcacctacaatctcttttttcctaggctgcctcggcccgttgcagcctgaccttgccctgccccggcactcccacagcgggcaggattggaaagggcagtgtctggcacgttggcatgaaagccagccaggagggttgggcaagggctccagggcccgtgaggaaggagtggagaccacaccatgcagtgccctgcccctgttttgatttggtcatcattgtctgtgttcaatcctaagcttgtcgagaactgggccggcatggctattgaagttctgtggaacagaagttggtctcttacaggggtgtggctgaaacagcaaaggactggaaggcgtattagtcatctgtgctgtgtaataaatgactcccaaatgtaactgcttaaaacaacaaatgtgaccatcccacagattttgagggtcaggaatcagggagcggctccgctgggtggttctggctcagtgtccttcctgaggctgcagtcggctgggctgcaacatctgcgggccaggccaggctggaggacccacatccagaggcctcgcaagtggctgcggcaggaggcctcagctccgggccacgggagctccccacggctgctcctctgttgcccctatgtgactgagcagcagccagggcacagcaggaagctcagtgcctttggtgacctggtctctgtaattgcaccgtctcttctgcccttttttctgttggctagaaacgagtcactaaaatccagcccgttcacacagggagaggaattaggctccaccttttgaaggtggtatcaaagagtttgtgtatgtgttataaaccacaacacctgacttctaatgccaactcctctttaacttctgtgtaaccttgggcaaattgctctaaatctctcagcctcagtttcttcttccataaaatgagagagctgatcctatctctaatacccttcctctcagccctcacaccctcacaccttcattcattctgggtatttatttactaaacatttactcagctctctgctagaatgcctggggagtttcaaaaagactgatgcctggttttaagtctcccctagtgatgctactgtgcgggcagggttgagagtcctccttctggagtcataatctgaaaatgtgatttgcacgcaaatcacctgggggtcttgttacaatgaagattttgatactggaggtctcgggtgcggcctgaaatttggcatttctaacgagctcctgggtaatgcagtgcatcccagggaccactctttgaactcctcagagccagtttctagatgctggaagaaaggcgcagaaatataaagatataaaaatataaagatgattcccaccctcatggaacaaggaatccagttggagacggaaaacatgtagccagcaccatcagggtctgaccgcctgcccaggatgtggtccaggcaccaggactgagtcggagggggtgaagaatcccccagtgagcacggtctcgccggaccctgtgatttccccaccaccagcatcatcccctgtcccctcaggtccacagcaggacacagcatcaatccagatccttctgtgatctttggaagtcttccacaaattaggttgttttgctgaacggtagttatttccacagggaaagaaaagaattagcaaatctatcacttgtatttgttcagtcctgtagactattccccaggttaaacatttgtttagtgagcctgcttttattggcaccacaaacaaattaaagtgtattttccgaacttatcttcagggtgtaaaattccaggcttatggaaattctagtaaaatagcttttaaaaaaccatcatcttagcttttattctttctaccttatggtttttctgtcttctccaaagggccctcttcccatcccctgagcaggaaggaagtgaagtattcccacaaccttagaccttggtcccctgccccaccctggttattctctgtgtggcctgcctgcaatcctgtccacctccctgcccagtcaggctccctgggcaccgtccagaggccccagctcccagaccatctccactcagtgtcctgccctccttgtgtctcagtataaccaaggcaatgtcaggatcctcctcacttcatatctcagcctctgaaacagactcctaggtgaactctgggctcccaggttctcttcttgctaacctttacacaccatttgcagattaatagtcctgaaatatttcctgcatcctgtcactgactccaaacatctcatgtctcctggtgtcgtaaagaagcttctttaactcaaatgcgtaccacctggggttctgctaaaaatgtagattctgacccactgggcctcgggtaggggcctgagattttccagctctgaggagctcccaggcgatgctcccctctcagtgcaaagctcaagcagcaagattctgcaggatgaggccacactacccatccgtcattttccacaggggaaagtgtcttcttagccagactcatcacgtcatccagatagccaaggctcagacgtcaccaaagcctgtgctgggctggctagaccctccattagcaatttccccacttttaactgtgtttaaagaaatctgagttgtatgttcttatgacccagattgaactctggattctcctgaagccttctctaactcagtgattctttcacccctttttggatacctgcacaagttagctcttcattgcacactgccttgcgttgttattaatattttgggttttcttcttttacatgtttctgtctttccagctagctgctgaagcccctgggactgcagctcacactcctttcacttcttttatatttctttcagcactgagatggtgctgtgcctttagtaagcacttaataaatatcttttctttaaatgacccaaagcaaaattcctgtacttaatgaaaaattagtttgagaaataaagggaataaaaatgaaattgaaacagaatgacccccattttacagccctccctgaatagcatataaaggtctgcttcatgccaacatcctcactgagtcctcggggccaggacctgtatgcctttggaggcctggcatggtgtctggccccataaacatttgaaaaatgcttgattcgtgagttcattaatcgttctcctctcaccggagatacaaccatccgaacttagccagcacatacagatcaatagcagcaagaacaagaccaagaaagtgggtaatttcaaataaggtcttggaaagacagaatcaaagtgcatatctaaaaataggtggggtggaggttggagctgagggcagagagaagagcaggaaaaaaaaaaagaaggttgtcaaagccagggttcagctgctagagatcaagaccagccatagagcagaggtgccttctttcttcatcacccttgttgaatccaattctcaaggagctaaaaccatgactgtcacacaacgtaaactgactgtgcatcagggactcattcagctccttaatgagggatcccttgaggtggccttgctgattccgggagcttctgaggaatggaataagttaggataacaaaactgcttaaggtcccacagagcagtgaagtcttacaatctttgtggttgtcttttttatcaggctaaaatctgcaagctaacatgtaaccctaccgtgactgggctttggccaaatagtgcatagcagagtgaagctcaggtacacgcccctggagatgacatcatctcaggcaggcctgagtccctggaaagctagtttccttccacatgaccttatttcctagtgttcgatggctttttgtatcagcatcaagctttaacccagggctacccagagtaaagggggcaaattctgtgcacagcagtgcagaagaaggtgccagctcacttcttccctggtagctaggaagaaaagagaacaccatgcctgtgatcaggaggcgccacagacagactggtcacccatgcagccttggcttgccctctgagtatgcctaccacccttctgctccaattctcaacaagccagaatatttctgtgggatctgtgttacctcatcctggttagaactgctggggacaaacctccccataatgaacagaaaatgctacatccctggtttgcaaaacttcaacagtcaaaaggatgcatgtacaattatttttctatagggatgcataatccaaaaaacaaaaaaaggcttgaagacctatgagctaaaccattccatcttaaatgttgaagtatgtctgggtcagctctgatttagtagatctagggggctccaggttcttcatttccaacaggctctctggcgatgctgatgcagctggtatgtggaccccactttgagaagagacagtttccactaaagtgagaacaatgacggcgccttccccaggtggtggctgtgaaaatcaggtgatattatccctgtgcagcactcagctccatcccagggcctgggactgaggcattcttgggacagtgggcgcatgtcctatgctcaataacacatctctctatgatctctccacgcgtcctgttctgtgtgcatgagctgttttctacccctgtggctggggccctccagctccgcaaagccggatttgacaggtcttagactcactaatcttgagggttttccatcttttgtttctgtgaagtcactgctctcaataacattgttacctgaagagaaatttatcttggtgggttcttactttccttttaaaaaatatccacatatgaagctctcaaacaagcagaaatccaccgtctagtttttcccaatagactgtgttattggaagctttgagggataaggggaaaagaaattggtttatgaagtaaaattgaagcaattaaaggatcaaaatcaccttacattttcctacaaagacacactctgtcaggcatggacagccccctgctctttcaagttttatagccaccccgtcttggcagaaaaattaggaagtcacttgttgtgcacaagactgttgtaaacctctttgataataaaaaaaggataaaaagacaagtaggagacccgtaaacacgaactttaaaggcctggagaacagcaggcttccccttcttctgctcctgctcttagcccacaagccctcaaaccattttctacagcacatttgctgcagcctcagggagaacatgaactattgaagtaaaaaaaattctagcctttgatattcttcatgtttttttcctgtttttccctgtgaaatatgaacctgcaactgattatcccagggacttgatctcaaaaacataatttggccgggtgcagtggctcatgcctgtaatctgagcactttgggaggccaaggcaggtggatcagttgagggcaggagttcaaaaccagcctaaccaacatgacaaaactccgtctctactaaaaatacaaaaattagcctggcatggtagcgggtgcctgtaatcccagctacttgggaggctgaggcagaagaattgcttgaacctgggaagcagaggtttcagtgggccaagactgtgccacagcactccagcctgggcaacagagtgagactccatctcaaacaaacaaacaaacccatgcacaattggctggtctttgggacaaaccccagtaaagagggtccctctctgtctccctttcacttcatcatgtttgtggagttgtttgtcctactcagcagtttagccaagaatagtggtccccaggcaatcaatcctccctccactgtgctcccttccagggctggcacttggcctctgccagcaggccatgtgggctcagtagcttgggaagcccttctctacaggcagagccaacacagctgaagctcattttctcagaacccctatagccaaacacagtagtgttcctgaagacagtagggtttccttactatttgaatgcacttgggcaccgtagaactctctgatgactattgtccagacagaagatgacctcttcctcatagtcttcaggttgaaagagcacagggtatggctgagaccacaggctctgaccccacataactgcaccggggcccgcgagatgaggcataggccttcctgtgccctgtgaggagtcactccagaggagctctgcctgcggctggcctccaatgccactgcatttcttaaggctttgaagggacttaatgccagtctcagcatagtaaatctaaacccttcacccaaagttcatgtgttaattgcaaagatcatctgactttaaaatattgataatagaaatgacaaagacggaacttgagtaggcaacaacatgcaaggcagacaggtctttgcattcttgaaatttgatacttaagatgacaggggcaataaaagaccaggaggagaggcttgcttcaaagttggtcttatcaaaacaccttgaggtgttaatgactttcttaacagaactccaaggctataaactgctttagatccaaggatatggtgatattgaatgttttaattgtggtattaacagccccagttgtaaaagggaaggtgtcactcaaagatgagggacaaggcctgaattttataaccgaatttaattggcactgatttgacgttgatagtacctggtttttccagttttcaggaaatatttctttgcctggggggagaggggggagcacagaagggaaaggtggagggagagtacatgatgcaggaggggaggagagggtgctgcacatcaaaaggcccatcttgaatttcctgtgatgtgctaaaaccccagccccccaccaccacatcaatgcacagagcagtcacacctctcctacatcaaaccccaattactacacacccagggaaggtgcccagctctcccactgcagcagtcacccaaatgagaaggaaggaggcatacagacacccaaaggtaagaggaaaagacccaaagccagtagagcccaggaggagaaaatcctgatggggtaaaaaccttctaaggatcttcctgtctgtaatgtttttctctccccaaaagacctgtatctgggaacaactgggtcatttattatctttttttttttttttttgagacgaaatctcgctctgtctcccaggctggagtgcagtggcgtgacctcggcctcccgggttcatgccattctcctgcctcagcctcccgagtagctgggactacaggcacccaccaccacgcccagctaattttgtttttgtatttttagtagagatggggtttcaccatgttagccaggatggtctcgatctcctgacctcatgatccgcctgcctcggcctcccaaagtgctgggattacagtcgtgagccaccgcgcctggcccatttgttgtcattaaaagatataatcatgacactttggacactcaaaaaataaataccagtacccttcacacacacacacagacacacacatgcttgcgtgcacacacacttttctaagtgggtggcatagttaaaaaatgtttggaggaatattaaagtaagtttttagaatgttcatgtaaaagaggcaggttgtgctattgaagagagtcttagatcattaaaaaaaatttaaatgttaagctgaactttataggatttaattagaatgaatgaactgttccttattccagacgtgctgttattaagtatgtttttgtcatgctacacggtttgtggaattatttccaaacatttggggtctgtggctctctggaaggtcttctgattaggaacctcagctctctgggtagaagcaagccaagggctgctgcctgctgtcacttagtgagcactgagtgtggcgtaacggagagtgtggattccagcactgggatgctctcctgtggacacgccttcagcacttcttctttctggaattggagtgctatttgctgctccatttgctcagagaaacctagttctttaaacagctgccctttgttgttaaaagattatcctcatttcagtcactggtgactgtggtttggttgggcttttggagtttgttggggtttttttcccccaaagtacctgatttcctcttagagtagggacttttatttctcatattttgggtttcctcttcagtttagggaaagatgaacagctccatgacctgatcccttttcgtcacagttccctgttagtgggactgctttggagccgtggcatcatgtggcagagactgagacttgaactggagtccagatgacctggcaggggcttctggctgtagcacaggtcaccggtggacctcagaaaagtcctggatctctcagagtctcagtttccccaggagtaaataaaaaacgtgccccatctatacaagcctggatgtttttaattagaacatttcaggaggtgggagggatctgaaagactatcttctgtgctgcccagtggggtagccacagccatacgtgtctgtttaaatttaaattaagtagaattcattaacatgagaaactcagtgcttcaggggcagtggccacagttcaggctcagcagccacagaggccatagtcctggacagtgccaggctcagctgcctcagctgatggttgaggaaaatggtccaagaagtgagtccaggattggcccatgctccagccagagccgaccctactggctcctcagtctatggtcatctgcttctgagtgtgtgggtgtctctccagccagctcacactttcctctttctgccttatcttcccacaagaaggcagagtctacagatggaagggtccctctttgcaggttgcaggccccaggccaggcagtcctgtgatacccatagcctgggaattgcccagaattggccgcaacattctgcagtgctctcaggttcattcttctgttgaaagggctcctggctcttgcagatcatggagttttataaaacggagtctctaaaacccctcttgtaattgtcttctgtcttgactatattgctgtccacacctgactactgtgcaggtgccatcatcctgtaattttaccagacgaaaccattggggtacattgggtaacggggacatgggatctctctgtattatctcttacaagtgcacgtgaatccactttcaaatagaaagctcaatttttttaaatgtccttgtgcagtttttacaattcgaatcttcttgaattttagaacgtcggctctaggcatcctagaaacagattttgaagggctcttgaaagcaaattgaattcttttctcatagttgctatgaacagtttaacagtttgtagtgcgtgatcatttttgcttacgtagcccttttacgttggccacagagtttcagataagaatacatcatgtaaaacttcagatgtattttcccaaaactggaatgtgtctctgttgttggactcgtgcacacagtcaagtggttgaagctaggggtgtacagcagtttgcggcctctgcagggctggactggggacttacaagtgacagtgagtgaccttcagtgacgcagagccaccagattttgttcagttcaattgatcgctggtgcagatgtccctggcaagggtaagacaagtgcacagtgagccctcctgtccttggcatctctgtagctctctccttatcctagaacaacactgggattgtctgcagatctcttgtttgtagatctttgacaaaaccattgaagagtgaggatctttggatttgtgcttttaattcagcatcactctgctcagtctcttggacagaatggtactgcggttggttttgaaaagggtgtgtgtgcgatggtgtcatgccaggaagagttggccttggcatgggaggcccttgaattgcattcctttctctctctcttttttttttttttttttttttgagacagagtctcgctctgttgcccaggctggagggcagtggagcgatctccgctctctgcaagctccgcctcctgggttcacgccattctcctgcctcagcctcccgagtagctgggactacaggcgcccgccaccacgcccggctaattttttttgtatttttagtagagacagggtttcactgtgttcgccaggatggtctcgatctcctgacctcatgatccaccagcctcggcctcccaaagtgctgggattacaggcgtgagccaccgcatctggccgattgtgttcctttttcatcacttattggctatttgagctttgacaattatcccaaactctttaatcctccatttcattacctgtaagacagggacaacacaacctacctatttcataagattttcctgcgaatgaacgttggttcacatgtgtgaaaggctgtgagagcgtccgagcatctcagcgcaatctgcaatgcgccatctgccatcagggaaccctaaggaaaggctgagaggctgcctagacagggcgccacatgctaccctaccagagttcacagtctcacttggacatctttgtggatttccttctgtgatttacacagggaaaaaagtctctccaggattttatccaaactgttagattctgggagaggtgttgggagaaacagctcatgacttatcttacagctgcgcttcccctctttgatttccctgaacacagctagagtttttcttacaaatattaacttggaaaaatgagagttggcccagctatgcttgctatggactcactgcttccattcatttccagcacaggggccattagtgtgaagcaagggtctccctccccaggctcaggtcacgagagagcagcagcaggttaaaagacccaacacatgggctgatcacttctcacctcttccaggaagcctccccaggcttttccgcacccacccaaggctgagctgagcccaaggccccttgcatcagaatgaatgtgttctgaccatagagtttcagaaaagaaaacgtaacaataacaccatctgccagtgagtgcttttttaatgtaaatgtctgtttttgcagaacgtccataaccaaaagagcagttcaaccttcagcatgtaaatctgatgtaggcagcgggaaccaggagctctacctccctctgaagagggcctggctgtgagcagggcagggcagccaaggagggtggctggtcccagagaagctgtgctccaatgctggctcctccctgcctgcctccactggtggtgggtgtgccagatgcccttgagtgagtgaggggaggtcagcctagactggtgggtcctgggggcagaggcctccaggctgcagtgtgtctccccctcttaattatttaggagggaaaggactggcaactgttccctttcctgaatctggttctttaccctttcattaaaaattatggtcagtcttctttttctgtctgggcctccaaaacccagtcagggccaggcccagaggctctgcagcgggggccactctgcagggtctgctccagtgctggtcgggaggtggccgagcatttctgcatccatgcgtgctcacccaccactcatttatacgcctggcctctgacccaacagttctaccactgggactctattgtaaggaaataattagaagtctatccactgtgtcttttatgtacgttgtggcgttcattataatagtgaaaaactttgaaataaagtcgaatgtccagccttaggggatactcttggtacatccacatggtggaatactatatagccatgttcctgaagaatatttcaaatgaagaggctcattaaatcattaagcaaacaggatacaaaactcaatatacgatatgactccttatgatatatctatatatctatacatagtaaaaggaaatatatcaaaatctcaataatgtttccatatggtaggaccagcagtgatttttagttttcttctttatacttttacatgtttgaaaacttctttacaattagtagtgtttttacaatcaggaaaatatgaaaaaaaatgtaaaaacctatcagtgacagagccagcgtggtggaagttgttgtccacttttctgctggctgacggggcagcagagacaggtgtgcaccctgccctggctcctcatgcccccaccttccaaacattccagattatacttattctttgcctgatctgagaaattctggtatcctgtttttggggggagcaccacaggtgaacccatagaggcattcatcagcaagagcgtcttgagaacatagaccaccctccactaaacattctgaggcagtgagcactttttttgttcagacaatctcctaggaaagtgtcaaaccagctcctaaaaacagagttaaaaccttgggggatcctcagtttgaggctcttgtggacaaatagagaaactgcagccccggggagaactggtggttgccaggacacccaggccagactgagccagggctgggatccccaccccgctcctcttagcaccctgtactatcagtggacccagccacagggtgtgcagggtggacaggccagcacccagcttccctctttggagggcactgctttctcagagccaccgtggccacgttagtgcatcatgacattgactgagtggctgcagactagcatgttttaaatggaaagggaccatgtggtatagcactgtgtaacatggtctaggatggagaatgttgtgtagggcaagtgttggtttcacttggatatgtgtgtgcttgtatgtatgtgcgagtatttttagagaaggcttgagtttcttgagagacctgtggaaaagctggtgtctcagaagacatatctttctcattttcagccagcactcctcatcaagctcctgaatcccctgtagacatttggctctcatacgctggggaaaggcgaaatctccactgcccacggccccagcagccattcaccgggcatccagagctgagtcccagggcgcatgccacagccggcactggcctggctggagccccaagggtgtgtgaggccccagctcccctcagccccatgactgctgtgagaaccaggtcccttggaaacctgacaacctgagtcatcttggcacaggttttaagcatcacagagaaacaaagcattgaaagatgcaatattctgctcatgaaagacccaggaggacctgaactgggttggatcagggagaaccccaagtcacagcccagcgtcccctgcattacagacactggggagctctgatttctctgctgcatgtcttgctctttgggaaaacaaatctccaacaccaggtcatctctccatccaccaggctgtaagagttcccagatcgcagaccacagggcttcataggccatcatcagcccctctgcacaaacttggccttgcaatggccccatcagctttactgaagccttggctttcctcgggccacctgccaccagcatgccccatatacactccattagtcacgattctagctgttccagagtcaggaattcacgggaagccacagagaactggtgttgatacacgtttttctggctctaacccactttctaagcatgattttgggagcacagtgtcccgttcttcatgggtgccaattccaatggcctcagccactagccatggaggccacttcttgaggacttgcagggaagtggcattccatgatgtggatgtggctcccaggttctctcatgaactgtgttgtcacctgccccaaacttggtgccttttcccagccagccatgagcctggagagcccactatctctggctgacacttccaagtggctgtaacattcaacagaattcattcacatccagtcacaacattcaacaaaatcagaagccttgcgcttgagctttaggtctcctgggccagatatctaggggtgttccaacagaagtcacctgcaaaggcctgagagctggacttgggcttcttaactacagagactgactcctggctctgccattgctaagggagctagctgtcccgagcaatagggcggccatggggtgccctcccaccgtccttctgccctctctactgtgcgtcctgggtccagggtcttgccatgcccccctgttctgccccctgcctgaacaaacgcacccttgtgagccttctgcctcagctcctggaaggcactgccctggggttttttttgttttttgttttttgttttttttttcctgctgaaggaataactatttcatggttattaatgaaagtgatagcaattccctgtgtatttatcttagattatgtggtcgttacgagctgaagtacctcaagcagccagtctgcggttgatttgaaaacaggcgagtctcaacagtgagcttaaggaaaggtgtcaggtataaatcttgtcttcaaacagccagggtgcattccagacttcagagacacttctttgtataaaggccctttttttctctcccgcctttctttctcctgggcctggaggaggatgaaagtgcaggggtgtgtgcgttcgtttagtctgataatgagggtgaggctcacgggcatggtaatttggcagctttggcacttcctgtaacagttttgatttttttttaatccaaagggctgcttaaagacaaacattttttgttaaactgctggtagttcattttctgcaggaactgtgcaattaatcttgtttatattaaagagacaggttgcttttgtcagctttcctgcgctataattaataaagatcaaaaacgttacaaaaacataatatttagcttaatgcagatgaggctaggcaacagctgcatcaattagaggagcaaaaggggaaagaaataccctttgctttggaataactcggatgcattaaaaaacatggattgtgaggcttctcacctccactagcctcgcctggtaggcccggtgaaggatggggtttggacatcaaatagtttgtaaggccgcatcaattatgttgtaaatgcagttggaggcacctactcttaacccacgtttatccaggtgtgtggctgtggatcagaagcatggagcctgaggatctctgcagtggaggagggtgaagaaatcagatggcaggcagaacctgatagaaccatccagccccctggggggcctccatgagcccggggccacttgatttatagccctctatttgaaggactgtcattagaaaccaaaacagtgattagatatgcccaaacagatgtcattacctgcccccgacttcctaaaccagtgactaagacctttggcttccacatgagagttcaaacagggtcatctctgcccataaacaagaggcgttgctgtttccaggctttcatctgtctcacgaagcgaaggtgaacagccacctgggagcccaccagaaatttggtggagatgcagtgtgagggctggaactggttgtcagtggcacccaggccagttacctcacttagatttcaaggaattgaggcctggggaaagtgtagaactgcaagtcccacagttacacagcctttgccttggctgggcgtggcggctcacgcctgtaattccagcactttgggaggccgaggcaggcagatcacctgaggtcgggagtttgacaccagtctgaccaacgtggagaaaccccgtctctactaaaaatacaaaaaattagcggggcgtggtggtaggtgcctgtaatcccagctactcgggaggctgaggcaggagaaccgcttgaacctgggaggtggaggttgcggtgtgctgagatcgtgccattgcactgtagcctgggcaacaagaacaaaaactctgtctcaaaaaaaacaaaaaaaaaaagagagctttcgcctttcctgctgagcttcaaaacttgggatcctaatcgtaaaagtccaggacaaggagggatatgcaaaatgaatcataacccaaatattttcagcaaattctggtggcataagaaggtggctgagcagatggaaggaactgcccataatcaagcatctatgagggaaatttcactgtcagtcaaccatctaaccagaaaagcacccaagggagccttgtgccttgccagatttcaatgccatgtgtagtttcttggctacccagaatggactgataaacatcagaacctgctgacgtgagagactcttggtgcagtgctagtggaggacatggagggatttgagtggcatcaggaatgccagtattctaaaccaaatggagttcctacctgaaaccaaaccaaagtcatctccaagttttagaggacacctctacaggcatcataacactctcatgccctttaacttctactcttcagaatgtataaaaagggtatctccagccaggcacaaagatgttcattgcaactgtatttatgacagtgaaaattgggaaccagcctgaaggacaaatattaggggattggttgatttaattatggcttgttcatttgatgggatactttcaatccattaaaaaggctgttgttaagaataattaagacaatagggaatgaaacagtcaaaccacaagtagcccgaacagtgttttaatctaattttattttatttattttatttttttgagacagagtcttgccctgttgcccaggctggagtacagtggcaccatctcggctcactgcaagctccacctcctgggttcccgccattcttctgcctcagcctcccgagtagctgggactacaggcgcctgccaccatgcccggctaattttttgtattttttttagtacagacagtatttcgccgtgttagccaggatggtctcaatctcctgaccttgtggtctgcccgcctcggcctcccaaagtgctgggattacaggcatgagccaccgcgccctacctctaattttattttatgttattgtatttatttattttttgagacagagtctcactctgtcgcccaggctatagtgcagtggtgtgatctcggctcactgcaacctccgcctcctgggctcaagattgtcctgcttcagtctcccaggtagctgggattacaggcaagtgccaccacaccatgttggccaggcaggtctcaaacccctgacctcaggtgatctgcccaccacggcctcccagagtgctaggattacaggtgtgagccactgcacctggcctaatttcattttagaagatatatatgtctctacaaataagggactgaaagaaaatgccaaaacccaaaattaatgggttatgattttatttctttatatttttcttttattttacaattcttccataattggaaaataattatattaccttgcattcattagcacttactgttgtaaatactttatacacatcatctcatttaatttatctcattaatcctcacattctgacctaggttctattaatatcataattttactgatgagacaaccaaggcacagacatttagattacttgcccaaagttgcatagctagtaaattaagcccaaatttgaacccaggaaatcagacattagagtcctgttcttataatcactaccctttaatgctattattaaaattagttgtgagcgcttccctcagggagatgtgccagtcactcatagcctggtgggagttcctgtgtaagattatcttcccggccaggtctggtggctcacgcatgtaatcccagcactttgggaggctgaggcagacggatcacctgaggtcaggagttcaaggccagcctggccaacgtggtgaaatcccgtctcaattaaaaatacatgtatacaaaaattagccggccatggtggcgggcgcctgtaatactagctactcaggaggctgagacaggagaatcgcttgaacctgggaggtggaggttgcagtgagccgagatcacgccattgcactccagcctggtcaatagagcgagactctgtctcagaaaaaaaaaaaaagattatcttcccagtgacagctgcttgaataaaggtcactgagggaatgtgacagaggaaagcagacagagacacagaattcagggaccatacataccaggcacagggctgggtgggatgagcgttgactaagatgaaaagagcaaagcatgtggctcacaattttgccaaggagagtgggtggggagccttttccaaggatagtttcaggactggtggccacataatgggatagagaccaccacacctatccaaagtttgcagggcgagagagggcaggtaggctgcagaatgtctgtgaaattcctttaagtaatgagctattcaaataataagcatatacattaagatgggaaaatggcagcccatatatcttggggtataggtcttgatgtatagctatctgcccacacaccacaatctgctgctggtctccggaacaggatctccagttctaaagagaaaatgatctaggacataacatggaaatgccatctatgctatctaggttgccataactgcaggattttataagaaggtggtgagggaattggtggataaggtgcgttacttttcctcactgggttatctgagagaccatagcaagaaatcatagaggggataggcttatacagagagaggggctcctttaattctctttgtctgaccctagaagacttatcatgcctttcaggagcaaccaaagaagttttaggatcttggtaatctttagtgtctcacttataatatgtagaaaaacattatttcaaaggatatccatattcttgatccctctgacctgtctggttcaacttcacttgacccttgggcacacaaatggtgttaaagagcagaggaaaggctcaaagcctcagaaccattttcttctgcctaactggcctctccacctgccagttttctggtgcttctttattgtttccatcgccaccagcctaccttaggtccttgttcacatagctacctccagtgtctcatcagtcacatccatccgacaatgacagcaccaaattagtcttcctagaaaatcatctggttgtgtcctggtctaccaaaaacaactatagaactggacaagtatgggaggtaactgcaactgtcatcaggtattggacaacaaacagcacaggaccgtgagccttaagaaaagtaaaatatacccattcaccctggcttcctagccagagggaatttgtagactgtagtgaggccaagcagagaggatgtcttaatgagatgaagaggcagagtttagagataaagtatctacaatttgtggaacaggataccagagaagagagtactgcacagaagaaagtcccagaaatcagcatgaagtttaccggtgggtcttggccaagactcggcacaagctagcagacaacagagaacacctgttgtggacagcagagctcagatgcctcacagggataagcaattctgaagcatcggcttagccagaatgcagaaagctcagccaccactttgagctttcaatagagactccaagagcacagatggattatttgtaacacaaaggataaatgcttgaggggatggataccccacttttcatgatgtggttattacgcattgcatgcctatatcaaaatatctcatgtaccacataaatatgtacacctactacatacacacaaaaattaaacgttttttaaaaagacctcagaaagtctatacttcaggaatcaggataatgccttggaactaaaagcagaaacataaatagaccaaccctaataaagaaaaaagtcaagactgacaggtttgggaggatcttccagtaatttgacacttgcccagagtaaaactcagtgctatttaaagtagatttcacatatcattacgatgtctggcatatgataaaacattaccacacatacgaagaaataggaaaatgtgacccataatccaaaaataatgaattcaatagaaacagaccccaggataatccggatgttggaattaactaagactttagaataactcatattaatatgttcaaggatttaaagaaaaagttggatttaatgagtgaacagatggagaatctcagcagagcaagtgaaagtattttttaaaaaggaaatcctagaagtgaaaagtatatctgaaatgaaaaattcaccagaagggctttacaatgtattggaggctgtagaagagagaagcagtgaattaaagtcagatcaattgaaccttcctaatctgcataatagagtattttaaaaatttcatcatgtcctcattattcagaaaccctcctctcctatcttgtgtacttaaaggaaacaaaatcctgatatttaaagtattttgcaattagtcaccaaactaccttctacccaatctcccagtccccttcacatgaacccattatttaaaccaaatcaatcaacaagctgccccagcacctgtacctccccaccttggcccttccacacatggtgctcatacctgaaattctctcccctctttcaggtccttgagatgatatcaaatgccaccattttaaccttcttcaatgtgcctaactagcaatgtgatttctcccttttgaccttccgtcaaacaaacaaatgaaaaaacaaagcagtaacaagagaaaaataaaacatgcttttgcttctttgtgaaaatattcttggtcctgcctgcatggtcttttgtcttggatctaagccctcttattagactgtaagagtgtcaagggaaagtctatgtcttactcatcattgtacaccattcaatacctcaagagaccttgggaagatcataatgtctgccgaattaattggaatataactgtgatttgagaagatagtccataacacaggcattggttctgatatagtgttgccaagagctttcactgcatatcatagatctaagagaacctcgtggactcgcagaaatggaagaacctttagaatgatctagtataagaccctcattttacagttaaagaaattgcaggctttagtgaagtgtcttacccaaggccccatcctgatccagtgcccttccctgtaaaccatatcacctttatccctgtgccaatatctatacaggattgtgtataggatttggaacaataaatttaaacacacatctaaattttgacaagaataagcccctcccatcaagctgtgctttatattaaattcatttcagtttttctggagttcactacgtgctagtacaataatcacataagacatcctggcctttctggtcgaattcctgtatgaccttggacacaatgctgcccagctaacagaaataactgatggttcagttctttgtgaccatttgctaagttcagagtttcttcaatacctgtacagtagtgtggtcattggaattacatggcattggcctggtcaaatgcagaagaccgatattgagacccttcaagacacagctgctataggggaaactgagctcatataaccaggagaaggggaaagatgggtttctgaaaaaaggcttcaagctacatagaatcctctcaggatgctgagaaactcccagggcaggtagttatcagcctggtgagcaagtgcaagaaataactggattatgagaggcatgcctcacaagtggccccttcaatatagaagcatcagtgctcccagatgctggacaatggatggcagacaaaggctgcagctgagtcccccaactggcagctgcccttgggtgaagaagcctgcctcatgcaaggtcacaccccttcctgggggcctggttaatgtggatgtgtgaaggcctgggtcccttgctccagttcaggacagctctgtagggccatccctgtgctgagaatgtattgccccttctgccaacagtgttgattccaaagccttctgataaatatcttgcacttacatctccagcccaaggtctgattcccggagaactggactcatgaagggagcaagggcagggatgtggagaaggctgagggcagctccaacagagcagaggggacagcatatggctgtgtgtcacgtccagaatgcagacttggagctttgtggtgttcaggatgaagtcacacactgtccagctttcagctacatcatgtcagaatatgaacgaataaacaatctcttgtgcttccctggttgatctggccttgtctggctcatgtgctgttaaacaccatcggcccttataaacagaaatacaacatgctctacataaagacatcacatctaaattagccagaggcagtggcatgcacctgtactcccagctactcttgaggctgaggcgggaggatcattcgagcccaaaaatttgatgctgcagtgagctatgcttgactgagacccgcctgtcaaaaaaagaaaaaaaagaaagaaagaaaaagaaaaggaatggagggagggagggaggagggagggaggaaggaagggagggagggagggaggtagggagggaaggaaagagaaaaaagacatgacatcttagatggctgtcatctgttctgccttgtagggctgaacatgtccctatgtgtgctgcattcactcttcagccagcaggcccctcctggggtcataagtgcccctccccatggcaccatgcccaggccgcactcagtgaataaaccatctgacaattgatttgtccagtttgctgcacccaatctccacagttccccctactcccatatacatttgttatttcaaaaacctcaggaaatgagggcattggcctccatgagctcatagaatctttgatttggaagggacatattactcggaggttattttccagtcacatctgcttctaaggcaccatgaagacctaacccatgataaatcattggctacatacctcatcatcttaactgagtcactctttctctttggagtttgagaagaaataaggacatgcatgttccatatggcacacaggactggggttcagtggcctctctggttggatgattagttcctgcagccccaaaccaatcctccaacctcagatgattatgttttatgagcaagagggagaaatctcatcacatttttaggaaaaaaaaagattttatgatgcaattaattgcaagtcatgcactggtttggaggctgttagctaagacctgatggcagcaggaagtggatgtccccatagagttgtgggacgcagtaggcaatattattcagagccaactggaggctcaggtcaaacacagctgtttgtcagcataagatgcccaagccgtatcttcccactgactgaaaagcaaaattatcagatattgtgcatgtgaatattaatgcattgcttttctctttggaataattaatacttgtattattgcttttattaaaaatagcctatgttagccaggcttggtggctcacacctgtaatcctagcactttgggagggcaaggcaggtggaacacttgagctcaggagtacaccaccagtgtcggcaacatggggaaatcccatctctacaaaaaactacaaaaaaaattacccaggcatggtgtttcaagcctgtagatccagctactcaggaggctgaggtgagagaatcacttgagctctggaggtcgagactgcagtgaagccatgattgtaccactgcactccagcctgggtgacagagtgagactctgcctaaaaacatgtatgtgtttttaactaatttttttaagttttttagtgatgggggtctcactgtcttgtccagaccagtcttgaactcctggcctcaagtgatcatcctgcctcggcatcccaaagtgctgggattatacgcatgagccaccatgcctggccaactctactttttagtatatgatgatttgtctctgtgtccccagccaaatctcatctcaaactgtaatccccacatgtccagggagagacctggtgggaggtggttggatcatgggagcagttttccccatgttgttctcatgatattgagttagttctcaggatatttggttgtttgataagtgtctggcactccccacttcactctctctctctctcctgccaccatgtgagacgtgccttgcttcccctttgccttctgcgatgactgtgagtttcctgaggcctcccagccattcagaactgtgaatcaattaaatctcctttctttataaattacccagtctcaggtagtatctttatagcagtgtgagaacggactaatacagagaattggtactggtagattggggtactgctataaagacaacctgaaaatttggaagcaactttggaactgagtaacagacagaggttgaaatagtttggaaagctcagaagaagacaggaagacatgggaacgtttggaacttcctacagacttgttgaatgattttgaccaaaatgccaatagtgatatggacaatgaagtccaggcttaggtggtctcagatggagatgagggacttattgggaactgaagcaaaggtcactcttgctatgctttagcaaagagactggtggcattttgcccctgctctagagatccgtggaactttgaaattgagagagatgatttagggcatctggcagaagaaatttctatagcaaagcattcaagatgtgacctggctttttctgaaagcattcagtcatgtgcattcacagaaagatggtttgaaattggaacttatgtttaaaaaggaagcagagcataaaggtttggaaaatttgcaacctaactatatggtagaaaagaaaaacccattttctggggaggaattcaaactggctgcagaaatttgcataagtaacaaggagttgaatgttaatagtcaagacagtggaggaaatgtctccagggcatgtcagtgatcttcacaccagcctctcccaccacagacccggaggcctgggagggaaaaatggtttcatgggccctgtgcagccccaggacttggcatcctgcatcccagccactccagctccagctgcagctaaaaggggccaaggtacagctcaggccattgcttcagagggtgcaagtcccaagccttggcaacttccacttggtgttgggactgcgggggtgcagaagacaagaattgagctttgggagtctccacctagatttcagagtatgtatgaaaatgcctggatgtccaggcagaagtctactgcaggggtgaagccctcatggagaacctctaccaaggcaatgcagttggagcccccacacagagtccccactggggcactgcctagtggagctgtgagacgagcaccaccattttccagacccgagaatggtagatccaccgacagcttgcaccatgcacttggaaaatccacaggcactcaacaccagcccatgaaagcagttacaggagctgtaccctgcagagccacagaggcagagctgtccaaagccatgggagcccaccccttgcatcagcatgccctggatgtgagacatggagtcaaggaagattttggagctttaagatttaatgactgcccggccaggtttcagacttttgcatggggcctatggcccctttgttttggccaatttttcccatttggaatggaaactcaatggctgtatctccattgtatcttggaagtaactaacttgcttttgattttacaggcttataggcagaagggatttgccttgtctcagatgagactttggacttttgggttaatgctggagtcagtaagactttgggagactgttgggaaggcatgattggttttgaaatgtgaaaaaaaagatgagatttgggagggaccaggggcggaataaggtttggctctgtgtccccacccaaatctcatctcaaattgtaattcccatgtgtcaagggagaaacatggtgggaggtgattggatcatggggcgctttcccccatgatgttctcatgatagtgagtgagttctcatgagatctggttgtttgatatgtatctggcacttccctcttcactgtctttctcttgccactgtgtaagatgtgttttgcctcccctttgccttctgctatgactgtaagtttcctgaggcctgccagccatgtggaactgtgagtcaattaaaccttctttctttataagttacccagtctttatagcagtgtgagaatgggagaatggactaatataattccactttttagtatgtaaaatatgtgtttggccagagagccaactttttaagaattgtttggtgctgccaatattcctgacaccagtccccaaggggttgtctttgtgcataattcagctctgcaagtctttaccaagccccatggtgtgcaggcacagggcaatgctgaacacactcagatatgtgttgtcccaggtgctactcccgtcactgtcacccgtaggtactgacatgagtttggggtgtatctgaagagcctgtgataaagtcgggggaggctgagtatacccagtcatgccctggtgcattttgtacctgacagctcctcacagctgctgggacacactccgagcacatctcacagggtgtggacgactgccaggaggaggggctggtgtgtccttggagtcaccagaaacttggcagccctccctaatgtcagattccttcatgtctgaggactagtgctgccagtactagtgcagagaatggagtcagaaaatgcaatcaagtcattagtttgcttgaactgtcttttattttgaggaagggtcaaatggaagcataggatagaataggcatcttcatgacaaagtaacatgtgcccctggcaacccacattctactttccgtctctgtgaatctgactactctggggacctcatacaagtgggatcacatgatatttgtcctttcatgactggcttatcttacttagcaaaatgtcctcaaggttcatgcatactgtagcatgtgtcagaaagtctttcctttttaaggctgagtaatattccattgtgtgcatatgccatactttgtttatccatttgggatccatggcatttagaaataaatagatctcaaatttttagaaagttagctgcatttttattttcctttcatttccagtcctttttcctggtgttctttgtggctggcatttaaaatgcagacagtgccaacaagcccagcttatccatcctgttcagccctctgctggctcctcttaagacccagagacattgccccttttagtaatttaataaattagtaagtctcaaggctttaaaacaggttttaattttattttagtaccagcatactctagttccaaatgccttggcgttgcttgggggctcttggcatggggataaataaataaatggccttggaactgctggagtagtgaaatgtgtaatgaaacacctaataaaagatgtctttaaagattacatgcttggactcagtggcatagcatcccattggcccctggaatatacagtgccccaggacggggagctcgcccccacccaagctgggcttggctgagtgccctatagctgttgctccccacacaggatcgagcttcctgagctgcctcacggacaggcagcgcccacatacatagtcacaactcctttgcgcattcaagggcagaaagcaccagactgtacaatgcaagccagacagcagggggcaactttttcaaatcaccaggctggtataatacggtgatcactgaaaccttgccctttgcaccacgggaaacatccaagcagggacaccctaggccttctgctcatgtcaaagggctcaaagcacctccccggcgtcagttcctctgggacctgcaggtggcggcgaccatagctcctggcctgggattagaagcttggcctctgcggtcagctctctggctcagccttctcccttgactctgtgacctcaggaaggtctgggaccggctctgtgccacagctccctcctctgcacggtgggggtgctgcagcccctccctcccaggcccagacaccaggacccagggcctctccttgttttgctgcctttgcccaccctatcccccaccctggcacttagcccagcagggcttcgtaaggtctgctgagggcaggaatgtgggccaggtctgcttgtgaaggagcccattatcaatccaggagagcctgcttcacccacagccagattaacagccccatgaggttagaggcaacagcattggctccatggccattgttgccgcagccatagtcaaactattttaaattatctgaaagaatataccattcctgggccgggcacggtggttcacgcctgtaatcccagcactttgggaggccaaggcgggtggattacctgaggtcaggagttcaggaccagccccgccaacatggtgaaaccccgtctctactaaaaatacaaaaatttgccaggcatgttggtacagccctgtaatcccagctacttgggagactgaggcaggagaattgcctgagcccaggaggcagaggttgcagtgagccgagatcgtgccactgcactccagcctggctgacagagcgagactctgtctcaaaaaaaagaatataccattcctgccgaacagagacagaaacaggaacagagtgtttgctcctacgtggctggatagcaattgcctgtgtacattcctgagaaaccacaatctacatcaagccttttacattcaaaacacttccacatgcattcacctcagtttaccctctgagaaatgagtgagcaggaaaacctgtctccctgttttggaagcaacgtaactgaggtgcagtgggtggaaatggtatgcaaggttataggctcagaggaattctagtctctgctcagccccgggctggcatccagccctctgccccagcctgaggtgtgctgcggagcaacacagagcatcctggagaaaggaggggtgctcagccccatggattcatctcccccaaactggagagcagacaccagccaccaagaaagagccaagaaaggatggctgctgttactcaacacaccaggccacggaaaatacgcggagtcttcgctctggacattctgttgtgctcggaagtgagtcctcccaagcccgtggtgactgccccatgtcacactggttctggataattcggactagtcaccacctgccccagcaatctctttttcaaaaagtttgtccagggcttcggtagtaacatcagctctttcaccttggaaaaaaggcacagggtagagagatgaatacggtgtgattgcagtttaatctgtatcccattcatacataatttaactatataaagaatgaggtgagccagaaatgaaaggttttactctgatccccaagctctgagggatagaaagcctcccctctgtttctcccagggtgcagcagagccctttggagtcggagcagacccgtctcaggtgctctagctaggtacctctgctgagcttgcccttctcaaggccttcccgttactgtacttgaaaagagaatgacgaagaaacgaattctctttcaaaccggtagaacaagaccctgagtttgacaggaaggatccaaatttatgagttctttgcttcatgctgggactcgaatgtaagggagggaaaaaaagcccactctgaaagggacatgtaatggttatttatagccctgcaccatgcgggtcacctgcccggtgaaacgccatctgtgccgggttacctgcacgtcagcgaaggggccgggaaggcatggtctaatcccaggattaggagcagggagaaaatccatctattgaatcgttcaaaacaaacaaacaaacaaaaatcctacccgctcaaacttaaaagactgggagcctgaaaatgtttttgttgctgctgttgagttttcttagcgcgcctcctcctgaagttctcagggcacgaaccttcgtgagagtccagatggccagggtggtgcctgggagcgaagctggcttcgtggtaaaaggagaggcgggaacaggaacgcgctggaaccgcagggctcccgccgtcttgaaaggcctctggcgtggaaagcaggtggcggaaccgcccgcctcacggcctcactcagcgcagactcacaaaatgaaggcaccatttatgtcttctagaacgggagggagacggggacgctggcccctgccgtcgccgtggttcatcgtggttcacctggcctccccgggaacttgccaactgccacaggtccacaggggtgggatgaaaccaagtccatgcatccacgcccaggccccttgactcgcttggagcccttcctcccctcagccccagccatcgccagcctttctcttggctcccagacctctgttcccaaagctgtgtagaagtgtcgaaagttgagtagatccggcattgtgcctcggctctcccacctctgtctgtgtgaccttagcaagtcgctcaccctctctgagccgccattgactccatgtgttatgtggggagtagtgagtgcctcccttgcaatgctggggaggtttagtgacacgtctggcgctggataggcccttcacgaatatgctcagcaggctgagagatggggcctctgcccccagcacacacacctgcaggtccacttccaaacacaggttccggaagaagcccagcgaactttctctgaggcacctgtggagtttccatcacacaaggggcacctgaaaggcagccaccttccccagccagcagggaaccgtggcatggacaggcctctctgtgcagcagagctttgtcagctgtgacctgataagctcccacctgctgtcgggcactggcctccttgggcatacacgttcactgaggctgggaagaggctgctgggaccagggcagaagtgcccttgcgtagtgagggcctcacacatgggctgtttgcttctcctctgagccaattctgtgtgcgagcataatacacatcctaggagagaaggcttgggttgagggtgattatttataatggcagtcaggttgttgtaagacaccatcttttggaagtgacttgttgagaactagtccctgggtgcctctgggccaaggagatcgtttttcttctccttctactcttccctgttggccatgcccccagctggtgcagaggaccctcagagctgagtgtaagttacccatggcagctgccagctggtcaggaagggtcgccaggaagcccctcaaagggaacagctcaggggaagctgtttggaagctcagtgcctccgccttgccctggtgactgggaggaaggctgtgagctaccaggactctcctctggccagagcagattcagacaaaagccaggggcagcccctttgggaacctgcctcacgtttgagtcaccgacatcaaaagcaaggtcaggactgcccaggcccagaaaacaaccaaaaaccattttgcaaatgtagtcttagcaaaaacaaatggaatgggcaaatggagaaacattgtggtttacgaatgcagtggaatacgattcggcaataaaaaggactaaagtcctaattcccacaacgcagacgcatcacaggtattatattcagtgaaagaaaccagctgcccgattccatgtatatgaagatctagaacaggcaaaatcggtttaaatttatagtgatgaccggtgacagcccagcgtggggcagattgatgatcaagggcgcaagagatgctctggaagagatgggctctgtatcaagccacagggggtgtatatacgttatcaaagtctcccacctgtaactggaaaatgtgaagcttattgcaagttaattacaactcaataaacgtgattagttttaaaactatcatctgagcaataagaatacaaaaatctgtgccactaatcaggacatcaacttgtaggttcttggggaacatgcagagtctgagaacaccactctcatcattttgcactgttgcccctggaagcctgccccgttcagacccacgtcatcgcgtggtgtgacgtgttgtaattgcgcttggtctttgctcagaagctgcttctttgttattctacacgtgactccacattcacattgtgtgacgacggcactggatgcttgatacagaggaggagcggagagcctggctgctctcacctccgcccgatctggggctcaggcatggcccaggggagcccagagtacatgggccacgcactgagattcccactactccctgggctcatagtggcttcaaaggggcagctgaggtggggagtgggaggcaagggctgcagagtaggaggcacgtgggccggctcggccatggaggagccacacgtgctttgccagcccccatacgtcctccctccctgcaccttccccttcagaccatccgagccatcctgggaggctcagcctccaccacccatgtgggcaccttctgcattacctacaatagccagcctgagaggagcagcaagccctctgcaggccctcgggacacgtaataatggcagtcatctttaccgcctcttcacgtcattgcctgcggcagctctgtgctattttagactctattgatcctggtgccaataaatggttcatattcttcaacttccttaacttagaggctatcgtctcagtcaaattgatgtcttctgtctggctgacatagcttgggattctagtagcgtgtctttcaatgattaaggattacgttcttgttttgcttttgttgtgaagcagaatcagcgtcactgagacacgttcatgcaggaggcctcgtctccatcacaccacaaatactttaaggtgccaactttctgttctctagtggagtccagatccaacaggaatggctgggtctgggggaggcagggcaggctgaaagtattgctttccaaatatctctgagctgatgagagcaaagaaatgaggacaagagctgagggaggacccagcacagtagcccattggcagaaaacaagaaagagttcttggttttatcagaatgcagttaagcaaataactcattcatctattgctgagagaagagggtatagcaatggccttacaggggatacactgtgactgcacttcctaacgggacatgttctcctcctcccagccctcacccacactgttccctctctctctacttttccattgtgattcctggctaactcttagccatcatctcttcttgggacttgggacagtcctcctgacctccccacctggtaatctgtcattagcacccattttcacatacgcatactctgcactagacacttgaagtcaggagttcaagaccagccttgccaacatggtgaaaccccatctctactacaaatacaaaaattagccaagtgtggtggcgcacgcctgtagtcccagctactacggaggctgaggcaggagaatcactggaacctgggaggcggaggttgcggaggttgcagtgagctgagatcgtgccactacactgtagcctgggtgacagagcaagactccatctcaaaaacaacaacaacaaatggaaggatgagtggcatgtgtattaaagtgctgaagagtggctcctatcatgtttcaacaaaacttcatgttactatgcttatataagagtcctagagtggccaggcacggtggctcatgcctgtaatcccagcactttgggaggctgaggtgggcagatcatgaggtcaggagttcgagaccagcctgaccaacatggtgaaaccccgtctctaataaaaatacaaaaattagttggatgtggtggcgggtgcctgtagtcgcagctactcgagaggctgaggcaggagaattgcttgaacccaggaggtggaggttgcagtgagccaagatcatgccactgccagcctgggctacagagcaagactctggggggtggggcggggggggaagaagtcctagaaaaacttgcattttgtaatttaaagcaatgtgttagttatgataacttttctgatttcaccctgaaaatgctttccctcaattttgataaggcaaaaaagtagggattttttttttcaaaacttctccaagcttgtcagttcgacaagatcctttcagctctgaggcattcaatgaaacagaaatgaaattgtgaacacatatctttacagcaggacattgggatgaggataagtgctctccctctgaacttctgcatggatatttgcaagccacgttattttcgtgagcaatcctccaagagtgcagagcacccgagcaccacaaactgcgggaaatgcagagagagcttccttcctctttgggacgccagccccagttctgtgtacaagtgcacacacacctgcttcataacataattagcattctgagaagcccaaacctagtctgacaagcagcaataaccatgttggtgttcagaaatgtttttaggccacgactgtttactgcacttcagaaattatcatcgtcactggtttatatgtaggaaaataaagactagcggaaaaagttgagtcaaatagaaagatgagatgtgaacagatgtgtccaaaatactgattttccatgctcttcctgcctctgtgggttctgctgaagattcagtgatgcacagagagttctgaagaattggacatgcttatttgtattagtagtgatccttcaaaagaaaatctagaagtaaataagtgtttcatgcattatatttattattctacgtgtgcaagaatatctgttttctgagtattatctcaattcaaattaacaaaggaaacttgggaacttggattttaaactttcaactcaaacctacctctgtccacgtcttttgggaaggccccacccgagggctcagggccatttggtttgccctcatctgtgcctctccccgcaggtccactgtgcatggggcctgtctgggtttgccacatacacacacatacattcacacacatacattcatatgcatacactcatacacagatacacacacacatacacacacatacactcacacacatacacatcacatacacttatactcacacatataaacatacacatatacacacacaaacataaacatacagacactcacacacatatacacacactcatatacaaatacacttacacataagcatacacacacacataacattcacacactcacacacatacactcacctacacttacacatgcatacattcatacacatacacatactcttatgcacacactcacatatacacatgcatacacacatcctcacatatacaatacatacactcacacataggtgctcacagatacacatacactcacgtgtatgcacacactcacacccatatgtttggggtgggcaacacccttgagacacttagggcctgagagaatgcagggacacagcccacccctttgaggggctgccaaaggtcagtttgcccctcatagccctgaaatcttcaccagggagtttgcaaatgaaagattttcagtgcagtgataaagaagagtggctgcttataaacccccatgtgatgctgtttgaaactctggggcccgccagtgtgctctgttgccagtcacttctgtttcagcgtcaccctccactccagccttgggaaggacggtgcctgtggtcttgccaagacgtttggcctgtgctctgcgtgtctgttccccggcacagcactgtggggggcctcccctgcctggccagagaggctgggaacaggaccggctatttaatttgtgggacccagtgcaaaatggaaatgggtcagaaatcactgaggacttcaggctggcaaggccagcaggacactaagtgctgcatggggcaggagggactcccaggctaccttctctgctttcctcctgctccggtgaaacagatccgactaaagcagaagtggaaagagaatgcatccctctcctcccaatctaatattaattagcactactcagctgagacagggaagattcagagctgtaaatcacatcaaatggaagtgttttcagctgctctgatggtgaccttgcgggctccctacagggaagggaggtctgtctgggttgatgggaagtgggggcttcagggaggcgggggagtactgaatcctgctgggtgtggggaggaggccaccagcagcctccccttgggtcttcctggaggaaggagagcgtgggaggccggggaaggagagtagcgctgggtgggcagggagcccgcagccagctctgtggctgcctcccagacacaggcagttgccagcaccttgcctcccgccatggaagagcttgtgcccatggagctgagtgggccagccacagcctctcccctccctgtccgtgatgcggtcaacccaggcgtggcaagccctgctgggccaggccaggtaagcacgctggaggggccacagacaaaagggacatccgtcctacagactttaaaaggtaactccgaaccatcaggcctgccaaggcttcccacagccacctggcctcagctgcttcccacagatatgaggtgtggccctttcagggagaagcttttggaagaggtagcaccgtcacagtcaaggggggcccaactgggtggaagaatgggaagtcccggaggctggaccatctgccagccgaggcagtgactctgcttctcctaaaggtggtgaccagtagggaggacggccaccttcttcctgcagtgggcactgtctgtgctctggaggcagccgtgatgacaagtatagacagtcaaagccacaccaccaagggtgaaggccattccaagaggcgagcagctcagagaggagactgagtctaggggaggacggctaggaaagggggccaaacttgtatataatgatgtcttccatgtctggctccctggacagataaaggcccaatagagcagggaccctatctgtctggcaccgtccttagggcctataagattgccacatagtagcagctccacagctctttgttgaataaatgaatgaactctaacaagattaagggaatcggtgtctagtgcagagtctgcgtgtgtgtgtgtgtgaaaaggggtgctaatgacggcatttgttctttggaagaaggccagaacttaaagagggagagacccagccaaggctttcttcctgggctcccagaaggaattaaacattaattaaacattaaacattctctccccacctcagcaagatgttgctaggagatcgtctagaccagtgcttctcaaactttaatgtgcacacagaccacctgcagatctggttgaaaagcagatcccagacagcaggtctgggcggggctgagattctgcatttctaatgagctcccagctgatgctaatgctgctggtccaggggccccactttgagcaacaaagtggcaatggtgaggattaagccatggtagtgcctggctggggtctgagctcagtagtcataagctgatgtgattacagctgtgtcatcattctagatgggaattgaggaaggaagggccaaaggcagaggaagagagagcaggtcggggaagagaagctgttaattcaggcaggagtggcagaccttttccgtaaagcgccagatttgagatattctagacttacctggtcatgcggtctcttatatcatgaaatgcctacaggcactaggtaaccaacaggtgacgcttgactccaaaagagtgtgttcacagaacctgctgggtggcgactggcttcacaacccctgaactggatcactagccaattaactggttagttccacaagttaagcagcagccttgtctgcctcaggtgggaagagacatttccacgctgctttggtttgaatgttttccccacagtttatgtgttaaaaacttaatcccttaatccccagtgaacaggtttgaaaggtggggaggtgatgaggtcgtgaggctctgccctcatgaatgacttaatgtcatcatcgcgggagtgggttcgttatctcgagagtgggctggttataacagtgaattggccctgcttgcactctcttatcaccatgtgatgccctctgccatattatgacatggaaagaaggctctcaccggatgcagccagtcgctcttggacttcccagaaccagaaccccaaataaacttcagttcattagccagtccgtggtattctgttctagcagcacaaagcagactaagacaggtgctccctctccccatcactgtcacaaatatgggagctcagtgtgcacgaggctggagccccacgtcagtcaggtccttggtctcataccccagcagcatcgccaggcactgatggagattggggatccccaaagtaaaacaaacaggagatcacgactgggagccgtcagccccccagcgcccagtggcccacctcctgcctgtatctgcagtctgagaagtgggatccaaaccacaggctgccctgtgctcccctcccccagaccccactcaccctctcagagaattggtaacaataatgaaacacatctaaggccacagacttttagttctgctttgtgtatctatttttcttttctctctgcttgggtttacctgggaacgttttaattgcgcctttcgataagtgctcctggttgacactaaggtgcggcaggcccagcccttctcagttattcagggaagccctccgaggctcagctataattagaagtcaattaaattagaaaccattcatatggttcttggaaggcctccagccctgctgagagcctctggccctatccacagactcagtggaaacctatctctgctaaccccaccatcctgaagccaagtccagggctgctgggagggggaacaggctcctatcagttccccttcaggcctttgcttgcacccaaccctcccccacctgacgggctgcaggtcgcccttgcctccccgccaccccgatctcccgtcgctgcctgccccagcttgctctgttgctagaaggaaaacacccagcgagttcaccactggggtggctggctcctcaatcttgcctcagtccatttagtgttttccaaacggtaaatgcaacactaaagtgcaggcagtgtgtgggaaaaggcagtttttgaacctcatcaagagggtctggaaacagaactcttccttccccaaagccacctggaggtctccaccaagtgagacacctccaaggtgactgggccaacagccgagacccaaggaaagacccaggaccactgctgtgctttgccagtgaccccagtcaggtctgtcctctgggatctcccctgggacccccttctcccacctattcttagagcagccagggacacacgctttttcctttatcacagaattcatactctctcttctagaccactcagacaatacagacctgcataaaataaaaagtgaatgttccccagaatgctccctcagtccttggtcacccccacccgatttcagttactgccaaaaaaatctttgctggaagttcagcaggcatcgctccagacctgctttcatgcatttagaaactttacaaatacacccggaggcattcttctctatcatttctttctcacccaacaacaggtgttacagccctgcttggtgttccaggaaactgaagttcctttggattttttgtgggtgtttatttgttgcaatgataaacaagcgtaccatcttaaggccctgccaggattctgcccaccctcttcctacgggagcgagggcatgtgctgttgtactcgggaggcaggacaggcgtgctccccagggatctctggaaggcctgcagactggaagctccctagcagccagttaactgattagttccacaagttaagcagcagccttgtctgcctcggatgggaagagacatttccatgctgctatggtttgaatgttttccccacggtttatgtgttaaaaacacatatgtacttggcattgggtgcatctcctaaaggaccattctctttccagaaatctcagtgaagaagcccttaagtcctgggggatttggaaaagaagattgtccatgtcagtccccactgacagggcccttggtcttttgctcttctccaccgttccctggctgctgacttacacagctctcacctccttctccaacttaattcttaatttctttcttttttttttttttttttttttttgagacagagtctcactctgtcgcccaggctggagtgcagtggcacaatctcggctcactgcaagctccgcctcccgggttcatgccattctcctgcctcagcctcccgagtagctgggactacaggtgcccaccaccatgcccgggtaatttttttgtatttttagtagagacgaggtttcaccttgttagccaggatggtctggatctcctgacctcgtgatccgcccgtctcagcctcccaaagtgctgggattacaggtgtgagccaccgcgctcagcctctccaacttaatttatttccaataatctttcgctaatttctacctaatgcctttaggctgttgcaggacttttccaaaagaaagaaagaaaaggaggaagggagggaaggttcctgtgcatcatggcatatgttcgtcacggtgtttttgtgtgtggtattgggaattagttggttttcatgaccaatggtagcttgctaaggacgagagaattctgagggtgaaaggtcttagggagtttgggttccatggcccagctggtcttctgggctgtgtcagtggttgattctggaaggttcctcacacaacccagcatctagaagagtacttgctgttttgttgtggcaagaggacagtgaaccagagtgcagccactggggaatttaggcgatcactagagcacattatctctctttgtagagccaggctaattaatacccagactaccaagtaaaattgctttgagtcagaaacacaggtctccattcagaaagtgaaaaaacaagcaaaaaaaaagaaaaaaaaacccacctcctccttcaagggaatgcattcgtgtaatattaatagttggtgaaaagtatctgaacacctgaacagctgcagccatgctcaatcccttcaatcccttaagtagctgtgtgacctggggcaaatcacttaacctctctgggctcccactatctcaactgtaaagttaggttattggacttgtccactttgatggacaacctgttcttaacagagagagggaagaacactaagctggggctgggagagcatccagaggggcaaagaccagaatctaattcctggcagtctctccaggggtcctcctaagtcctggagcccagaggccaggactggcctggaggactccagacttaaagctcatgtaaggctaggtttctccaaaccctctgagcacgagaaacacaatcactaacctcgggtttaaccttgggccctccgtgtgctcctagcctcctctcaggctccctcccaggcatggctgcgaggctgggaaggccccagagtcagcccaagtggcatgggtacagcttcagcttcatgtctgcttttcttttaggatgtatagtttcccctctgtttgctggaaggcaccttatatccagtggggttaaataaaggtagccagacccccggctggggtgctaccgccagtgcccagctaatgacgcatgtctttcaggtgagcccttgggagaggatggcccatgtgggggactgcacgcagacgccctggctccccgtcctggtggtaagtggtctgagccccttacccccacagcaccctcatcctcatgatggttggactgtttcttggcctcttcagctgtaaaatgggaatgctgatcatagtccctcctccacagggttcttctgagggtgaaatgaaaccaggcctgcaaagcacagaactctgccccaggctgaagttacattgatttcgttggtagctcccttcatagggtctcatggatataaacgttcttgattgcttgtttgtggtgtgatacacacagccctgtgtctatgtgatgagctcatgcttgggggccgcgcagctaagaaagacttggaagactcagacccctacccccatcctcctggacacgccggtgttctgagaagccactgtattagaggctcagtgggggacaggggcgcctcctccatgaccttggcaagtgcgttgatgaggagaactcagagcaggccttgatggtgggatggggcttggccagcaggggtgaggcagggtggttctagtgggggctggccgtgcccaggtgatcaaccaggagccactggagacttagcagcagtgagcactcacaagcgggcaccttcccagaccgagcccccagcagagcccccaccgcagggcacccccttcctatgtcaaccttggggtcttgcaggagtcacatgtgtttctaaggaggtacggaggccacaacacccccctttgttggcaggtgtctctgatgtgctcagcccgagcggaatactcaaactgcggtgagaacgagtactacaaccagactacggggctgtgccaggagtgccccccgtgtgggccgggagaggagccctacctggtaaggacccagccctcctggagcctggtgcgctctcaggggaggcctcctgcttgtggcattgttgccctgagcctgccttgctgtgtgaggggatgccagggtatatcaaaccagccggtcacgctccctggacgttgagattgatggcaagagctgccgtgagcccaggaatggcactcaccagctaagcattcataaacagatttttcaggagttctgaaatgtttttaaaggatcactttcccactctaccctgattaaatgagcgtcagatcatctgattggaagcaggattgaaatattctccagtactagtacattttttcctgagtgctgcatctccctccgcctctgggcaagctaagcctgagtgttctgttcagcactaagggaaacctccggggtttcagtgtccggttcttgtagcaagctgaggaaagtcagatgccaagtgctacctgcactgcctgggcattccagcagctcgctgaattcatctcggggaggctcagaaaaggggcagcatctggagcctgagagtggcgaggagaggggcaagcccagagcatgagctggttcctggggggttttgcagttaggacaactcaggaaaccaaggcccggcaagagtagcttctggagacagctggcacgtcactgcccaaggactgtgggccgagtccgtatggtttggctgctgcactcacctgtgtcccctgtcctctttccctggacagtcctgtggctacggcaccaaagacgaggactacggctgcgtcccctgcccggcggagaagttttccaaaggaggctaccagatatgcaggcgtcacaaagactgtgagggcttcttccgggccaccgtgctgacaccaggggacatggagaatgacgctgagtgtggcccttgcctccctgggtaagcacaggccctcctggcaaaccctggcatgctttctgcagaaaaccccgaggggctacgggcaaggaccttgggaacaggggtcatggatactgcaggcctcggtgcagccgcacacctggccttggtcccatcccacaaggagcagcatccaggacggagagtcctggcccctccggtggacaggcagcccatcaggctctgcctctgtgtctcctaagtggccattaaccatcataatatcttctgaccaccaaaaggaaacaaattgcttgaatacttacagtgcagtagcgcatgtgaaacactttgggaaaaagaaaactaaaatttcatgcaaaagcagcatttttagtatcctgggaacactctggggaagctactaataaaaatatttgagtcatatgatacctataatccctccaaaatgattatgcatcagaagtcttcaaaaagctgaaaatgcaattagcctgaaagagagaaagataaaatcttcctttttccaggcatgacacctcagcaaattctgccagggaccaggaaaatacagactctcaatccccagaaaatcctgagccatgatcattgctgcttcctccccctagtggccacaacacatcatgctttgcaagggctacaaatagagactaaagataaaagcagtggtggtgtccctggtacagctggtacaggtgggagaggtgatggcagtgatgaggctggtggggacaagggaggtgatggcagtgatgaggccagtggggacgggggaggtgaccacagcttagtgcataaggcacactcagagtgtcctaggagttgcagaaggacctctcacctcatggctggggaggtagtgtcagcagaggtcttgggagatttgtggaggtgatgcctggatgagttaggctaagaagtaggactaggacagaggcctgcaagtggagatgccgacgccagagttcagagggctgagcagctgggcagtgcctggggctctgattgggtccctgtggccagagcaagagttgtacacctgggggtgtggacaagctgggcaggagggcagggagcagatggaaccaggctctggaaaccaccgctgaagacttgagccttccgctcgaagctgatgcaggtcaacacgcagactgctgagccagggatgctgtgggcagggagagggctggagcagaggcaccgggggtggaggagaggaagaatctgagagccccctgaaagacagcactgaccaggggtgcagatggcactcagaaggggaaagagattcagaagaggatactcaggtgtctccatgactggccatgtggaaatagtgccatttgtcagctgcagaagacaggagcaagagggtgcttggtggggaggtggagggaggatagaggttgtgtgtgtggaatttgaggggactatgggacatccagacctagatagctaacccagagatggcctgaacctccaggcagagatccagagctgggaagtcactatgcactcagggtgctgggggccgctgtagtagaagggttccccatggggcaaattcctactgcagggagagggtgggtgcaccacggaacctcgccgacctatgctgctggctctggcctggctacggttcagacctgagaaggtgtccatcagtacccgaaggccagggctgactctatggcctgaagaccacgtgcttggttctgatacatttaccagaaagtgtgtaattactaaagaagttggacactggaagggtggtgagctccctgcctctagaagaattcaggcgaatgtggacagccatctgcagaattagtgggcaggctgctctctgggcttttaaacattctttccagtgctggaatcttgatgcctcccgccctactccatgggacagtgacctgctcagtccacaccactctcagcacccaggacatagcaaggcccagcacacctgctgggcaggcaagggaccctgtgcagagacaccctcagcacgtgcctcagagtgccttcgcactgctccgcaggggtgcagacgatggggacagtttccaggttggctccatgatgtgctgtgtctgctcaaagcctcactgccagtcccaacgcccaccaaaattgaaggcccccgcctcacctccgaatcccagcccctctcaggggctcatgctgccccctctactgcagacaaggcttccccagggtaggaccctggaggccccacttcctcttacgaggctgtcacgctgtgtcacagaggaggatcacaggagtcttggcaggccggtgtgactagctccatgaaaggctgcgttcattcctgaatccaagtggctgtcaggctgtggatgcggattgccttgtcccagtctctcctgggcccaggcccctgcctgcggtttggcaggtgcttctcctgatgctccgccctccccacagtgtggccaggacacttgctgaacaatgagcagcacccgaggctttcctgttgggagaggttgtgtgggaggacctgggaaccaaaacaggaggaaagggggagagagaggttacgcttcctcacctctccaggcctcaccccggaggagctccaccaccccgcgattctggatggcgggggcagggggcaggacacagcgactctgcactggttctgcacaccaacacggttggaggaaaatgaacatctgggaatctgcggcgtcccttacaggcatgagagtcctgaagaaaggaactctctgggaaaatgtacacctattgactgagagaaagtcagtccttaaacaacagatcccaggggacccatttaaactgactcttgtcctgggctatacacctgaatcaacctatgtagaacaggggttggggggctagggagaaagtcaaatatggatcaaaaagtagcaaattagacctttccagaaagacgaagggaccggacactctgtagctgggccagagatccctaaatgaacacctgatttcgggttggtgacaagcccaggcagaaaaagacagccacatgttctttgttgctgtgcagcccaggatgagagacccaggtgtaagccaggcggtgaggagtttagcctagtcctacagagagaacctaacatttagaaatgttgcatgcagcaatacgtgctagaaaacggtggcttctccttgtcaggaggcactgaacactcactgggtgaggaaggacagtttcataacagcctcttggagccaatgtttttttaaaagtttatcaccggtcaggctcggtggttcacgcctgtaatcccaatactttgggatgccaaggcaggtggatcacttgaggtcagaagtttgagaccagcctggccaacaggtgaaaccccatctctattaaaatataaaaattagccaggcgtcgtggtgcatgcctgtaatcccagctacttgggaggctgaggcaggagaattgtttgcacctgggaggcggaagttgcggtgagccaagattgcttctctgtactccagcatgggcaacagaaggagactgtttcagggggaaaaaaaaaagtgtatcacctttcaatattccttaactgagtgacttgataggttgcatagcttgacccatacacatgacccccacagatgagggtggccagcctgtgacagaaggtgcctcgtgcccaggacaagtcaaagacacagtcgtgggacagagccaccaccctccccatgctcaaaatgtagtggccccattgggcacccatcataaagccgggtgttgtgcatccgccgtgtagccttggagctttacccatgacagagaccaagcccggcacctggggtgtgaactaggatgggcagagaggccttttggggcctctgtccacctcagcatcaaagttccacggagaagaacttggtgtcattcattcattcagccaatgtttacagacaatcatccttccttagtacctagcacaaggtccaaggaatagagacgtgaacaaggcttgccctggagggcctcccagcccaggagcgggaccaatagacgtgaacaaggcttgccctggagggcctcccagcccaggagcgggaccaatccccctaggtgggagagagaatgcgtggaggtagagtgagaaaaggtggaggaggcaagggcgaggaagtgaggcacagaggaggtgagatggggagcaggtggccacctaggagcctgagatgtttctcagaagtgtcagcgtgggccagggacgttagaaagctgcaggttgacctggtctggcccacatgcccgtgaactcacaaggccacgtggcagacacctgccttggcctgcctcatagaaagaagtggcttctggagggcagaaggtagatttgcgagaggcttagctgtaaaactggctgtcgtggcttctctgggaggtgttttgagattggttaattaatgtttacaagatacacagggatctgaggataaagggctttgagggagggcaggcaattatggtcctaacattactggtaacagtccaggctcaggaaggcaggagcccacagacccccgtgccaggctgctgcttagcactaccgtcagcaggggcctccatggggcctggctaataaaaaagagattagaaagcagccatggaaatattccttctcatcccagttcttgaatcgcaatagggaaagtgttggcaccgctcacgttatttaatcgactactcacagtgtgacaaatggctccatgctctccgctgagcatttgtttatggaaaatgggcccaggctaggataggagctagagcctgcagagggaaggcgcccgagctgggagccccaaggagagggtggtgccagcaggggctgtgcctgggagcgggacggctgcagggagcacagccacagggcagacccctgagagcaggacctgagcagtcatatagccacggggctggcactgtgacatcggggagctgaaagacataatggaacatcactgggagctgaaggacttcaaacagagctactgtgaatgatttgtcccttgcactgtgtgtgcagccccagcgtaaaggcttgcacttccaagggtgtcttctgtcaagtgctttctgagaaggaggcacttacaacctggttgtgttgccagctatcatgagggccacctgcattgacctctctggacagcacaaccgtctgtctcctgcagctgcactctggtggcattcagcagcagtaaagatggcttgggagttccaagggtcccagaggcacactgatgcctataatcccactaggctgcaggctctggggagggtgctcacagagggcatgttcctcctccaggaaggtctggccttggttggtgtgacccctggggggctaagcaggccctacatgtgggggcacagggatatttctggtggatgatgtgatggcacacacactaaacacagccaccagagagaggaaccagaaaggggctgagatcaaaagaaaggcccacgttggcagctcaatattgttaaaagaatgctccatttcaagacaggctgaaaccccaaggaaactgagtggacagagcaggtgactgagtgggcgtggcctcatgcccgacttgattgtgggcctgcagactggccaccgtgctctctgcaccagtccctgcctgtgtgctgtccagctcacctgtctctgttttgtcttgtctctcccccgtagctactacatgctggagaacagaccgaggaacatctatggcatggtctgctactcctgcctcctggcaccccccaacaccaaggaatgtgagtgtctttgtccttccaccagcacggtatttgttcagcacggatccctttcactacagagggtgtaggaaagagccggtcctggcacctggacaaggtgaatcacagtaacagcactagtgaaagtgctcctgtggcctgtccaggcaggtctatgaagggagggatgtttgccacatctgagccttgagtcagaggctgaggttctagtgcaggttggccaccagctacctgacaagtcacttaacctccatgagcctcggttttctcatcggtaatatgggggtactaacatctgaccttcccatctctcacggtcattgtgaaaacaaaggagatcacagaggcaaagtactactattttgcaaagtactacaaagtgctaggtgacagtgaggccaaggaaaatataaatgtgatcacaattaatgaaacagattccacaaagcacatgtaaacagtctcaggagtttataatcctgccttggggtgtttctttcctgttatcctttctggctttcatgggcatctgtttatgacgaagggccaggtacctctgcctcagaggaatgtgctgtgtagactcttagatgtgtggtctggggagagacggaggcaggtaggacaagcagctgggaggaagctgggtgtctggtgccgggctgcaggagcacttgccaccctctggctccttcaagggtggaggaggagctgaccctgggaccctgcctctctttgctctccataaggcgccactacccccatgtctcataataatgttgtccaggagaagaaggagagcctgcgtcttatcacgctggaaagaaggggaggagcaggaatggggcgcagcatctcctctctccttttggtcaagccaggaggagggttctgtgctgtgggctgtgctgcaggaggagcaatgcatgagccctgcaccaatgtgtttgctcgtcttcaaagccattttcctggccagccatatgctaattaattcacaaattagaggaggccgcagctcggctgccagcctgactcatggtgaagccagctgccatggcccgcatgtcctctgtggggatctaggctgattcaaggccagatcattctgggttgaagaaccagtctggaaagatgtcagacactccccacctattcacaaaagcatctttgcctgtggaacctgggagaggagcagtcctcctcaggggcttttctgttcaagagttctcacatggcacagccttcaatgttcaatgtctggcagccagagcagacttgagtcacggcaggggcgcctctctaagtccagcaatgaggtctatcacatgtggaaagcaagcaaagtcccctgagtcctcaagattttaaagatgagcgcaccccactcccacccccagcccttgcctgctttactgaaagccggctccgaggaaagcctcggggtagggccttagaatccggccctgaaggaggtcagcagagaaatagacagtcctgctgtgttcccattagaggccccttgggcaaggccccagacctcggcttgcccatctgggaaatggggagatgcggccagataggccttggggtggatggagccctctgggttagggcctcggtgtgaatgccaaacagagtgatgccctccacccctgggcctgccctggtctcaatccagagatctctttactcagagcacctgcccagcagtcagcaaaaacgtcagagccagaaagccccatggagtcactaagacccacacacacaggactgccatcagcagccccaccctgggcagcaaacatttcatcaggagcccgaagttgccaactggctgcccaggtccagcaggccctgtctttgtcaaacccacagttgtggtcaagagcacctcttcctcccctctgttttcttgatttacctgggccctcgccaaacaaagtgcacatccttggtactctgcagcaacaaatggtggattacgcaaaccaccgtcagacttgccaagggcccctggctgaggatgacacccacctaggagagctacagcagacaatgggtcgcagctgcaggggagacaccagccaggagtgagcccaggtcagtgtcagggtctccccagcctaggagtgcccacagctctgccccacacctcccaggctctaaccctatgcctaggcacctgtgcaatgcaattacctcctatccttaaagagacggcagcttctctgcacctctgtgaagcagagggtttcaggggggtgattcgcaggggagcaccctgggggtttcttatgactcgaattgcttggcccacccccgattcatcaggtctgggtgagccagagaatgtacatttttaacaagtttgggaaccactacggtaggttatgagcctgctctggaacttcactgcctgagttagacgagttatctcacctcccagagcctcatgtcctctcctgccccgggcagctcccagtggtgcccactgcccaggctcctgtgtggctcaggcgcaattttgcccaccaaatcctcccagaagcacatcatgagtgccccagggcgttaattaatgtggtgcagcccctcaaataaccctgaggagaaatgaaaaagcaacatatattttcctttaaaatggaataaaatcattccagtttctggggttgccaagtaatgagagggaaaccaaagaggacaggcgtcagattgcagatcagtcctggctgtgggttggttgtcaccttggattggaacatactcgcccccagctctgagcctgtactcagtgactgcaatactgtggagccctgtagcccggtgaaaagagatgaaaaggccttcggttatttttcagttaacttaaagagcaagatgtacttggggtgaccagagctttctggttttctgttttccctgcaccatcctgcataaagggatctgtgatttaatgacagtgggggcagggaggtcaacccgttgccctgccgtaacagagaggaagatagggtccagcatcaggcttgggtttcattacaagttatcacccctgggaaagtgtcctcatctgcaaaatggggacatgattgttgggaggaaagatgtgatgacgtgggcgatgcatgtggagtgcttactccagtgccaggcgccaggcactgaccagagatgaagcatcccagcccagcaggcggcatggctccacggcacgtgagctggcctgcacttccctcactgactggcggtgtggacagcacacagaaggggaaagagattcagatgaggactcaggtgtctctgtgactggccatgtggacatggtgccacttgctcagctgcagaaggcagaggcaagagggtgcttggtggggaggtagagggaggatgaaggctgtgtgtgtggaatttgaggggactgtgggacatccagaccaagatagctaacccagagatggcctgaagctccaggcggagagatccagggctgggaagtcagctacgcactcagggtgccgggagccactgggcagaagggctccccatgaggcagcttcgtagtgcggggagagggcaggtgccccacggagcctcgctgacctacactgccggctctggcccggctacagttcaaacccgagaaggcaccccagagcctgggacactgggcagcagaaatccttccctagaaaagcagtcagggccaggcgcagtggctcacacctgaaatctcagcactctgggaggcctaagcaggcagatcatctaaggttgggagttcaagatcagcctggccaacatggagaaaacccgtctctactaaaaatacaaaattagctgggcgtggtggtgcctgcctgtaatcccagctactcgggaggctgaggcaggagaatcactggaacctgggagatggaggttgcggtgaactgagattgcgccattgcactccagcctgggcaacaagagcgaaactccgcctctaaataaataaataaataaaaagcggtcagagggttaatgaaagaacgcaatagcctggcagctgttttcttatcatcagtgacgaagtcccctcaggcaaatccagagcaggctggccttttggagaaatctctgctactctgcgtactcccgtggtttccgtctcttgtgcccggatgctcttccgtgacactaaacagcaagcactgcccctcaggtgtgaagcgggcctcccagcctcccagacaccggcgctcagttgctcctggctcagagcctctcagacctgactgcacacacatctccagggacccgctgagcaatggattctgacacagcgggtcccagtgggcccgagactcagcatttctagcaggttcccaggggaccccactttgagcagctagagagtctctgcgagtctgcccacagttcagaatctgccactgggggtacacagccagtgccacagtctgggaccccttgttgacagctctaagaatcaacaaacagatcattcctaaaaatgcaatcttttaccctctgcagagaatcccagccagcctctaatgcatactggtgagattctaaattgtgtggattaacagacctcaaagacccccatatgagctattgtggctgtaaatggaggcgtagctccctccagccatgtgcttctggctcactgagcattcctggggaaggggaacacagtgcccggcaggaccctccccggagtcaccactgcctcgaactccacgcgaggtaggcagaaccagtccccgctcattttcactttaaaataggccttgtgaggacatttttgcctgttttgtggaactgcagttcataccagcttttatcaaacaccccagccttgcttattcgaaactcaggtgcacacggaagtgtacaaggggagatggacccgcagttggccacccaacagaaacccacctggagcaccttgcacttaacaagcatcccaagaggcagatgaaccgaaacacacagcacacagtggaccggggtgaaacctccagacactgtatatttggttagtgcagagttaatcctcagtagacaggcatagaccctggcccaggagaacttgggtgcaggtgcagggggtgccggtgcctatcctgggggctgcacagggctgcatctccaccagggctcgcgccccaccctggtttgtctgtggacccccagctggtgacagtggaaggagtggacatggtgggaagaggatcagcccagaccgctctcttttccttttaatattctgggttttgcccaaacctcttttagacatcacgtgcattcaacatgatgctggtgcgctaataatataaaaatgcatacttgtatgattctgggatggatttttttcaagcatttaggggtaatgcagagtaggtgcttgttttccatggcaatttttctgactcgcctggaaaacagcagacccacccagggctgattatccaacctctgcttcaggctctgcaggtgccttcattagctgccctcaaaccacacccattgctgcccaaggttggcactttgggaccggatctgctcacctgttcttgtgggttatatgtgtagtgacagtggcagcaagcagaggtgagacacttgtgtggggggctgacctcaccctcatgaggtcagccctgcagccagggatggcaaggcccaccgcctcccgtttgacccccctctagtcttagcataccttctgtcttgcccgggggcagaggcactgaattgtggacaaaaaagaccaagtaagctagatgcttgttcttctttcaattgatacataataattgcacatgtttatggggtacagagtgaaatttccatacatgtatacaaagtgtcatgatctgatcagggtaattatgatatccatgacctcaaacgtttatcacttctttgtgttgggaacactgcaaatcctctcttgtagctgtgagaaatatacaatgcattattgtccgctgtagtcaccctgcagcgtgccagagctcagaacaactcctcctgcccggctggacttttgtatttgttaaccagcccctccttccccacctctgttctgctccacttctatgagatccactcctttggcttccacacgagccgcgcgttgcttttatgaaacagctgtgcttggggcagatccatttccttttttgccacaagcaccctccctcgcctgtcggccacggagctgtgactctgaaaattctggcacacccttgcctttatctgtggtttgagggtctttgctcctctcccttctgctgaaaaggcagctccattccttattgccgagctccgagcgcagggaagaggcccattgtcaggaagtgagctgctgccctttggtggcctgggtggcctgtgggcaagtctgaatccccatgtcctcctgctccttgggcaatgatctagtgactgtgattctcctgaccagtcttgtgagaagtgtctccctgcagatgctctagtggccctgggaactttggaacgtgagggggcttgtggggtctggctgattgggtgctggctttcagcttcagtcctgacacgagaggctgagctctggagaaatgtcagggtccaccatcccacccatcttgcccccacctcctcggctgcgcacacgtgctcagagcaagcatttctctcaccaactcagggatccctgcacaccagggagcacccagcctacacctgcagcctggcacagttggggaccgtttagttggtgccagctggaggtgtttggagggaaccatccggtgatcaggatagaggcacagctggccgagggcaggtgggcgcctgtgggtgcaggaagatgtcacatctgcaggcattgtttggggacgtcattgtgtaaccagccctgcagggctgcagaggcatcccacaagtctgtgtgctctctaggctgcgtttattgccccactctagaccacaggcctgggcatatttgtgtccccatccccaaccctgtcacctgaagcagcctgcgagccccgacaggaagggacaagaagaggcgaagatgacaaacattcacagacagcccatggctgttcttttgctctgacagtgtatcttaagctcccttgagcgccttactgaacagatagatcagcttcttttcaatctcttgtttgctcttataaaggaaattaggtcatgctggaaactatgccatgatgcccctatgctcactcacctgatgaagtgtgggaggctaccccccagcaaacagaaatgggcacacaatctgaagcctccttatcacactggagacttccagagcaacttcagtaaggtctgtgagggggaacgctctgttgtttgacatgggcttgtggctttcagctaggggcacgcacttctccaccagctctttttttatttttatttattttttattttttttttgagatggagtttcgctcttgttgcccagcatggagtgcaatggcgtggtctcgactcactgcaacctccgcctcccgggttccagcgattctcttgcctcagcctccccagtagctgggattacaggcacctgccaccaggcccagctaatttttgtacttttagtagagttggggtttcaccatgttggccagggtggtctcaaactcctcttaggtgatcctcccgcctcggcctcccaaagtgctgggattataggcatgagccaccgtgcctgggcagctctttccctaataagaacactggttctgaggccaagtaagaggctaaattaagaaagcaaagatttatcataagtttgaggcccacgaggaaaaaagcctccattcatcatccagaaacacaaggaaacatcatttgcccctcagtggacaggtgatgtttcttacataccctatgacatagctgccctggtccctcccaagcccaatgtttcattggccaagcttccaatttgctttacaaggtgtgaggacagagaagcatccagcccattctcctgtggccctgctccatttagagcagacacgagtggatagctcagctggtcactagctcctgggctgcccccactcacagaacaagagtgtgcgtttctcctgagaacttcctactaaagaaaacagccagcccaggcatggattacaggctcacacctgtaatcccagcactttgggaggccaaggcaggtggatcacttgaggtcaggagttcaagaccagcctggccaacgtgcatttttctctataaaaaatacaaaaagtaggtgtggtggcacacacctgtactcccagcatctcaggaggctgaggtgggaggatcacttgagcccaggaggcagaggttgcagtgagccaagatcgtgccactgcactccagcctgggtgacagagtgagaccttgtctcaaacaaaacagaaaaacagtccaactaggaagcttgcttctcccggaagccttgctgcatgggctgaccaggcacagtgctgggccattccactgggctgggccaggctggggaggtaccttgatttggggatggcagctggccttgtccttgactcaggggctgcttttctgtagaccaagtgcacttcacggatttctccagaactggtagagacaaaagtgagagagtgggagatgcatttgaagcatgttggctttattatttgcaaaactgaagtctggcccaaaagaaggttgatcttcttttaggaggtctggaacaggacgtggtctcttctgtggtggaatgtttttgttttggctgaatggttgcgtcttagtgatttgactgagagcaaaatcagcttccattttatccccgctaagtcacactttttccatagaaggggagttgtgggaagcatagctttaagggaaggcaaagcacaccttgctctgaaactctttggtcacaaccatgtaaaaacatgtctgaggaaaaatcctaggcagaaatacagcaaaagtccacttagccaaggaggccatgggtagttcttttcctcctttcttgtgttcttatttttccagatttttatttttattttatttttattttatttttttttgagacaaagtttcacgtttgttgcccaggctagagtgcagtggtgtgatctcggctcactgcaacctccacctcccgggttcaagcgattctcctacctcagcctcctaagtagctgggattacaggcatgcgccatcatgcctggctaattttttgtattcagtagagatgcggtttcaccaggttggccaggctagtcttgaactcctgacctcaagtgatccacccaccttggcctcccaaagtgctgggattataggcatgagctaccgcgcccggccccttttctagatttttttttttttttttttttgagacggaatcgcactgtgtcacccaggctggagtgcagtggcgcaatctcagctcactgcaagctccgcctcctgggttcacgccattctcctgcctcagcctcccgagtagctgggactacaggcgcctgccaccacgcccggctaattttttgtatttttagtagagacggggtttccctgtgttagccaggatgatcttgatctcctgacctcgtgatccgccacctcttgtccttctaacaagaagaactcatacccatactacgtaaagatagctatcgcatacacttttatcaccagcctccttcccacaacaatatttatatgtataaatcaagaagctattatttcaaactgatgctgaacaacaatcccaaagtgctgggattacaggcgtgagccaccatgcctggcccccttttccagatttttaatagtgagcatatattacttttatgactggaaaaagtattaacacattcctactctatgtaattgaaggaattagtcaagtattgtatcaccctaatagtactttcatgtacacactctatgttgcttatttttatggatttcatatactttgtctccacgcataggaaaattgagttggtgaggcttgcaaaactccccaacccacactgtttagttttagcagacttatcacatgagtgttttcatttaaagaacaataaccagccgggcgcggtggctcatgcctgtaatcccagcactttgggaggccgaggcgggcagatcacaaggtcaggagatcgagcccatcctggctaacatggtgaaaccccgtctctactaaaaatacaaaaaaattagccaggtgtggtggtgggtgcctgtagtcccagttacttgggaggctgagacaggagaatggcgtcaaccagggaggcagagcttgcagtgagccgagatcacgccactgcactgtagcctgggcaacagagcaagactccgtctcaccaaaaaaaaaaaaaaagaacaataacgatgactctttagggttcattaaacagtctaagaaatacaaatatttagctcccctcagccatcactgcctcaggcccattcatgatcatgaatccagatccatgagctctgtggcagcgtctttgaaggtggagcttctctggatcatttgagggactctattttccttgcaggtgtgggagccacttcaggagcttctgccaacttccctggcacctcgggcagcagcaccctgtctcccttccagcacgcccacaaaggtgaggagggtgctcaggtatcgatcacctggagttaggtggtactcggatgaaagctcagaagaggagaggaaatgatcatgagtgatgattatggtgcgcttccccacctggcctcacctccctaatgtaattgaatgacatgttgccccccgtgcaggaagtcattatatctgcaatcagagttgatccctctatgggtgtcctgggaccgctgggaggtgctggtggtgaaggcgggggcatagcggcaggtggacagcacaggcagctgcaagcccggccaggaggagagaccaggcgtcctgggctttggtttggccgggagttaacagcaattctatcactggttttcatataaacatgctgaccatagcactttaatattaacttgcagaatgtacatttcattctccctaaccagggaagaagggattgaggaggaccccaaagtttaatatgtctctcagagtcagccctccagctggcttggcctttctctctcactggtttagtgccagcccattattgaagcatgtttcgggcccaggtctcagcgagccgtgaggtaccctccagagccctcagagcacccagctcgtcagcttcatctctgggcctcccacgcgctaacgcagagcaaaaggcaggactgctgggcgaggatatatgaatctcatttgcacaggccccggggggagtagctcaaaacacggagaatattaaaacacttatgtcatccagacctggcatgctaacgctattacaggtattccccagatgatgctgggaggctggttttcctgcagatgcacccacaggggaggctcagcgcccacatgcagggttctcagctctggcactacctcccccgagatgatttgggagcttcagatgctggtctcctgtctatttgggtggtggcaaatctggatcttagttcaagacaatcagagtcctgtttggttattttagagaatgagaatgagcttcagggcattttatgcatccagggtcgacattaacctgggaactgagcaaaatcccccggggtgactgagggactgcctggtggaggcggcagtgcaggtggaataggtggcccagccgaggcaccccctgtgccctggggctcttacaatgacacttaggttgaaattgcatgaggtgcaagatggagccaaacctggaatccagagctgactttcgcatcctgacttttgtttggaaatgcccaaacttgaattgtgctgccttccagacactcttgttcactggcctttcttcctctccacaccaaaccctgccctcaggttgccaaagcagtagaagcaagagcaaactccctaggaacaatcaggtgaccccagagaagtctggagaggccagtctgagggcagcgagcagggctgtgggcagtcctggtctggcagccaaaaccagcgcggaggatttggttctcagtctaagcaagcacctcagatttcagggttccctgaaagcatcccaggggcagggccattgcttccaggggccggagtcctggagggaagaccagcagggatcctgagctctgggtcattcatgccttctctccacccacagaactctcaggccaaggacacctggccactgccctgatcattgcaatgtccaccatcttcatcatggccatcgccatcgtcctcatcatcatgttctacatcctgaagacaaagccctctgccccaggtgacggcccccatgcgccggtgccctgcttcctggactctccgtcaactccccctgtcggagagcctggctgctcactccctcctctctccccagcctgttgcaccagccacccggggaagagcgtggaggcccaagtgagcaaggacgaggagaagaaagaggccccaggtctgtgaaccagggcttccacacaccatgtgcacggtgcccatctctgggtggagggcgttcccagaagcagcctcctcgctgcttctgctctcacatgctgaaccatactgtgcttaccgtggggtggtgccacacagacaccgggcagctctgcccaacaggaagagcagggttgggctgagcgcagagccatgagccaattctaactcctatctccccaacctccccatttccctgcagacaacgtggtgatgttctctgagaaggatgaatttgagaagctgacagcaactccagcaaagcccaccaagaggtatgtggaagcccccagcaccaagctgaagctggggtcctgtggatcctgagcagggaggggaaccagggtgcagccgagtgaactgacaggctagcctgggacactatggggacgttcggcgacagacagtccccaccacctctttgctgactggcaggggtcaggtggtgtgaggagcctgtggaaacagctgcctgctgctctcgggtcaggcccctgtccctgcatcctgccaaattccctgggccttcctccttaacatccgaattcctcatgccccttctccagactgggagggcagaacataaagccaaggatgcatgcctgttgcggccaacacaccagtaccacccgtgccggtgccagtactgctgccaccgtaatgctggtaacaaccgtggtgatgacggctaacagcatttggtgcctactgcccaccaagtgctgggctagggctgtgaacacatcctccctccacagcccaggagcaaggtgcttgtatcatccctgtttataggataccacactgaggtatggaagttgtcactcgcccaaggtcacacactagtgaacagcagggctggggtccgagtccaggctcccaaggagccacatggtgtaaagaggcctctggaggaggagatttggcaggtgaagcctttcccgcgtttaccacacatgaaggtgtggaaccagcccctgctctaaaatcgagggtagagggaagtcaatattttattcatccagtgggatggtcatttggacttggtcctgcgtagcttccaaaaatcaaccccacagcatcagctcccagccaggcaatgtgctcggacccccctgccaggcctctgcccgacagccactgcaggctgcgcctggaaggacacccccgcaacagtgcctcccttggcagatggggcacagaggccaccagaaggtcaccaaactggttacaggaagagcagaggttaagccctcctctcctgcccccaccccatgatcttcctatgattccatgatcttcctatgattcaccttgcaaagccattccaatcgatccagcatctgtgtggagatcctgtgtgccagatccaagctgctgctcccaggaccaagggcaggacctggtcaccctgcatggaactcttaaatagggcctccctagagactgaatttgctcctcagcctccagcccagccttatctcattctgtctcagcctctcccttctgatattcaggcttttcttattcccagaaatcaaaaaggcagagacgtgccccatgacttgagttgcagttgaagacagggaaaatttggaggccctattaggaaaaaatatatactgctttcatacacgaatattaaatacaaattgaaccctgacacttgtacgttaaaagacagcaaggcactgagcttttgtccctgctgtttgtccttaggtctcagagacaggacctggggtgccacctcacctgctccacctcaccttctctcgagtggggacagggatgggtcctaccacctccttgtgaggccctgaagcctgatgaggaagtgggtcccactggggcttcatgatggttctcattgtctttgtattaccctgtctctagggttgtgtttgcatatgggcttcactgctgtaacctagttactaacaaatataatcctttttttaagaaaaaaaggtcttcagccaaaccacaggaagcaagcaggatgcctctaaaaaagaatattgtttttcatatacttggaatggttttaagagagtttaagctccaacccacatgtgcctagggcagaccctgggttctttgtgggctgtgagccacagggcggcatgaacctgggcttggtgggtccgaccgcccacccagctcacccgctggggcttgctgtgccaccccctgcaatgcacacaggtcagccaggtcacccccctagtcaagagggggctttccaggcacaaggctccattcagctcccttttcaatgactccagagagccagcatggattcagcgccagccgcatcaatctgtttgcttaacatgaagacaccagttgaacttggtgcttactgggattaaatacagagatctaggacatattcaatgaaccttcacggagcatccattgtgtgtcaggtagcagggaaggagaggcccgtggatgcctcccacacgcagtggcagccccagccccttagacgcctgcaggtcacccaccacggacttgtttgtttggaaagaagcaggaagccaccggtgtatgtctcgtctcatgtcccctggtcccgtgcccacaaggtgcccagtaaacacctgaaaaacaagtcattgccccccactgtccacagctgggcaatggacaagttcaccacaggagaacttgtcagggctgcagcccccccaggcactgctaatgaccatcgctcttgtttttgcagcgagaacgatgcctcatccgagaatgagcagctgctgagccggagcgtcgacagtgatgaggagcccgcccctgacaagcagggctccccggagctgtgcctgctgtcgctggttcacctggccagggagaagtctgccaccagcaacaagtcagccggggtgaggctcctgcaggtgccatgatgagctgtgagatgtggctccctcacagccgcaagactaaaactttcttattgaatcagctctcctgcaagacggggtgtttctcccagaagtccaagataggagacctggacagtgacaagttcacagcaagatagtcaaaagggaaaaaaaccctttcgtttttgagttttgtttttttttttggagatgagagtcttgctctgtcacccagcctggagtgcagtggtgcgatctcggctcactacaacctccgcctcctgggttcaagcaattctcctgtctcagcctcccaagtagctaggactacaggtgcacgctgccacacccagctaattttttttatattttagtagagacgaggtttcactgtgttgcccaggctgctctcaaactcctgagttcaggcaatccacccgcctcggccttccaaagcactaggattacaggtgtgagctaccacgcccagccactttgtttttattatatagcttcatacacaaaaacgaaaaataataagcaaggagaaaaaaggtaaaatcacttggaatgccagagggcagaaaaagacccttgtaaatatacggggttttatctaaccagacaattttctagacacacacacacacaacgtttttcttctatgcatttttaaaaatataaaaacaggttcacatgtagaaactgtccccagggttttatcacctaccgccctgtaatgtgctgtggccaggagcagggcaggggtgagggcaaaggtggccagagccctcttgggctccctgtagacctggcctgtggtcgtccctctagcctgtgcccctggctgcaggccccagccgcaggacagctgtgttgctaggcaacatcactgatggcaaaaatgcccagttgggatcctggctccagcctggtcctgataggatgccaagctctgcctgccccgagttcagtgacctctgtaatggggctgccacttgcagagaccctggaagcctgtggggttgttacaagggagataggtggccatggccccgggactcttcagccagggccactgagcagctgtgcaccgtgggcctggtctcctggcaccagccacgtgatccgggatgggagccccgcacggctctgctgcagcacagatgtcctgagggcaagtgggggtccccatggtcatcttttcaaacagactgatgccaggggtgtccccaagtatcttacgagtctgaccacccagctgagcctaagacgcacccgtggtagaccccaaaaatgtttgaataggaaaacctgaagaaggccctcctccctgtgtgtcagggctgggctgctgacacgggggctgtgtgcagcgtctctggtgttgggcgtagctgctgcctgcccctgctgacatggaggatttgcctcctttctactgttgcccctttctggagatgaaaattctcgactctttttcacagattcaaagccggaggaaaaagatcctcgatgtgtatgccaacgtgtgtggagtcgtggaaggtaagctgaaaaaaaagcctgggagaggtggtgcccaccccactgacatgaagggctgggcccggagccctgaggctcctgtgaggggaactgagggaagccgcccatccagttgccgcactttggtcagaatggccgctggaaactatttcaggtgtggggaaacagaatcttgttcccagatatcggaaggcatctcccagtgcttccatgggccttcccctcatggggcgggagacagcctggtgcaggcacccactgtagggaaacgcagggtcggtgagcagcagccacggagcctcagacctcccgtgtccccagagaccgtgtccacactggcatcatcatctgggaaacgtgatcagtcatttatcctagacttagctgccctctccctgccctcgagcatccccgatgtctgatagccctgggagcctccagcctcccctcccagcggccttctgagctaagtcaggctgtctccccataacctgggcttgagtgtgggcaggttaagaggcaacaggataggaccgtcagtgctgcaatctgaaatcataatcttcagcttccagttcctgcaaaatccactttctaaattaccttcttattaaccccaaagataaatccctcatggctgaggtcaggggttttcctgctgctggactcgctggcctccctccgtggactccttgatctggccgggcagcgggagtggagcctggtgcatgctgggcagctcaccaatgcccccattacccctcctcccacccccacaccccaccgtaggccaaatgcagccccctgtgccctggcaggctttctgatccagtgctttgttggccagaaataactatactgtgggtgagttccagggccaagaattcttggctgccgctgaaatgtggcatctctccataaacgcatgccccaggtcagcctgcctgatctcacctggcatggcctggggctgtcagctgcccaggggaggatggtctaggactcaccttccatccaccaggaagctcttctctgttccaaaaaatgttgagttcacacccctgggacagaggttttcaaacctcagccagggctgagaacctgtgctccatgcccagctctgatgaacattagagtcacctgcaggtcttaacaccctctctgcccatccagcccacccaatctgcccaaacaccctgatgtaattagtcaggggtgaatcccaggcatctgtgtctctttgttttttgttttgttttgtctttaattaaactttttattttgagatacttcttaccatgcagtggtaagagataatacagagagatcctacatgccctttacccagtttctcctaacgataacatcttgcaaaactatacacagaagtcacaaccaggacactgatattgacacagtgatatcgactcagctcccatacaaaaactcctcctgttgccttttatagccacagccaatttccacccaccccaccctcacctaggcccctggaaaccagtaatctgttctccattcctataattttgtcatttcaagagtgttataaaagtggaatcacaaggtatgtaaccgtggtgaatggcttttttcactcagcataattcactggaggtccatccaggttgttgcatgtatcaatagtccattcctctctcttgctgagtagtagtctgtggcataaatggaccagagttggtttaaccattcacttgttgaaggacatcagggttatttccacttaacggctattatgaataaaggtgctataaatatttgtgtataggtttttgtgtggacatcagtcgtgatttatctgggataaagacccaggagtacatttgttgggttgtatgatagttgcatggttgattattttaaaaaactgccaaaccgttttctaaagttattgtaccattttacattcctactagcagtgtgggaacggtctagtttctccatatgcttgccagcatttggtggtgttactatgttttgttttagctattctgagaagtgtgttatgatatcttattgtggtctcaatttgcatgttcctattgtttaaatatgttttcttgtgtttttttcatctgtgtgtcctcttcagtaaaatgaatgtttcttcatgtcttttgcccatttttcaatggtatcgtatgatttttttgctgttgagttttgagggtttttaaaaatatattctagacactagtcctatgatggatatgtggttttataaatgttttctccattctatagtttagcttatcttttcagtctcttaacagggtctttcatagaatgatgttttaaatttttatgagtcaaatttatgaaactaattataaagttttctttttatggatgatgcttttgtgtcaaatctaagatctctcttgcctagtcctagatcccagagatttgctcccacaattttttctagaagttttatagcttaatgttttacattctaagtccacatagtttttatgttttacatttaagttcacatagttttatattttgcatttaagtttgagttgatttttatagaagatatgaaacttgggtcaaagttcatttttttgtctatggatgtccaattgctccagcaccatttttttgaaaaattatctttcctccattgaattgcttttcaaactttgtcaaaaatcagtttggcatatttgtataggtctattttctggggttgctgttctgttgcatttatctacatgtctgtccctctgataataccacaaggtcttgattcttgtataaattatgtaataacatataagtcctgaaatcaaatggactgctcccattttcctttatttttttttcaaaaatgttttagctattctagttcctttgcctttccatataagttttataataatcttccctatatgtacaaaatgccttgctgggattttaatgagttgcaacaaaactgtatatcaatctgggaagatttgacatctttattatgtcgagtcttctgagccatgggcatggtatatctcttcatttatttagcacaactttaattttttttcatctgcattgtgtagcttccgaaatacaagttctgtgcatattttgttagatttacaccatatcatttattttttgagccactgtaaacgacaatttaaattcagtagccatacattcattgttagttatatagaaatacaattgatttttgtatgtttatcctgtatcctgtgaccttgctgaattcacttataagatctgggagttttcttgtagatgccttgggattttctacatagataatcacatctgcaaatgggaccgttttatttcttcctttccaatctgtgtaccgtttctttccttttctcattttattgcactggctataccttccagcactacagtgaatataaatgatgaagcagaagcagaaatccttgccttatttctgatcttaaaagcattccatttttcaccattaagtataatattagctctaggctttttataaattgttgacattaattttttgagtggattacaataatttttaaatattgaaccagccttgcctccctggaataagccatacctgatgtggtacaattcttttttatggttgcattctatttgctaatattttgttaaggattttgcatttatattcatgagagatcttggtctttggtttgtggtttgttttttgtctttgtctggttttggtatccagtttatactaccctcatagaataagttaggaagtgtttcttccttttctatgtctagaaaagatcgtgtagaattgctattctttcttaaacattttgtagaattcttcagtgaaatcgtgaggacctagagatttcttttggggaggtttttttgttttgttttgttttgtttttgagatggagtctcgctatgtcacccaggctggagtgcagtggcacaatcctcgctcactgcaacctctgcctctccagttcaagtgattctcttgcctcagcctcccaagtagctgggattataggcacatgccaccatggcccagctaattttttttttttttttttgagacggagtctcactctgtcccaggctggcaacctccacctcccaggtttaagcgattctcctttctcagcctcctgggtagctgggattacatgtgcatgccaccatgcccagctaatttttgtatttttagtagatatggggtttcaccatgttggccaggctggtcttgaactcctgaccttgtgatccacctgctttggcctcccaaagtgctgggattacaggcttgagccaccatgcccagccctaatttttgtattttagtagaaatgaggtttcaccatcttggccagactggtcttgaactcctgacctcaagcaatatacccacctcggcctcccaaagtgctgggattacaggcgtgagccaccgcgtttggctagatatttttacagttacaaattcagcttccttaatagttataagtctgttcaaatgatctattttatattgggtaagttgtgatagtttatgttttttgaggaattgtttattttcatctaagttatcaaatttatatgtgtagagttaaagttgcaagttttatcttattatctgtttgatatctatggtgtgtatagtgatatctcctgcttcattcttgatattggtaatttgtgtcttctctattttttccttgtcagttatattgatcttttcaaataactgtctcttttcatattgatctcttttactttatagttttcaatttcattgattactgctcttatttctaaattacttatttccttctatgtacatttggtttattttgttaatctttttctaagtgcttgaaatgggagcttagattgttaacttgagttttcctcctttgtatgtatctgtcctataaatttcactctcagtactactttagctgtgtctcacaaatattgacatcttgtatttttattttcattcatttttaaattgtctttgagacttcctctttgacctgtggattatttagaagactgttgtctggttttcaagtgtgtgaagatttttctgttatatatttatattctgattctattgtggtaggggaatatcctttgtataatttcaattcttttaatttgttgaggtttaaggccaataattatgaacaatgtgtattctgctgttgttgaatggagtgttctataaatgttgattagatcgtgttggttgatgatgttggtaagttctatattcttgattttttttctaattgttctatcatttactgagggaggaatgttaaagtcttcaactataattgtggacttatctcttctttcaggtctatcagtttttgtttcacatattttggagctctgttgtttggtgcatattcatttaggattgctatgtcttcttggattgaccctttaatcattattaaatgtcactttctggtaattttttcctctgaagtctactttaactgatgttatagccactctgccttcttgttattgaagtttgcatgatatgtatttttccatcctttacttccaacgcctctctcattatattgaagtgagtttcttctaggcagcatataactgggaaaatttttaagtctactctaccaagctctaccttttagtttttttgttttggtttggtttgggttttttgttgttttttttttttctttttttttggagtttccactcctgttgcccaggctggagtgcaatggcatgatcttggctcactgcaacctctgcctcccaggttcaagtggttctcctgcctcagcctcccaagtagttgggatcacaggcatgtgccaccacaccagctaattttgtatatttagtagaaacagggtttcaccgtgttgaccaggctggtctagaactcctgacctcagctaatccatctgccttggcctcccaaagtgctgggattacaggcatgagccaccaggcccagcctttagttggtatttaaaccatttacattaaatgtagtcattgttagggcttaagtctgctattttatattttgtttactgtttgttgtctctgtttttcatttctgtgtttttttattcctgctttactgtgggtcacttgaacatatttcagaattcgattttggtgttttttgagtgatacattttgattttatctctttccatagttattttagtagtttctctagacattgcattgacacatataacttatcagtctactggtgttattattattattatttttgacatggagttttactctgccacccaggttggagagcagtggcacgatctcggctcactgcaacctccgcctcccaggttcaagcgattctcctgcctcagcctcccgagtagctgggattacaggtgtgcactaccacgccaatgtgttttttgtgtttttagtagagacggggtttcaccatgttggccaggctagtcttgaactcctgacctcaggtgatctgcccaccttggcctcccgaagtgcttggattataggtgtgagccaccgtgcccagccttactggtgttattattttgccagtttgaatgaagtataaaaaccttacctttctctatgtccctttaccttctctgtttacagtagttgtaaatatttcctctacatatatttagaaccacataaattgcttcaactgcctaatgtaattcagaaaacttaaaaagagaaggaaagtctattgtatgtgcccatatttttgctcactatgttcttttctgatgtctcaagtttcattcttttactatttcctttctgtttatagaatttccttttgcttcttttaggataggtctgctggtgaaaaattcttaacttttctttggcttggaatgtcttgatattctcatgctttcctgaaggatattttcactcagctcactgcaacctggtatgcaactctgggttgaaagttcttttctttcagtacttggaaatactgtgctacttctctctggtctccaggtttctgattataagtctactgtcattctaattcttttccctctctaggtcaggcgttgtttttctttggctgtttctaagactttgtctttagttttcagaagttcatttatgatgtatcttgacatgaatatatttgggtttatcctgtttgggatttgcttatcttcttgaatctgtagacttacgtctctttacaaatttggagagttctaaaccatcatttatttgagtatttatttagtcccactctcttctcctctccttctgaaacttcttgacacaaatgttagctcttctgttataactccacagttccctaaggctctgtgtttttcagtttattttctctgattgagtaatttccacttctagtttccattatccatctcactgattctttcctctgtcttactctgtcattgagcacatctactgagctttttattgtggttattgtacttttgtagttctaatattttcatttcttttttacattttctattatttttcctgaggatttctatttttgcatttaagcatgttcataattgcttgttgaagcacttttattatgaattctttaaaacctttttcagattatctaacatctgtcatctcagtgttagcatctattgattttctttttttactcatttgacatcttcttggttcttggtatgatgagtgaattcactttgagacctgtgtagttttatgtcctgatatgaaactctgggtcttatttaagccttctattttagctggctccttttgatagctctgtggcaggagaatgagggtgctgtcttgctactgttgggtgaaggtagacatccaaattccccactcaaccttcactaacactcaagggggattcctttttactgctacttggggtttgggagtatggctactgacatggtcaccacgggggcagaggagtttttaccagctggttgatgagaaagccccagctccctacatggcctttcctgacaccacctggcacagtgttacagcctggtgagggtggaattctaggctccccactcagcctttgctaccctggatagagtggggacacagtttttctgtgatgtttggctggaatagagcaattattgtctaaatgttttatgcttgctaggctgctcttttcctagtgctctgactagagacagaagacttttgttggggctgtttttgtctgtggttgctattatttccagatttttggacttttctgccccatgtctggaatttatgaggcaaaagaaaacccagggaacttaccaccatcaccatcctaaggtatcgaggtccctagttggtctgtcttcttttctccacttttcagacttcttgtatttgttttacacagaatgtccagggcttttagctgtacttagtgggaggattagggaaaattatatctactcttatcttccagaaacagcaatatcaagtttttaaatgctcctaggtgagtctaatgtacaatgaagcccaagaaccatcagaccactgagttggcagtgacttggttcagataaccccaatctggggctatcattgagagcagccatcacaaagttgactactgttccctaaagagacatgacactgtccctttgaccccctcctcagcccagccccatgggagacagggttacccaactaaggataacttgtcttgaagtctttgagaactgctaaaaatggtcatgagggaattattatcattgtcaatatagcagtcattttcctagtggggaaggggctattaccggggtcagggtacatgcacagccctctcttgtggctggcagcgttctaggtgtcgtttgccttaagttatgcatttgttttaggtggctttctgcatgttttataattttaaaaaaatttttttcaaataatttttatttcatttaaataatttttcagtgttgaccttctattgactgtgacttgcaacatctaactgtggccattggtgtctgtaggtcttagccccacggagctgccatttgattgcctcgagaagactagccgaatgctcagctccacgtacaactctgagaaggctgttgtgaaaacgtggcgccacctcgccgagagcttcggcctgaagagggatgagattgggggcatgacagacggcatgcaactctttgaccgcatcagcacggcaggctacagcatccctgagctactcacaaaactggtgcagattgagcggctggatgctgtggagtccttgtgtgcagacatactggagtgggcgggggttgtgccacctgcctcccagccacatgctgcatcctgaaaagcatgcctgtgggctgtcctcccaggacaagccaaggatccaacgagggctctggagctgtgagtggtgccaaaagactgccaagaatcaaggcttttgtgatatgtcaccgtatgccttaggatgttcaaggagccagacgaaataaggcctgtcttccaatttaaccaaagataaaggactagagccgggatactttcagatgctcgcctgtacctcaccaggcagagtaaatatctactcactcatacagccagcccaccagcccaccattaactcactgaacaatgagacaatgttgaggactcaaatgaatcaaaccccgtgggaatgacagaagtgaagaatctggtccctgtctttaaggagtttgcactccagtagaagacagaaggaacgtatgtttacaaaccacttcactggaagacgtcaaacaagctgaatgaaggggcgcttagaaaacgttaatagaagttctaagcgggagatgactccctactgggatgatgaaggatggcatcctagtgaagaagcagctcaaacattttgataaaatggcaacaaaatgcagacaccctgctccaggtattatttcaggtttagtacaagtctgttaataccctatgtggtttcattaggataactttttacctatccttgaggtcatccatattcttacaggccttccagtcaataatggaagagctcactctatacaaaaccaatatgcaaggcatgtgtttgtccaagcaattggatgtgtgcagtagccaatttcatttactgcattactctttggcctgggaaccctgtggtctgcactacatgtgaatggccttccacttcagtcttaggcagatttgaccttttaggggcagcaatgctgaaggacacagcaatttaaattataatgtgtcaggctgtgttttcacttcaaacatgtatgagtagtcagctgtaattagagaaatgatgacttcctaagagttcagccacgcataattctagatttcaagagcatctaagacttgtggattagcctcatggcatgagagtttcagactcagccttctgagccagtcagggaaagtggagttctgcagcgcaaatgagagcctgggcttggtgtcgagggagctggcttctagttgtgccaccttgggccttgtcttttcctctctctgcctcagtttctcgtctgccaatgagatgttagttagtgattctataattggggcaggtagggttcaggtgagcaaaaagaaagtggagctataggaaatgccaggcctttgaggtgctctatggaagtcaacacagtgtggtttgtccatttaaatgggaataaaaacagaaaaactcagacttggcattttcacaataactgcaatggtttgacataacatttataggcagaaagttaataaactggcattgttcttggcatattattgtactatccctgtaactgccaagagctcaggagccaggctagtgatcacaccaggggttagagttcactgctgaactccctgatggcaggtctgtgtttattactacattaaaacaaagtctctgacttataaagcgaggtcgtaaaaattacaagttgcatgactgaaaaaatgctttagggggaaaatcagtcatatctttaacaccaacaagcaatttcccaccaacgaatgtagtacatactgtgagaggatcataatgaggtcctgaatatttaatatcatcatttactgtgtctgtttgctgctgtttttcgaacctatttggtttaccctgcaagctaaatactccacggcagagcttaattatccttttaattcctctttgaaatcctgtggtgcccccttccccctgccttgtgatgatgatgagtgagtctccccttaattagactgcaaatgtcacttgtgatgagtgtgccattccaggataacagcttgcaccctcctcagaatgttttcagcgaaagagtggggtggctgttctctgctcctggtgctttggcctcatttcacactattagaattctggggctgtaaggccagccagtgtcagctcatgttccattggctctccacctgccatttttagggagctattccttatatagttacaaattcccttgtcatttacttatttggaaacatgggatttactctgacaagctttagcctatgttatgggattcagaacaatgagatcataataattctcactgaccaaagctgggactccatcctgccatttttgtgtggagatattcataattctgcaatactttaaaacatttagaaaacaccccagggtaggtctgtggcccttagacagtgaagtcttaattgtcaatattatttttgtctaattctgtatatatataacttattatattttataatctcaataaacatattaataagatttatagactaccgtaatgtgagctctctttgtatttggggtggtgggtcggggggtgagtggggaaggttctgattgctctgttcctggttattgccctatgtatgatgagactgtaggattgcaaccagctataaacaaagtgcctaaaatgttatggcctgggacattcactaggcagaagcaaacattacaaagagatcatgtaaaaaccacctggagcattgctttccaagttgccatcattagctcataaggcattgtatcacttatctatttctgtgtaacaaactgtcttgtcttaaaattcaatggcttaaagcaacagtcatttattatcatagctcgggggttagtagggggtcagtcagctgacttaggttgggctcagttgaatgtgggtcaactggggcctctgtctgttggaataccttaactggggcagctctactccatcatctctgtcaacctagatagataacagagagaggctctctaaaagaaagaaaatgatatgtattggggaatagggcattgcaatgggaatacatgtgccatagtaaactatgcgtgtttttgaagaggtaaaggaagacaatggttcttagaggaaaataaggaggattacataattattttgagacaattatccttggctacaaggataataagggtggtgccagtccagggttggacagggagttgctgggcagaggtccttgcaggagtctttgtgtgtgtttaagattgtcatggcctttgtgcaaggttttcattttttcagtcttgtgatggctcttgttatcagtgatttatgcagggagaacccttctttcctggccttccatgactctatttgtcagttttgtttttttttttaagcacaagtgactcctttataattctgacaacttccacatttcccccatttgatcaagatctttatcagaaagcatccccagtgagtcatcccatattattccttcgtgccaggatagacctgtcctaggtggctggtctggtctcacattggagggatttgatggtgactaggagtcagtgtcaaaaccctttagccatgtttgaacaaatgggaagtttggagagagtggctctcaggctaggtctacttgaagtctactgttaaatttgattttgtctgttctgtaaacatttgctatcatcatctcaaaatgcagggccagtattattctgttagaaggtgtacttctactgagatttgacaagtaacaggaagtttaaaaaaggaaaatataaaggaaaattaaaatcaatagtaatatgagaatcccagtttgcatgatgattttgagccatgaatgtaggtttaaaggcaaccaaatgaataaatgaaataaccatgaggaattaggtgacccttcttttatccttgtggcctctttctttattttgtgaacatgggtctcaactttcccagaggaatttacctaggtacagcaatgtagtattagaaatagcacagacaaagatggctactagaagcatttcatgccagcctcttccacttagaacaaaaacagtgtgtagacagtcacactttgaatacattatccaagagagaacactggaattcaacagagaagtggcaggaaacaccaaaagcagggaaggagaagggagacaagcagcctgcctagccaggatcaactaggagctgggagtgacttcccaattcagggaaagggtgaataagagacttccagtggcccagatccccagcatgaactcatgtaatcctggccatgagagacccctcaaccctcccaaccactgaagctaacatagggagctgctgggagaccatgggatggaactgctccagagatggagtttgcactggatcccacacctttctgagacctaagcaactacagcaagacaccattttcaaacctagccttgggtagattgcatgctgtcctggggcccagaggcactgggactgaggtgttacagaaacccagattgttgctgctgggaatggggagtgagctgcaagcacttccacagccagggctaagaaacaaacaaggaaagggttgcagttgctgatgccaggaagtgagtgctgctgggacagaaattaggatgctgaaagggtgtaagttgccactgggacttgctcaccagctgaaatggggcctcctgcagccagggtgggagggtgagacaggcatgggctaacattgtcaaggctggaaagcaagccccactgggactgtgggaaggacatacattctcacctaccagcccaggctgtggccacagagcacagccacactctgtccagtggtagcactttagcacagctgccatcatcccttacctgagcactctgcctggggcctgaggatcaccttatcctggccaccaatggtggtgcctgctctcaccaaggggcctgagcacaaacctgcacagcccagctttgccccctctttcagacagggcacatattctggggtcctgggaactgtgcaattcaatccaccaccttgggtacctgagcatctttctggggcctatggttgggcctaaactcccagccaccatcacatcacctggtacctccttgcaagtgtcacctgaaggccaagaggttgtcttacccagtccatcacagcaaccaccaacatcaatgcacaccacttgggacccagagaatcgtcctgctactgctactgccattgctcatgctatgccagctgcccaaaggcccaaaaacccacctacacacccaatccattgctgccactaccagcaactgaacaagccacctggaggcccagaaatcagcctgccaaataactgccaacagagatgccagctatacagccctgggcacaaacaggcacacttagcccattgctgtcatcactagggcctgaagactggcccatttggcatcccaatccctagtacaacttcaccacagcctccactaataacttcaccctaacccagtggggaaatcatggatgccaccaacactacttacagcctaaaaaatcatacagagactacattactacgtgcatccagaatcaaagccaaagtaccctactcaaccaaaaccatagatatatctttaggaaaaagtcttcttctatgaaagaaatttcaaaaacaagaagaagcaacagttacaccagatgtgcagagatccacttaaggacaaatgaaacatgaaaaattaaggaaatgtgacgcctctaaaggaacatcagaattctcaagcaatagatcttaatcaaaaataaatttctgaaatcccagataaaaaatttgaaatattgattttaaaggagctcagtgatatacaagagaactctgaaaaacaatacaaagaaatcagaaaaacaatatgggatatgaatgaaaaatttatcaaagagatagattttttttaaagaaccaaacagaaattccagaactgaagaattcattgaaggaaatatataatacatttgaaagcttcaaaaatagattgcataagggagaataaagaatctcagaacttgaagatagcatttttgaaataatccagtcagacaaaaagaaaaagaataaaacagaatgagtaaagccttcatgacacttgggaaaacacaaagtgatcaaatattcgagttattagtatccctgagagtaaagagacagagaaaaggttagaaaatttaattaataaaataatagatgaaaacttcctaagtctagagatttagacattcaaatacaggagactcagtgatctccaggaagatacattctgcaagcgttttcgccatgacacattatagtccagctgtctgaagtcaaagataaagggtgaatcctaaaaagagcaagagaaaagcatacagttacctatcaagaaaacccctgaccaggtgcagtggctcatgcctgtaatcccagcactttgggaggctgagatgggtagatcactcgtactcaggagtacaagaccagcctgggcaacatggcaaaaccgcttctctaccaaaaacacaaaacattagccaggcatggggcttgtgcctgtggtcccagctactaaggaggctgaggttggaggattgcttaagcctgggaggcagaggctgcagtaagcccatatcatgccactgcactgcactctggactaggtgacagagtgagaccccattacaaaaaaaaaaaaaaagaaaaccccatcagcctaagagtgagtttctcagcagaaactttataggccagaagagaatggtatgatatactcaaagtgctgagaagaaaaaaaaaaaaatgtcagccaagaatactatatccagcaaaattatccttcataaatgaaagagaactagtctttcctagacaagcaaatgctgagggaattcattaccactagacgactcccacaataaatgctcaagggaattttaagcctggaagcaaaataacatttaccatcatggaaacaaatgaaagtataaaactcactggtaaagcaatcacataaaataggaagagaaatggtaccactatagaaacccaccaaccacaacaacaatcaataagagaaaaagaaaggaacaaagaatatatgaaacaaccagaaaagacaacaaaacctcacatatcaataactgtgaacacaaacagatttaattctccacttaaaagatatagaatagctgaatggattaagaaacatgatctaactatacgcctcttacaagaaactcaccttaccagtaaagacacatctgaaagtaaagtgatgtacatatttcatacaaatgaaaaccaaaattaagcaggtgtagctgtactgatgagataaaatagactttaagtcaaaaacagtgaaaaaaaaaaaagaaaagaaaaaaaggttattatataatgataaagggatcaatccagcaagaggatataattattctaaatatatatgtctagaatattggagcactcatattaataaagcaaatattattagatctaaggagagatagatgcaatacaataacagtcagagacttcatctctcccactcagcattagatagatcacctcgacagaaaatcaaaaagcattggatttaaactaaactttagagcaattggtcctaacagatctttacagaacattctatctgactacagaatatacattctttcatcagcacatggaacattctccaggatagaccatatgttaggccacaaaacaagtctcaacaaaacttaacaaaccacaatcatatcaagtattttctcagaccacaatggataaaactagaaatcaataccatgaggaactttggaaactatacaaaaacatggaaattaaacagcatgcttctgaataaccactggataaaaaagaaattaatatgaaaatttaaaaaaactgaaagaaataaaaatgaagaaacaataaagcaaaactgatggggtacaacaaaagcagtgcaaagggggaagtttacagcaataaacgcctacatcaaaaaaagtagaaagagtacaaagtaacaatcaaacaatatacctcaaagaaatagaaaagcaagaacaaaccaagcccaaaaatagacaaaaagaaataataaagatcagagcaggactaaataaagtagggacttaaaaaaatacaaagactcaacaacatgaaaaattgattctcccaaaagataaaaaaaattgatacacggttagctaaattaatcaaggaaagaagacccaaataaaatcagaaatgaaaaagaagatattacaagcgataccacagaattacaaaaatatcatcagagactactatggacaactatttgctcacaaattagaaaacacagagaaaatggataaattcccagaaacataaaacctaccaagattgaatcagtaataaaaaaattacccaacaaaaaaagcccaggactaaatggattcaaactgaatcctaccaaacatacaaagaaataacaccaaccctcctgaaactattccaaaaaattgaagagaagagaattctccttaacttattctatgaagccagcattaccctaataccaaaaccagacaaagacataacaagaaaagaaaactacaggccaatatccctggtgaatgaacatatatgcaaaagtcctccacaaaatacaagcaaaccaaatccaacagcacattaaaaacataatacaccattatcaaatgggatttatgccagggatgcaaggatagttcaacatatacaaatcaataaatgtgacatatcacatcaacaaaatgaaggaaaaaaaccatatgatcatctcaacagatgcagaaaaagcattttaaaaaattcaacatcactccaggataaaaactctcaacaaactaggcatagaagaaacttacctcaaaataagaaaggctatgacaagcccacagctaacatcatactgaatgaagaaaagctaaaagcctttcctctaagaactgaaataagacaaggatgccccagtttaccactgctattcaatgtagtactggaaatcctagctagagcactcaggcaagagaaagaaataaaaagcatccagaatggaaaagaggaaattaaattggccctccttgctgatgctatggccttgtatctaccttaatactccaccaaaatctcttttatctaataaataaattgagtaaagttgcaggatacaaaaccaacatataaaaatcagtagcatttctatacccatagtgatctagctgagaaagaaatcaagaaggcaattccatttacaatagctacaaaaataaaataaaatacctaggaataaatttaaccaaggaagtggaaaatctctataaggaaaactataaaacactgatgaaagaaattgaagaggacacaaataaaatggaaaaaggtcccatgctcatggataagagaaattagtatcattaaaataaccacgttgcccaaagcaatctacagattcaatgcaatccccatcaaaataccaacatcacttttcacagaatcaaaaaagcaatcctaaaattcatatggaaacagaaaaagagctcaaagtcatcctgaacgaaaagacaaaagctgtaggcatcacaatgactcacttcaaaacatattacaaggatatagtaaccaaaacagcatggtactgttataaaaacggacacgtagaccaatggaacaaaataaagaaaccagaaataagacacatatttatggccaagtgatctttgacaaagccaaaaagaactaaacactgtggaaagttcaccctcttcaataaatggtactgagaaaattggttaaccagatgcagaggaatgaaaatggacccctatctctcatcatatacaaaaataaactaaaaatagattagagatttacacataggacatgaaactataaaaaacagcataagaaagcctagggaaaactctcagggaaagaatttatgactgagacctcaaaagcacaggcaacaaaacaaaaatagacaaataggattataataaactaaaaatacttgacacagaaaaggaaatgatcaacagagtgaagagacaacctaatgaatagtagaaaatatctgcaaactattcatccaacaggggactaattttctgaatacacaaggaactcaaacagctccacagttgaattttttttttaaaatcccattaaaaagtgggcaaagggggccgggcatggtggctcacacctgtaatcccagcactttgggaggccgaggcagatggaccatgaggtcaggagatggagaccatcctggctaatgcagtgaaagccgtctctattaaaaatacaaaaattagccgggcatggtggcgggcgcctgtagtcccagctactcgggaggctgaggcaggagaacggcgtgaacccaagaggcggagcgtgcagtgagctgagattgcaccactgcactccagcctgggtgacagagagagactccgtctcaaaaaaaataaataaagtgggcaaaggacatgaatagacattgttcaaaagaagacatacaggtaaccaacagatacatgaaaaaatgcccaacatcagaatgaaaatcaaaatcacaattagatatcatcttaccccagtcagaagagctattattaaagacaaaaataacagatgttggcaaggatgtagataaaaagaattcttacccactgttggtgagaatttaaacagccactatggaaaagtaagatttctcaaaaaactaaaattagaattaccactggatcctgcaatccctctactgggtatctacccaaaggaaaagaaatcaatatgatatactgatatatatcacccccatgtttattgcagcactattcacaatagcaaagatatggaatcaaactaagtgcccatcagcggacgaatggataaaggaaatgtggtacatatacacaatgaaacactattcagccacaaaaagaatgaagtcatgtcatttgcagcaacatggataaaaccagaggtcattattttaagtgaaaacagccaagcaaaaaagacaaatgtcacatgtttccacttatatgtggaagctaaaaaatttgatcacatagtggtagagagggaaagacagataccagagactgggaatcatgagtggtgggaggaagaggataaggagaactgggttaaagtgtacaaacatacagtaagttagaaggaaaaaattcaatgttcaacagctgactggggtgactatacttaacaaagatgtattgtactcgggtggacaccccaaatacccgtgtggtgacttgatcaccacacattatacacatgtaacaaaatttctcatgtatcccatagatttgtacaaataaaaaataaaaagtctggtctcattaattctttacatttagaaaggaattaatttttacagatacagtacttacttttcaattttattgtataacttttcattaaagtgagaaagccattatattcataagacaaacacagtatcaaagaagttaaagtcattaggtaatgaaataacaatcatctcaaatttggatgcacatgctcaataactttttctctcagcctaaatgccttattgacagggaaaagttatatgagaggaaaacaaagtggcaagaaaactgcactggcccctcaggacaaaaactcatcagggaaagattcaaatgttttaaagttctgcaaaagcaatatgaaaaaccaaagtccagcattgggggcgggtaaaggtgggtttgtgaataggaagaaaggctggaagtttcagctcccttacagagtacctggaaaaaagacactgattagtaattacatgagctaaattctcctttagcatctctcagtattaattctctgcaaatatttgtattacaatattccaattagctccttgggaagaaattttgatgtaactattctcattctacagacagggaaattccagaagccactgctgatggggagtggggaggggctgaaaagcctggccacagagcagaggtgtttcaacgagggtgtgtggcttggcagacccgccttcaattcctgagcctgcacccaggagtgacaagcctggactcacagctgcccggctttcgaaagaaaaagaggtcaagtggcctttcccagctggaagatgcctgttgcagctgcttgagagtcctatccgggaggacacaatctcgaaaaggggacctgccaggagagctgtggcatgtgtcatttgctccttggccaaaaccatcatccttgactttctgatgtttattatgtggagctttgtcacaggttcctacatgaaatacgctgtcactaccacaaagaaacaagcaaaaacaaaacaaagatctcttctcttattctcttcagcggtgctctttcttctattttgattgcatcaagcttttcagaatgggaacata

SEQ ID NO: 863 - DNA, 4218 bp, Homo sapiens
aggggcagacggccggagagccaggtgtgccagggacctatggcagcagggctgaacgtgcccgctccagcctctccagtgctgggagagacctctagatggtgcaggtgagtttgcaatgagggaaagcccctcggcaaggactgagtttccaaacttgcagacagggcagggagcggtcaaggaagagttcccgggaagccctttaaacggaaaggaagcggggctagtgtcagagaggtgtgccaggtcccaggcagccctgctggcccctaaggacatagagtacctgcttctgagagggctgccacggtggccacctgtgaagcctgtcacccagaactggatggtacctgactttcttcatagacccatcttctgctgggactgaagctgacctccaacagaagccaggtaagccctgcccttgggagaggatggcccatgtgggggactgcacgcagacgccctggctccccgtcctggtggtgtctctgatgtgctcagcccgagcggaatactcaaactgcggtgagaacgagtactacaaccagactacggggctgtgccaggagtgccccccgtgtgggccgggagaggagccctacctgtcctgtggctacggcaccaaagacgaggactacggctgcgtcccctgcccggcggagaagttttccaaaggaggctaccagatatgcaggcgtcacaaagactgtgagggcttcttccgggccaccgtgctgacaccaggggacatggagaatgacgctgagtgtggcccttgcctccctggctactacatgctggagaacagaccgaggaacatctatggcatggtctgctactcctgcctcctggcaccccccaacaccaaggaatgtgtgggagccacttcaggagcttctgccaacttccctggcacctcgggcagcagcaccctgtctcccttccagcacgcccacaaagaactctcaggccaaggacacctggccactgccctgatcattgcaatgtccaccatcttcatcatggccatcgccatcgtcctcatcatcatgttctacatcctgaagacaaagccctctgccccagcctgttgcaccagccacccggggaagagcgtggaggcccaagtgagcaaggacgaggagaagaaagaggccccagacaacgtggtgatgttctctgagaaggatgaatttgagaagctgacagcaactccagcaaagcccaccaagagcgagaacgatgcctcatccgagaatgagcagctgctgagccggagcgtcgacagtgatgaggagcccgcccctgacaagcagggctccccggagctgtgcctgctgtcgctggttcacctggccagggagaagtctgccaccagcaacaagtcagccgggattcaaagccggaggaaaaagatcctcgatgtgtatgccaacgtgtgtggagtcgtggaaggtcttagccccacggagctgccatttgattgcctcgagaagactagccgaatgctcagctccacgtacaactctgagaaggctgttgtgaaaacgtggcgccacctcgccgagagcttcggcctgaagagggatgagattgggggcatgacagacggcatgcaactctttgaccgcatcagcacggcaggctacagcatccctgagctactcacaaaactggtgcagattgagcggctggatgctgtggagtccttgtgtgcagacatactggagtgggcgggggttgtgccacctgcctcccagccacatgctgcatcctgaaaagcatgcctgtgggctgtcctcccaggacaagccaaggatccaacgagggctctggagctgtgagtggtgccaaaagactgccaagaatcaaggcttttgtgatatgtcaccgtatgccttaggatgttcaaggagccagacgaaataaggcctgtcttccaatttaaccaaagataaaggactagagccgggatactttcagatgctcgcctgtacctcaccaggcagagtaaatatctactcactcatacagccagcccaccagcccaccattaactcactgaacaatgagacaatgttgaggactcaaatgaatcaaaccccgtgggaatgacagaagtgaagaatctggtccctgtctttaaggagtttgcactccagtagaagacagaaggaacgtatgtttacaaaccacttcactggaagacgtcaaacaagctgaatgaaggggcgcttagaaaacgttaatagaagttctaagcgggagatgactccctactgggatgatgaaggatggcatcctagtgaagaagcagctcaaacattttgataaaatggcaacaaaatgcagacaccctgctccaggtattatttcaggtttagtacaagtctgttaataccctatgtggtttcattaggataactttttacctatccttgaggtcatccatattcttacaggccttccagtcaataatggaagagctcactctatacaaaaccaatatgcaaggcatgtgtttgtccaagcaattggatgtgtgcagtagccaatttcatttactgcattactctttggcctgggaaccctgtggtctgcactacatgtgaatggccttccacttcagtcttaggcagatttgaccttttaggggcagcaatgctgaaggacacagcaatttaaattataatgtgtcaggctgtgttttcacttcaaacatgtatgagtagtcagctgtaattagagaaatgatgacttcctaagagttcagccacgcataattctagatttcaagagcatctaagacttgtggattagcctcatggcatgagagtttcagactcagccttctgagccagtcagggaaagtggagttctgcagcgcaaatgagagcctgggcttggtgtcgagggagctggcttctagttgtgccaccttgggccttgtcttttcctctctctgcctcagtttctcgtctgccaatgagatgttagttagtgattctataattggggcaggtagggttcaggtgagcaaaaagaaagtggagctataggaaatgccaggcctttgaggtgctctatggaagtcaacacagtgtggtttgtccatttaaatgggaataaaaacagaaaaactcagacttggcattttcacaataactgcaatggtttgacataacatttataggcagaaagttaataaactggcattgttcttggcatattattgtactatccctgtaactgccaagagctcaggagccaggctagtgatcacaccaggggttagagttcactgctgaactccctgatggcaggtctgtgtttattactacattaaaacaaagtctctgacttataaagcgaggtcgtaaaaattacaagttgcatgactgaaaaaatgctttagggggaaaatcagtcatatctttaacaccaacaagcaatttcccaccaacgaatgtagtacatactgtgagaggatcataatgaggtcctgaatatttaatatcatcatttactgtgtctgtttgctgctgtttttcgaacctatttggtttaccctgcaagctaaatactccacggcagagcttaattatccttttaattcctctttgaaatcctgtggtgcccccttccccctgccttgtgatgatgatgagtgagtctccccttaattagactgcaaatgtcacttgtgatgagtgtgccattccaggataacagcttgcaccctcctcagaatgttttcagcgaaagagtggggtggctgttctctgctcctggtgctttggcctcatttcacactattagaattctggggctgtaaggccagccagtgtcagctcatgttccattggctctccacctgccatttttagggagctattccttatatagttacaaattcccttgtcatttacttatttggaaacatgggatttactctgacaagctttagcctatgttatgggattcagaacaatgagatcataataattctcactgaccaaagctgggactccatcctgccatttttgtgtggagatattcataattctgcaatactttaaaacatttagaaaacaccccagggtaggtctgtggcccttagacagtgaagtcttaattgtcaatattatttttgtctaattctgtatatatataacttattatattttataatctcaataaacatattaataa

SEQ ID NO: 864 - protein, 448 aa, Homo sapiens
MAHVGDCTQTPWLPVLVVSLMCSARAEYSNCGENEYYNQTTGLCQECPPCGPGEEPYLSCGYGTKDEDYGCVPCPAEKFSKGGYQICRRHKDCEGFFRATVLTPGDMENDAECGPCLPGYYMLENRPRNIYGMVCYSCLLAPPNTKECVGATSGASANFPGTSGSSTLSPFQHAHKELSGQGHLATALIIAMSTIFIMAIAIVLIIMFYILKTKPSAPACCTSHPGKSVEAQVSKDEEKKEAPDNVVMFSEKDEFEKLTATPAKPTKSENDASSENEQLLSRSVDSDEEPAPDKQGSPELCLLSLVHLAREKSATSNKSAGIQSRRKKILDVYANVCGVVEGLSPTELPFDCLEKTSRMLSSTYNSEKAVVKTWRHLAESFGLKRDEIGGMTDGMQLFDRISTAGYSIPELLTKLVQIERLDAVESLCADILEWAGVVPPASQPHAAS

SEQ ID NO: 865 - DNA, 29111 bp, Mus musculus
  misc_feature (1)...(29111): n = A,T,C or G
cttcccaggaagcgtaagactcaagactccccatgagtctagatgtcccaggaagtgtaagactctagactccccatgagtctagatgtcccaggaagtgtaagactctagactccccatgagtctagatgtcccaggaagtgtaagactctagactccccatgagtctagatgtcccaggaagtgtaagactctagactccccatgagtctagatgtcccaggaagtgtaagactctagactccccatgagtctagatgtcccaggaagcgtaagactctagactccccatgagtctagatgtcccatgagtctagatgtccctatgcccaggattgtgtaccctgacattggcaagcaaagtttgggtctcaacaagctcagaacgcccaaggtaaagcaagcacagggtgagggatctgatcctgtcctttgctggggagaggggggctgtcctcttgacacagaggctggaggatggtgttgtgcataggaagtaggtcatggaggcctggagttggcccagagtccttgacagcagcaagcaggcctgtcctggagcatgcactgatgggagcagagccaggccagcaaatggggcctgaccagcatcaactccccgagctgggaacggacttcaggagaggatgtctggaccacagttctctccaaaccccaagggtgaggctgcccccctccccccaccctccacccaggcaccaaccctgcacagccttcaagcttgcccgggcccaaccgggccgctggcatgcattggtagaaagccacagcagccaaggctgtaaggatagagcaggcttgccagcacactggggtgagaaaaagcaggtcaagaatccaggcctgcctgatcctgcccagtggggccatgtcagtagggcagggggttgcactactcatccaaatgcctcttacagttctctacctcacgcttaccacactgtccctgcctaaagctgggtgtgccctggatccccaagggaacctggcaaatacagctcagaccggtctccagagtccccgctgtgcattgacagtgacctcaaccatgaacaaggatgatggcctcggcggaaatggggggagggggcagtgatgccgaaggtgacagctacttagaaagctctgtggccaggtggcttctgctcaggatgatgtgaaaggagacacacggtgggtctcatttcctcccagaccaaaaacaccctcagcgagcctctgctctgagtgtgtgagctgaggagctggggtggagggacgggcagccagtcccccaccggccaaatccacccatctctagtttcatcccatttggcagccacagccttggtggtgatcctgtaatcccgtccagtttaacctgcatcatccccatgcttcctgaaccatggccatgagtcaccctgatctgagccagccggatacttctaggccacttaagagctctcgccacttctacaaagtgagttccaggacagccagggctatacagagaaatcctgtctcaaaaaaacaaacaaaaaaaaaaaaaagagagagagagagagatctcaccactgtggttatgaggacgggacaaggccaggatcacagccagaggaagtcctaagccctgaaagcgcaccgaggtcccagccagcaagagactttcccccagggtggcagaaataagccatcttgtctctcagttccacccagcccccttcactctgtgccccatctctttgccagagacaccagcactcaccagagacaagcccagtgctccccatgcccaagactcctggacagttaaacagatggacagatgtcaaagtccccatggacatgatccaacttcagctcgctctcagcctctcttcctctcctgtcctgcccaccctggctcagcttcccctctctcctgcccacagcattccacggaactcattcctgcctcacagatctctctactcctccacagcttgaggtcagccacagctgatgggtcagtcacagctagcagagcctacaccacaggagtccatggtggccactcatctgtgcttttctttggtgatactggtgttgcaggaccactgctcctcagacttgaccttgtagtccatccccaagtccaccagtgcaagccctaacatcttctcactggctagccgaaatacactcctactgtgtgcaagccctatcacattctcactacccaactggaatctactcctaccatgtggtgccgtccctacctcccaagtcagtctagcccccacactcaggcagcccagatatttccaggttgtcttccaacctgggaatcctggcagcctcaggcttcctccagtgatttgcctagccccacctggggcttgtcacagagaacctacccttccccctgctcccacaccctgctcagttctacaccccacctgctccctgctgcagaaacttccccagagattcccactaacccccacactaccccttatctctttccaaagctcccttctgttttttattagcctggcacacaaaaacttatgcaagacacacttgttggcttgcatggttgcctttgacaaatgggagcctgctgggtcaatgtggaatgtgctggtagatgacttggcatgagcccaaggcacgggcagctagaaaacgccacacctggagccgaccctgctcatcctaacaagaaaatcagagatgggtctggagaagtgtgcccaaggagtgtgtgtgaggcagtaccccagagggcagaagaatccaaagtgtgagagccttcagtggggctgggcctctaggtcccatcctgtggccattaggcaccgctgaactggaggatgctgggagtcctcagggttgagtggggaaggttggttcttatatgtttgcttgttttgttttgagacagggtctctctgtgtagccctagttgtcctggaactcactctgtagacggggctaacttcgaactcagagatccccccacctgtctttgccttccgagtgccgagactaaaggtgtgtgccatcaccacctggttgggataggcctctccggcttcccacatccttccactggcgcctgaagccattctgcagagagataggaaaggccctggagctagttctaatcctctgtgacctccggcaggtcactggccttacctgccctagaaggaaggtctgtcaagtttacagaggctgatcgaggcaacaaacaacagactgtatgtagccgccacacataagaccaaaacaaaaggtggaccaatgagcagcagctgtgtgggccagagagcaaacagctcgatggcccagcttcctggaactctccgggcaatgaactcttaacaggtcacagcttgttagccgttggaatggaagtaggagtgagattctggccagctagcagcctaaggtctgcagacccctcacttgcaaagcagccaccagtatacagggtacctcggtcctcgttcccccccccacccgtccccacagccactgtccccactgatgagacacacacagcaagaccttcaaggacaggggctagtgaggtcagagacctgtaaaaactccaggcctggaggcagaattccttcccatggcccggaccaggagtcatcatcccaggacttagccgatgtcttcagagtgactcagtcagtcagctgtcacagttttgcattctgtcacagactaaggccttcggtgtagacagcccatccccgtgtagctgtgcctctgaagtgccatggcgaatcggaactgtttgagatactgtgagtggccaagcttccctaggcctgatgggagaagccgggcctggggagctgggggctgccagggcctaggctaggtgttgggaatggcaggctgctcagtgagtcagaggaggctgagtagagtcctctgctaagggcctgcaagtgtgccagccccagaatcaccacagtgggcagcggggaggacatgaaggctcagagagtaggctgcccaagcgcgcgcagctaacaagaccagagccaagatgtagcccagaggctctgacctcgcagacagccatttccattctcctgtggcttgaacatctgtctcctcctataagaagggtcttatgatatgcctgccgcagggctgtcttcacctttggccaactcaaaattgttgtcaaagatttaatcgtgggagacatatccatcaggtgaatgtgatatgacagcaacagggtcgtccatattcaggaatgttgtagcagtcaacaggaaagcccaaagccacaagacttatagggatgtggctcagttggcagcatgcttgtctagcatgcctgggccccggggttccctccccagcattgcataaatgggcatggtgctacacgcctgtgatcccaatactcaggaggtggagacaggaggatcaaggttctccttggctcccccaaaaatcagtaccagtctggggttacatgaaactgataagaaaggagcgaggtccagaggggccaggcccatttattcattgaacatttgattgaatatttgatgaggcatcactgtgtttcaggccctggactgggcaggtacgacacactgcgtgaatgaatctaattgaaggacagaaaatgtgtgtccagccaaatcgctgttgccttttgttttaaaaatctatttggtcctggtggcacgggtctgtgatctcagccactagagaggctgaggcaggaggattctgagctcaaggctagcctggacaatttaggtgtggctcagtgatagagccccattcagcgtggtgggaccctggcttccaccctcatggcgaaaacaacataagccaaattgatctgtacagaagtgcttggcaccgcgattcagccagcggcggcttgcctccgtgcctgacccacgagagctggtagtagtgcagtttcatgctttgctcctctcgtccccgtgacgggacaccgtcctgccgcctctgcctctgtgcttgcatttttaatagctgcaaggtacccgcatccgaacagagccagtggtgactggcctgttcccagtaggtacctgggaagtggctgacagtgtgatcttggtgtgaacatctgtcagccctttcagattagggctgccgggaatggtgaaatagataccagcgtgaaaataagctctccgctgagttcccaattcactgtcaggagaaccaagcagttcttggacttcccctgaggtccttgagtgacctctggccctgctgcccagctagcctagcacacagaatgggcttttcttttggaccccatgacttcctgtaatcagtgtatgtggttggcaggaggtggactgctaaactgtagttactcattccctgaagccctgtctttatctgtaaactagtcattgataaaatatctggccacctcttggccaatgaagagactgaagaatttgagggtcaaggccactgaccccgtgggcctgaacaaatattgactgcgtgtcatgtgccagaaggacctgagctctgtgtgccagagccccagtctaggtggggtcacagacccagctctgtcccaaccgagcattccattgctcaggggcttgggctcttccctggggattaagaacaatgcccccactcccactgctgggctgctgggcagacagaaccaccctgaacccgcctggaatgggggtgagcacagccctgctcacccactgagggactgggtatatcagaccatctgtgcctgcctacctgaacctcttattctcttcctttatcccagcgatgctcggccttcctaatgctgcaatcctttaatccagttccccgtgttatggtggccccaaaccacacaattatatatacaactgtaactgcaaccttgctgctgctgtgactctcgatgtaaacatctaaaatgagacctggggggagggggcaactcacaggttgagaaacactgctttagtcactgccggcctgtcctgggagatgcccccggctctgtccctaccaccattcatgctgtaaccttgggcttgagatgaacttctctgagtagcagccctgtataagaactgtctattcacagtgcctgggaacaagaagagaagaagctgtgtggagagagggtcagttgggtggttctgggattggcccaggagagagggacatggtagtatttcacaggagccatgagagcaggccacatccatcgccctttgggacctgggaagctccctgctggctacaatagtgctcaagtaaggaaactgagtctcagaggtcaccctgcccagccctttgtcatggtccaggtggctcacactcctggataatggatcctggaacggacaaggtgtcagactcccaccagcccaggtttgacatctgaggcctggatgtgtgggatgcatgcagcaagatcttgggggcagagggagaggggaagagagagacactctgagggaaaggagagggtggagcctattttccttaagcacttcacctctgggccaaagttttccttattttatgtaagagtttttcctatggctctgggggcagaagccaggcctccagcatgctgggcaaaggccatagcaccgaactactcgcagccccaacattcccggtttccactgacgtgtgatccacaaggctgagatgtactcagtggtaggtgtgtgtccagcatctacagagccatggatttgaaccacagccttgaaggaaaaaaccccgtgaaatctatatacaatttactaacaagacattctgtcctatggggtgagatgtgcatgtgcacatgcgcgagcgcacacaaacacacacacacacacacacacacacacacacacgagcgacaggtccagaagtcaacatcaaatgtctttctccgtcactctccgccttgacatgtatgtttgtttgtttgtttgtttgtttgagacaggatcttgcactgagcctggagtgcacgttttttcaccaaacctggctgaccaacaagttccccctaggatctgcctgtctctgccaccacagtgctgggatttcaggtgtgtgtcacccagtagggtttttatgtggatgccgtggaattgaacttgggttcacacacgtgcccagtgagccatcttccccagcctttgccacccagtgtccctctttggtctgaggatggtctcatgcacattttatagccagagttacagaactgaagacaagtaagtgctctgagcgagctgaatctgagcctccttccccataagctttcagtgtgagcgggcctcccagatgcacccatcctaaagactcctctctggtgagtatgtggtttgtgtttcccaggagcccatgcgtatttgctggcaagccaagctggcttgcctcctagagtaggaaggaccgttagggatccagataccccacccctcaggagcccctgtcagcctgcagggactggcaaggtgggtcccctctgcatccctgacagtgccctttgtcctgcttcctgtggcatctctatctatcttcatcttgatggttctgctgttgataacgctggacaggtaaacacggaaggaggagaaagtccaccaatgcctgccagccagcttcacctacagggccatggccgggaccagccgggagaaaggccagtccctccttcctggctttccaggcctggtccctggcctcctccagtttccccctgaacagctgagcctccaaagcagaagtcgctggccctgggttcatgctctctctggctcagtttacatatccaaaagcatgggtaggttgccaccaagcactgtgggatgtgaaagcatacatgggtgacaatggggacagggtgcagccagacccgcctatgccctgcaaccacgctccagcgctcaggatctcccctcctgagttcagagccccactccaggcctgatgtgtgggaaggacactttaagaccatagatgtccacagagggtctcaccccaggtctcaaaaacacacccgcagagagcagcagcctgtagcagggatctctgaagtttctgttaccgagcccgggcttaaacgaagcctctaagggtacctcagcactaaagggagtgtctcagcagaagagctaaacccaaggcagctcccattcaggctagggaaagctgcccagcctagtggaaaagggacatgcagaatgcatggtccttgttttaaaagaaatgaccaagaatgttaaggagacaccagagcattaaaccaagattctgaccacaaagccctaagcaaaaattgcagcccaggatcccccaggggagcagtagcttctaggaccagatccttgagccgtgcctgacctttcccttaaacccaggtcagcagccagccttgcccactctgcctcctaactactcaccccaggatggcgtccctcttcacccacccctgcaggatgtgcccctccgccagtttatggtgcactaggtactccccggggaacagactctcccattgagactgctggcacagactagggctcaggggttccgtgtgtttagcagtcctggggactgaagccagggctttgagcatgttgggcaagtgttctccactgagccatctcccagccccgagcccagggtttgaacatatcagtgcacaatggtacttggccttcaacctagggtctcatgcaatgctaggcacaggttctactgatctattccccaaaacctatatgcggtattttgaataatcattcttttaatccaagaaaaacaaaatatcattttttaaatcaaaatgctgtgctagcagccaagactcttgcagccgaaggatgttccacgaggtgggcccaaggaccccgtctttctttacaactctgaagttttctttttctggaatttgtattctttacttaattttttttctttagaaaattgtaccaaagtgtcactttgtttaatgagttccttttttttttttaaagaattgtttatgtaatatatatgagtgttctgtcttcagacataccagaagagggcatcaaatcccattacagatggttgtgagccaccatgtggttgctgagaattgaactcagaatctctggaagagcagccagtgctcttaatcgctgagtagtctcttgggtacttagagtgagagcctgacactccccccccaccgcccctccccagttctggtcctggtggtagagtgacagctgatcaggacaggaacaatggccaccaaggtgagtgcaccgacctaaaccactgcccaacttccttctcttgagccaaggctccatatggaaaagcgctattccagacccagtgtgcagtaagggatgtctccctaggacccagcttccgttcacggaccacaagaaccggccagcagactggcgtgaccccctacaggaagagaagtctataaggaccagggaggacggacacacactcacatgcgcatgcacgcacacatgagggagtccaactcaaccccacttttcagatggggaaactgaggtttgttcagagtctccaaccaggaagtcgctgagtgggagttgtcggggttgaccagtgactgagggttttttctgcacacacccgtgtcccctctccccacacgctggggtgggaagtgagtggaagatcagagctttctggagttcagaagccagctggccagctatttctcagaagcctaccactcactggtaaggaagagacctagtggtctctttcaagattccctagttcctccttcaaactgaacccgggaagggaggaactggccagcaggggccctttaagactggccagggccaagttcattcacccaggggcccctgctgactcacgcttatgaaagtgattttcctggtcccgcccctgcctccgcctcctccctgccccgctgtgaaatacccctgctagccttgggcctcgcacagcctctgggatccccagggctaatgggcatcctgttcttgcagcagggcaccgtgacaaagtctctcaccgtgtgaccaagttcctctgagtgtccagacaacccaggctcaccagctccctccagctatctaccatccatcaggtgagtggtccgggcaaggctgtgggtgggaaacaatagctatggggcaagggtgggcagacgggggtcaggaaagccggggtgtacactgactggtcctgaggaggactctgggagtcctcccttgcacctccagcgatggccatggttaagtgtctgggacactctcccccagcggcccctggcttagcagcctaatcctaactcgtgaaatagctgttccggcaggaaggagcatgggtagccttgctccttcgaggcaccaatggccactgtgtctccagcctggcgaggtgctccagtgggtcctaggtaccaggctcagacaagcacagccgagggttcctgggtactcggtttacggaaggtgcggtggagaaagtggtggaccgtggaggttgggccatcaggcacccttgggcccaggtggagcaggcacttggaacgagggttcactgtgactaaggccaggtaacacttggctgactgcacacttcctcctgccccagggctttgtgtcactagcagctgtcactgctacctgttgctttatttgggaatggaggggaaaggatcccaaacgaggctgtctaggacctagacgagatgtcccctccccttccattttccccaacctcagtttcattcatgaagtggggataagaaacccccagctcttgggggtggtggtggcatttttagagacaaatggtatatggttcccagccctccctggcatgacgatttcataaccttagaaatgtctgcagtgttacaccagggcaactatcgccacttctgagaaactcattttttatgtgctcatacctgtggggtcagaggtcgatggctagcgtcttcctcagtcactgtccacaccttctttttcattctattatcactatcattattattattattgctagagagagcacaagaacacgtgtagaaatcagacagccacccctcccccccccccccgccaggagtcaggggtcaggggtcagctttctccttccatctttatgtgagtgctgcctgcccataagtcactgcccttgtacaacaagttacctgcagggccacttccctccaggcttccctctcctggactgaacctggagcctgtcattcagctctctggcgggtgatctccaggggccctcctgtgtttgtctctccagacctaggattacagacatctgcttttgacaggagtgtggagaatctgaactcagttcctcacggttaggcaagcactttacccacggagccatctccctggccccttaaatcaacaacttgagaacgttattttttttttctatcagcattgcccaaccagagagactccgaaatatgccagtacttttaaaaactggttattctagcctggaggtggtggcagctttctcttgtaatatgagtggttgggaggtgcaggcaggagggtcagcagttcaaggcctgccaaggcttattctagtttcaagccagcctggactacatgagaccctgtcttaaacaaaatgagcagcttaccccaattctacaaactgaggcccctgggtggaactgcaggttggaagaagccgttttgccttataaactagtagcaggtacttgtgggtggttgtgagggtgaacagcttgggggcgtgtgacttctggggggtggtcaggcttggcggtgacctcatgtgtatggtacccagcaagcagctctaggtgacacttgtgccagctgcgagagggacctggacttagagtgcaaagtcctcccagtgtgttagcccatcccacttcctgggaagcaatatgggtgtccccttgggcctggccttcgtggacagggcctcctgctgccaccagtgaggagctgtatgctggggtgcccaggtctctgggaatggccggcatgctgttttcaggggtgctggaatatctagtagggttatacctgcagggatcaaatttctgttctgttatgggcccactctgaaacttagcaagcatgactttatccgccctccctccacccccgcctcagtctcttcatctgagacatggattgtcgtgagaattaagagagagaaggcacaggaaagcaccctgttaggatgctaccctcacctgtgttgttactgttgctgggtaatgaatatggtgggagtggggagagacgccaggcctttgctgtgccctgcgcacaccagtgaggggacaccaccctccaggaactgtagctgaatttccaaggctctgagcacagctacaccctctagttagtgagcaactgaccctcttccaggacactggagccagaatctgctgcaggacagaaagggacagtagaggcttcccaccctctacacctgcagaggctcagagaagcccctggggcagggtgacctagttcaagtccaatccagctgactggaggtggaacaggtttcttggcaaactgtaaaagtctgtgcaaagctctccagcctctgtttctctatctgtaacacagaagtgatcaaaagagtactttcaaccacccagattaaaaattgtaagcataaacctctgggggaggggggatgttggaacttacaggacgccagctcgacagatgcctggaaaagcctggcgccggctctataattactgccatagatgtgttaccctagggtcctcttaggccttgtaagggagaccacatgatctccaataacagcaaggagccacctgcactgtcccaggaaggaggaggaggacccagcgggtgctagggacatgggagccatcttgacaagtctgcaaagctgtcctaatggctgagcacagctgaggctgaggctagcagatggttcttggccagcccagctgtgagcccacaatgacgtgcaggggcatatcctactggcagactgttcctccccttgtaaggctcgcccctcacagaggagcactgaataccagcaccaggtgctaggtcagttgtccggtctgactggttggacttgcctggtgggagatgccggattttgtgttcctgcacgcaagtcacacgaggccccagctgtgttttgttggcccatgaagcatttatgtaaaggtgcgtcactggctgcccacttttccaaattagagagttcacatacaaccccccagaattccgcctcctctgtaagaggagatgtgtgtgacctctcagagcagtgtgctgccactaggtggcctgaggctatcagggaactcgcacaatagcccagagtcttagtcaccagttagccttgggttaaagtcctgccagcagcttcctccgagggtcagagtgggaggaacatgctggatggaggagctcgttgtccttgttcttccgagggccaacattttttttttttgtccctaccaccaccacccgagaaggagtctgacaccagccctcgttcctcagtcacagtccagagttgcttgtgttccctggcgggaggctgccctggtctgccctactgctggcctgggaatgcagcgccagcgctttgagcaattaggcattgtatccaccagggggcacatgaactctaaaacccaggtttgctggcatttttcccaaatccagctgtcaagagtctccccaagtccaaggtccaaccccgccctgagcaggaggtcaggcagggccttcctgacagtaaattcaccccagcagatattccagaacattctcctacttgcacagcttactgaggctcaggtctgggaaccagccccacgtcaccagcaaggaagtgggtggtggccctgcagccaccaaagaagtcttgttttgcccctacctctggtactaggcaggggtcctctccttaaggtgaagtgtgtgtatgggggggggagatggatggcattaggctcctgttggtggctcctggctctcaggtgccccatgtgataaggacaggtgtgctggatgcagagagtgtgggtagataggagggagataggaggctccttgtggctgccctgactccaccacgtagctgagatgagaaggtgtgactgacatcctccaacctgactacaggggcattctctttgttctgctctccaggtcagctgccagccccaggctgaacacccacccaccgagctatgacctcctggaggcacgactcccttggggccagcagctcagagcccctcccagtagtcatcatcggtaagtgtcaccccaccccagcaagggcgggggatacacgaatgctctgcagacccctgggtctgaggctagcaaagccaaggctggcccctagacggttgcctttaaatgaattgaatgaagctcgtttgcttactgtggagccggctctatgcataagagcacctgcaccatcacccggtgtccacaactgtgccagacgcccacatgggggacacaaagatagggccgtggttcctgtcctcagctctgcaaaatcgagaaagggggcgcaagcatcagatcgacccacacaagcgaacatttttaaagtgaaaagcagccggacagcgataagccgggaaggtcaggcggaggatgctctggtcccagctagggggagctttggtccacttagacacctcggggcttgaagcagcccgtcctgatgatggaccaccacctccaagactttgtcacagccctcctggcttaggcaagcactctgcctctgagctacactcccacctaccttttgcttttcctttggggctcactgtgttgcacagacaggccttgaacttgagatcctcctggttcattaccacacacacacacacacacacacacacacacacgagtgtcaggcttgcatggctatagactctgcctccctgggtgtgactccctgcttagccttttgccagctgcgtggatgggaagtgcttgcttaacttctctgtgcccatttccccaagcacaaagagaaaacactcatacccgtttcttgactgacatcacacaggaagccctttggccactgttcatttgtctgcttcttggtcattactacacatggcatctgtcgcagagtaagggcttagtgaacgattcatggaatgaaggggtagccagccaggctgagtggccctgacctccctgtctctgcaggcaatggcccctccggtatctgcctgtcctacctgctctctggacacatcccctacgtgaaaccaggagccgtccacccacaccccctgctgcagagaaagctggccgaggctccaggggtctccatcctggaccaggtgggtctgacacttgagcctgggaggggcattctcctagcggatggccaagctcagagcagaggagtccacaaaaccaaccacagaataggaaaagagcatccgggaccatctacccagacccactgatgccatgtcagctgtctgacctcacattagacccgtgcttctcagtgaccaactcccaccaagaacattcatggggccctcaggctcccagagggaccacagtgacagtccccaaaaatactcagcatagagatctctgtgtgaccagtttccctcagactcaaggtgggactctgctattccctggggatcccactgacctgtgccccgtcttcaggacctagagtacctttccgaaggcctcgaaggccgaagccagagtcctgtggccctgctctttgatgccctcctgcgtcctgacacagactttggaggcagcatagactctgtgctctcctggaagcggcagaaggaccgcgctgttccccaccttgtcctgggacggaacctccccgggggcgcctggcatgtgagtgtcatcttagagcacaccctggggagaggagcagggtgctgctgtcctggcagggcctgacaacccctttctctgcagtccattgaaggctccatggtgaccttgagccaaggccagtggatgagtctcccagacctgcaggtcaaagactggatgcggaagaaatgcaggtaagggggccctgggaggctgggcaggcaggcagaggagtttatactcccctattaacagataaaactggcctctctaggttctgactctgtccctgcagatgaggagggggagtcaggattgtgtagtgacaggaacgtgcgcatcacttgccctttttgcataatacctataagaagtatcttacaatgaaaccatagtaggtagccctttacagggctgtgtagtattcctaaaggagccatgcctctagctcagcaaataccccaccccagtgatcctctgccagccacttgcccctctcagtgtgccattatattaaacaaccctgcaggtagcctatgaggatagctctctctgttacagttagcacaaaaggtaaagaaaaaaaaagcatgaaatgacagacagaaacaaagcctatagctcctggtggcctccgtgcatcctggcctttgagtgccccttagccatgtgtgcctgcacagagtaactcatacagtaaggtacaggaagtcttatgagatgccagctcccccaccagcgtcacgggccctgcatgtccctggagagggaggagacacaatagaactggcagtgaaaacggcaagccccacaaggctcccgtgtgcctttcctgtgtggtccaggacctgctaagggcttcaataggggtatttttttttaaagatttatttattttatgtatgtgagtatactgctgcgctcttcagacacaccagaagagggcatccaatcccatcacagatgattatgagccaccacgtggttgctgggatttgaactcaggacctctggaagagcagtcagtgctcttctctccaaccctgggggagggggtaattttaagtccacacttcaatcagaacgtggttcacagggttcgggatttagctcagtggcggagcacttgccaagcaagagcaaggccctgggttcagttctcaccacgcgggaagggaagggtgggggcggggtgagggtgtgacccacacaggaaagagtaggggagccctgagtgcctctgaggagtacctgcaggtcacttgtgggcaggttctgaggccgctatccagcgcccactccctctgttcctccctccctctcctccaggacagccctgcgcttagctctggctgtagagccctcaacctcattgtcagcttcatagatgtgagctattacaacatttccttagatctgctgagttttttgttattgttgttttgtttgtttttagtttttgacgcagggtcttagcattcgaggctggccttaaactggtggtcctcctgcctcagtctcccgagtgcaggtagtcaccagctttcagactgttattgcccattgagggtaatgatgtggccagcccagacatgtcaccccatggtcaagttccagtctaggtgcttggcttgtacccaacactgtacgatctcccaagaccctcatgggatgttgccaatacactcacacatagggaaactgaggcacagggggtttcaggctttggatggtacccttgttagttctgctttacatgggagacacccaagcctcccctcagcagggcatgccgtcacactggccagtgcctactaccatgcctgtctctgatacccagcccctccacgtctgcttcctctttagaggtctccgcaacagcagagccacagccggtgacatcgcccactactaccgggactacgtgatcaagaaaggcctaagtcacaactttgtgtctggtgccgtggtcactgccgtggagtgggctaagtccgagcatggcagtcccgaggtccaggcatccagtcccctcttccaagtgaatggctacttgactaccaaggaccacggccaccagcccttctcactgcgggcccgtaatgtggtcctggccacaggcacctttgacagcccagccatgctaggcatcccaggagagaccctgccctttgtccaccacgacctgtcagccctggaggcagcccttcgggcaggcactgtgaacccaacctcagacccggtgctgattgtgggagcagggctatctgcagccgatgctgtcctctttgcccgtcactacaacatccaggtgatccatgctttccgccggtccgtgcatgaccccggcctggtattcaaccagctgcccaagatgctataccctgagtaccacaaagtgcagcagatgatgcgcgatcagtccatcttgtctcctagcccctatgagggctaccgcagcctccctgagcaccagccactgctcttcaaagaggaccaccaagcagtgttccaggacccacaggggggccagcagctctttggggtctccatggtgctggtcctcattggctcccaccccgacctctcctacctccccagggcaggtgctgacttggtcatagacccagatcagccactgagtcccaagaggaaccccattgacgtggaccccttcacccatgagagcactcaccaggagggcctgtatgccctggggccgttggctggggacaactttgtgagatttgtccagggcggggccctggctgctgccagctccctgctgaagaaggagaccaggaagccaccttaacattagcctggcaccctgacacccaggccctgaagaggaagagggcttatcacagcccagcgggacgtgagcccatctaaagatttcccatttgggaaccagtctccccagcagaaggggaagacttgagccatgtggatggactatctgccccagaggcatggggaacacaggctgccctaccctcaggcgagatgaggccccaggtgggagcagtagccatagaccagggggcccccttgaaactgtcagtgtgtgctggagtcacagggccagctgagtgtccaacttggagggccccaggcccaacttttcaccatcagatctgtaataaaaccagctgtgcctccactgtgcctgaggagtctgtgcttgggaagtggctaggcaaatagaccgcgcactgggcccctgggtaaagcccgcagctccaggagaacaagcgatagggccccagagtggagcatccataggcacagggctagactctatggagtctgggtcaggaatgaggcttccagaagcctgatgcagccctgtccactctgtcccctggtctgcccatttgagtctcacctcccgcctcagggcctttgagcaggctggtgtccagtcccgggacccctattcaggtgtcttgagtctgagtcacttgcacaagtctgcgtcttgctctaccttctgggcaactagcgcccgcgggtggaggaggggaggaagggatcggggagaatcatcccggcagagggcgctcggggctcaccggacaccagtaccaaggggggaggggaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccctctccaccattcgctccctgcctgttcccgcatccccgcatcctattgctgagaccctccttggcgcggggaccccgagcgcaagccccaactctcactgccgctgagacgcctgtcccccaacccagacctcaagatcctctccattcctccctccactttatctcatctccacatcccatagctgggacctcttcttcccgcagggacacccccgtccaagaccccaactccacccggaccgtattaccctcacttccatcctcttcttccgcttccttgcatccccatatctcatagcctgggaccctcctccgcgtggggatctccagagcgagccctcccaccaccccatcgcggctgaggcttgggtccgcacccaccgaggaccctctcctcagtcgcccccctccacgttcccgcttccactaattacatagcacggacccacgctactccccttccatcgtggctggggcaccggtccccactggaaccgcacgaccctctacatctcctccttcacattcccgcatccccgcatccgatagcccagtccccgagaactgctgtaagtctggccgctattcccctcttcaggtcctaaccaaaccatcacttgagtccctacgatagggacaagaactgggcactgctagccccctcctctctatcctggattcttccctgcacttccccacacacagcccggaaccaccactgttctcttctctgcggatgtagatgagcccccgtgctgtgccgctttgcgagtgaagccccttccccagctcctctctttccatagaatcagaatcattgcctggacctaggcgtcctcaccccccccccccagctccaccctgagcaactgtcctccttcactgtcttcctgtcctcactcttggaccccagactcactcctcatcccacctcgtgcctcatgcaccacaccgctctccccaccccagccctgcagagtggggtggcatataggcaggaaagagttggtggtccgtggaggggcttctgggggatgggactggtcctggggggggtgcctgtacatgttatggggttctgagagaatcggggtatttttgagtgtgttcatgagttcatgtgtgtgtgtgtgtgtgtgtgtgtgtgtgcacacgcacgcgcgcgcccacgcatgccagtgggtgccacatacccctacaagtgtcaggggactggaaaccctattccccacttggcttcccttgctagatctcagaacctgtgggtgtgtctgagcaggagggctttggaaatgggtgttctagtgcctctgggaacaagcaagagatgcctgtacacacagatgtgcacacacagagatgtgcacacacagggcaggaggatccagagtccagagtagaggtggctacttgccctctttcagggaagccctgttcagccccttgccctcgacacttggcgctgtgtgctgtctgagcctctttcctcccctgtgaggtgggatacagagtagaaggaaagtgtcactcatgctggctccgggagccaatttacctgatgtcatatggggccacatcaacctagtcatttcgacaccttggtttcttgagggccaaggggtacccagagagcgcacagctcccttgccctgtttctgtgggctgcaggtaagcagagccatctgtcttttgactcacggagacttgaggagtggcacgtcttgtctggcttagcagatccctgacagacctccctgagtctaggaaaacgaagggagttggagggcctgggcatgccataggctgacttctccttctggataagggaaccaattcctccagggccctgaactgtctcagaccttacgatactgggacatcaacaccacacagaattggttaaaagacaatactgattcagtgggttcagggttagacatcaattcccttttctacgagttggggaggtcttagcagacaccttggtcagtcaggagctgctggtccacctacctggggtatggcctggacagagcagcttttggaagtgccctgcaattattagaacagcctcttggccctgggcacccagcacccaccatcaactgaccttaagggatttaaatgtcagcagagcaggaagtgactttgtctcaaagtgtgggtcccaggttaggactgctccccaatcccgtctctgctagttgcaaccagaacatccctgcctgccctctctccccatcccatacatgacgccatacttcttgtgggctgatcttgtcaccaggtttcaagatcaccaccttcagaaggaacccaggcaagccagagcaaggggaggtgggtcctgaaaaaacagtaggaaggcgtggagctctcgtgggcctctctgagcatggctgggtgcagctgtgtgctcagtgatgggagagtctagggggatgagtgtgcgcacacctgcagagatgcgtgtgggtgtgcgtgagtgtgtagcacgaatgtgtgtgtctgtcagcagccgtgggcaggctggcagcgcagtgggaagagggattgatagcttgtgaaggctggggagggcctctgcctgctgcagtctctccacgctgggtcccagcctcgaggtctcccggggaagtttgggcttccaagctgctcctgggagagggatctcagctgggtcacgaggctgctcagggcacctgcccaggctcatctcaggactgactccagccctcctctctccagattttccgccgcgccgataaaaatggtgagttccttccaggtgctccgctgcccacactccctgtcctgatgcttcatgggaaagagctaggggtggggacagggacgactatggtcctgaagatgaagagcacaagaagatccagaggtcaagtcctgccgctgttctgggcctcagtttccccttctgtaagctgaagtggtaacagctgtcctgtgttgctctgagctttggggcaaggtaaagagatgtatgtgagtgacctacgacatttcaaaagagaaccagagggtagcatgttcatccaggaaggaagtactgacgaggcctgtacctgtcacctgccctgaggcccttcccaagtggccttcaattcaaggtggctccagttttgtccagttcctatgtccttcctaggagctgttgttaaccgtcccatgtggttgtggggtggggtggagccctttgggttatgaaaaggcagaagagcaggcctgggttaggatcattgcagaggagtgttgccctcattgggcctgtcccaggtgatacgcatcttcccaggcctggcagtgaaggatcacctgcagatcccacacacaacacagggatgtagggaaatcaaacagtacggaagatgtggtagcactgtgcagagcccgcactacccagggaaagaggcctggccccgcccccaacacaggtcacaggagtgtcaacttcagcttgcagtgagccttagactgcaccctcctgaccccctccactcccgcaggttgggtgtttggacttgtgttctcggtgagggcactatgcccaaagcaaaggagggcctgtgccaatgtattcaggatgccttccaacataagaacaaggctgtgtgtctctgggaggctctcacgataaagactagcttggacgtggtgggcacgagatagcccgagggaaggctagtatgagagtcctgactggcacccctgggtatcgctggaagacgggcatagacgtttagcagaagggtgaggatcagtcagtctctccttcccgggatgtgagactcacaggctcttgctatttgaaaggtcactgcggcaggccgggctcctgctcattagtagcaccacctgcaaacagccctgcttgggttattggcagaagtgatgaagctacaggataacttgtcatctcttaattggaccagaggccaagtggaggatattttttcctcttaatagctcatctgtgctcattaggcctgtggctagcacccaaggtaaatgtcagcaggcttgtgatcagagaatctgcaagccctgtcttccagcttcctgttctctctgggtacggaggacactgaggtaccacccatgagaagcaggtggaagcagtcaagagggaaactggacctggtgttggcacaccccatgctgtgcccgggacagacatgactaatcaattacagcacacatgtgttgagcctagcattggcctcagcttttccatgcagcccagctacttcacgaaagatagagccacccaaagggtgggggactgtgctagcacctaccgtgtggcacaaagtcctgctctaggttaggttgaaggtctgagttcaaactgttgttgccttgaggaaggatgcaatagagggactatcctcagactatcccagagcctgggacgtggggccggggttgaacgtgatccctataggctagtggtgtcaggttaagcatgttacttaaatagtgtctgtgtcagatgactgagggaagagcagaaggggtgattgcctggtagagggcacgaaggtgtttgctccccagaaaccagcttccattgcctccgatggtttgggattacctgtcgggaggcctcaggctgatcacagggagtttgtcagctgagtcagtagtagtggggataggctgtgggctaccactgtgtgctcttctctcggagacaaacagccacttgcttccttgcctgcccattgcagatgatgggaagctgtccctggaggagtttcaactcttcttcgcagatggcgtccttaatgagaaggagctggagggcctcttccataccatcgattcagacaacaccaagtgagcccgggctaccatggggcactgtggggggggatgtataggctcctcccatctccacaatgccaaggtcctgtttaagggcaagaggtctggaactcccctgacccagtaatccaaacatcagacctgtttggctctcactgccaagctgtgtgccaagcacgctctcgctctctctctctctctctctctctctctctctctctctgtgtgtgtgtgtgtgtgtgtgtgactgccacagagtttgtcctatgtgctaccaaggggtaagagaccctgggcctgctgtagtatacacaggactgatggaacttggccatgaccctgcctgctctctctccgttctgttctaatcccagaactaccccaggatctacattctaagatcctgttcctgtgaaccaccatcccaaaccaccccctgtaatgcatatgaatcccaactctatcctgaacctcacttctggctttgaagccaattgagttgttttctacaattcactcatgacttggaccccgtagcagtctcacagggtacctggcctccaaagccagcatgagtgtgcactgtcctttatctgatgctcctgaattcagtctaggtgggcaacagccacctggtcaccttcctctgccccactaaggtgctgaggactaatgtttctagggtgctagggcaggttggatcacttggggggcccagagactagtggtggtgtgggtacacggttgctaccaggccagtttgctgtttgtatagaaagcggtagcacagagctgaggctggagacctgacagggtatgattttctgggcatgccaccatgtaggagtgactttggttctcacagtagatcaggggacactgtctccaggacgcatgaggtctcagcttctctgcagcctcctgggaacacactgagtcacacattcttgggatgcagaggtaggtgcatcgctgagttcaaggccagactgagtgagttgcaggacacagagaaaccctgtctaaaaaaacaaaaacaaaaacaaaaaacagaggctgtcctggaggacggagtaggagacttactttaggggaggtcacaattctgaaaacattctggattcttgcctccaatattccccgaagtagaaactgcgaatgttcatcagccccttgagttgctaagcctttcttacccagacaactcactcatcagaagcaacattccgggctgtctgaggaattccaaggcagtcactgccaccggccttggagtctacagaaaacttttacccagacatatgctgttgaacataggatctaccaaagctagccctgggccagaggagaggctaagcccagaaaggagccatcagaccccacccagaccctgcctggtccctctgctgcagcatctggtgttgatgcctttatacacctcccccaacccccagcaaggaccaaccccttctctgctttggtctaaggagtgaagttcagggctatgatggaggctgacccagggctccaagagtcccaggaggggaagggttattgttttgacaagctgcgatagtcacagcccaccctgcggccctttcccctctcctaggctcagcccctgactagttccatccactcataatatggcccacgaactcagagagagagagagaaacacaccaccagatatggtggcataagtctgtgaccacaacactcaagacactgaggcaggaggatcatggagagttctaggtcagcctggattacataatataactttgtctccaaataaggaaaaaaaagcagaacaggaggcaggcaggtggcttaccctgcatcttcttctaccttctagaaagtggggctcacgtcagtgtctaggatggggggaaggcagcaagcactttaaggactgcacagagggtcagaaacaagcaatttaaggactgctaactccctctccctctttctttctctctctctcctttattccctccctccttctctccctttatagccacgtggacaccaaggaactgtgtggtaggtacctgaatcaacggcaatcagaggagggcagagcagtatgggcctaggttggggcctggtgggagggccctagggagaggggtggagtcctctgtgacccctgacctttgcaatctcctgccccagactactttgtggagcacatgggagactatgaagatgtcctggcctccctggagactttgaaccactcagtcctgaaggccatgggctacactaagaaggtcagtggttgtgggtagtgccttcgggaaactaagatctgagtgctagtttattctagatctttcagatcattgctgtccaagggtgtctggatttgtggcggcaaatgtttgaccgaggactcactgaagagcggagataagccacgtacttagaggagcaccttggtggcgagccctgtcctgtaggctgtgcatcagagtgtgagggcctttcccagggtcaagggtggtcctggagtggaagtcttgtgaagcaggagtccccaaggggttggctgcttaaggtacagtgtagacctagggatctgaaagcagggactgcaggtttatctatctgaacttgactcaggagtgcaaagatgtctcctaagcagctgacccatatgcagtagaatacttagctggtctggtcagggaccaggttgaaggactgtagtcttactttcattgtctgtgaagccagagcatccatattccaggccttgaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacagagacacatacacacacacagagatacatacacacacagacacacagatacacacacaaacacagacacatacagacacagacacacacagagacacatacacacagacacagacacacatgcatagacacatacacacacacacacacacactgacattctggcattgtgcttgctgtttgcaattattttaagaccctacaagagctcctcttgaagactgtcatcgtggcaattttgctgacagccccagtgtccgtggtggcttaaacattagcagggtgttccagggaagggtgtcagcctgctcagttgtggctggctgcgacatggaggggaggggaagatggattttgtagcaagagctccttggcctctccctcccacctaggagttgctctgttgctgtaaggcttgtaaagaggcactgggccctcattacagtgttccacctactctttgatcatggctctcaggatcagaacctcaccctccatgagggagaggagctgaactcccaggaggatctgcgcagccttagctgtggtgccactaggaccttgcacatgtggccttgggtggcctcaggtgacctcaggtggtcaccgtggtcctgggtgactcgggaatacccttgcagggcctgacaactgtcactgagtatttttctccttctcaggtttctcctagctggcctgtttgtagaaaggcagcctgatgctaatctttgatgctttctttgtacgctgacaagtttttatgtcgacttgacataagcgagggtcatccgagttgatctcagttgagaagatttcccccaacagattggcctgtggtgctttcttgattgatggtggataggagaaagcccagctcactttgtggggtgcgatccctgggctggtagccttagatgctgtaagaaaactggcttggggtgcaagccagtaagtggcatttctccatggccgctgtgtcagctcctgccttggatttctgccctgtcttctgtcagtggccagtaatgtgggagtgtaagctgaaagaaaccctttcttccccaagt

SEQ ID NO: 866 - DNA, 1977 bp, Mus musculus
acagcctctgggatccccagggctaatgggcatcctgttcttgcagcagggcaccgtgacaaagtctctcaccgtgtgaccaagttcctctgagtgtccagacaacccaggctcaccagctccctccagctatctaccatccatcaggtcagctgccagccccaggctgaacacccacccaccgagctatgacctcctggaggcacgactcccttggggccagcagctcagagcccctcccagtagtcatcatcggcaatggcccctccggtatctgcctgtcctacctgctctctggacacatcccctacgtgaaaccaggagccgtccacccacaccccctgctgcagagaaagctggccgaggctccaggggtctccatcctggaccaggacctagagtacctttccgaaggcctcgaaggccgaagccagagtcctgtggccctgctctttgatgccctcctgcgtcctgacacagactttggaggcagcatagactctgtgctctcctggaagcggcagaaggaccgcgctgttccccaccttgtcctgggacggaacctccccgggggcgcctggcattccattgaaggctccatggtgaccttgagccaaggccagtggatgagtctcccagacctgcaggtcaaagactggatgcggaagaaatgcagaggtctccgcaacagcagagccacagccggtgacatcgcccactactaccgggactacgtgatcaagaaaggcctaagtcacaactttgtgtctggtgccgtggtcactgccgtggagtgggctaagtccgagcatggcagtcccgaggtccaggcatccagtcccctcttccaagtgaatggctacttgactaccaaggaccacggccaccagcccttctcactgcgggcccgtaatgtggtcctggccacaggcacctttgacagcccagccatgctaggcatcccaggagagaccctgccctttgtccaccacgacctgtcagccctggaggcagcccttcgggcaggcactgtgaacccaacctcagacccggtgctgattgtgggagcagggctatctgcagccgatgctgtcctctttgcccgtcactacaacatccaggtgatccatgctttccgccggtccgtgcatgaccccggcctggtattcaaccagctgcccaagatgctataccctgagtaccacaaagtgcagcagatgatgcgcgatcagtccatcttgtctcctagcccctatgagggctaccgcagcctccctgagcaccagccactgctcttcaaagaggaccaccaagcagtgttccaggacccacaggggggccagcagctctttggggtctccatggtgctggtcctcattggctcccaccccgacctctcctacctccccagggcaggtgctgacttggtcatagacccagatcagccactgagtcccaagaggaaccccattgacgtggaccccttcacccatgagagcactcaccaggagggcctgtatgccctggggccgttggctggggacaactttgtgagatttgtccagggcggggccctggctgctgccagctccctgctgaagaaggagaccaggaagccaccttaacattagcctggcaccctgacacccaggccctgaagaggaagagggcttatcacagcccagcgggacgtgagcccatctaaagatttcccatttgggaaccagtctccccagcagaaggggaagacttgagccatgtggatggactatctgccccagaggcatggggaacacaggctgccctaccctcaggcgagatgaggccccaggtgggagcagtagccatagaccagggggcccccttgaaactgtcagtgtgtgctggagtcacagggccagctgagtgtccaacttggagggccccaggcccaacttttcaccatcagatctgtaataaaaccagctgtgcctccac

SEQ ID NO: 867 - protein, 484 aa, Mus musculus
TPTHRAMTSWRHDSLGASSSEPLPVVIIGNGPSGICLSYLLSGHIPYVKPGAVHPHPLLQRKLAEAPGVSILDQDLEYLSEGLEGRSQSPVALLFDALLRPDTDFGGSIDSVLSWKRQKDRAVPHLVLGRNLPGGAWHSIEGSMVTLSQGQWMSLPDLQVKDWMRKKCRGLRNSRATAGDIAHYYRDYVIKKGLSHNFVSGAVVTAVEWAKSEHGSPEVQASSPLFQVNGYLTTKDHGHQPFSLRARNVVLATGTFDSPAMLGIPGETLPFVHHDLSALEAALRAGTVNPTSDPVLIVGAGLSAADAVLFARHYNIQVIHAFRRSVHDPGLVFNQLPKMLYPEYHKVQQMMRDQSILSPSPYEGYRSLPEHQPLLFKEDHQAVFQDPQGGQQLFGVSMVLVLIGSHPDLSYLPRAGADLVIDPDQPLSPKRNPIDVDPFTHESTHQEGLYALGPLAGDNFVRFVQGGALAAASSLLKKETRKPP

SEQ ID NO: 868 - DNA, 38847 bp, Homo sapiens
  misc_feature (1)...(38847): n = A,T,C or G
agaatcacttgaacccaggaggtggaggttgtggtgagccgagattgtgccattgcactccagcctgggcaacaagagcaaaactccgtctcgaagaaaagaaaaacgattgctgcgccccagagtcagaccagtgtttctgattctgtgagtcgggaggatgaagggtgcccacgaacttggatttcaaaatccccaggtgctgctgtcctggcacgccactttcagaattcactgctgcatgtagactaaactgtaatactcccctcctctgacaaagccaaagtggctggctgtgttatcaccccagcaggcatggaggaagggccgggcctcctcctcgtggatctaggtggcgtgcgtggaccagggtttgcagtgaatgaaaggccaggtgtttgcaaagagggcaccagatatggggagccctgggcgacctgcccaggaatcctccatgaggtgccggggcagtactgcagcccatgtatttcaaggatattcaaaccgaaatgtcctgaatgtcaaggataacttgccgagaacaagaggaagaggccttgtctactcagaaaccaggaacttacagaccaagccccaccccggcagaggaaggaaacaggaagtcggaagagaagtctagggagagaaacagtcacgtccaggctaaggaagatgccacatgtcaaggcagaggaatttgcctctcaaagcaggagtgtggctgaatctcagagacacaacatcaaaacaaaccagacgcaagagaggacactctgtgtgattccatttatgtcaagctcagaacaggcaaaactactctgtggggacaaaaagcagaaaggggtcaaaaaactgagggtcccaggccgggcgcggtggctcacacctgtaatcccagcactttgggaggctgaggagggcggatcacgaggtcaggaaattgagaccatcctggctaacatggtaaaaccccatctctactaaaaatacaaaaaattagccgggcgtggtggcgggcgcctgtagtcccagctacttgggaggtggaggcaggagaatggtgtgaacctgggaggcggagcttgcagtgagccgagatcgcgccactgcactccagcctgggcacagagccagactccgtctcaaaaaaaaaaaaaaaacaaaactgaggggccccaaggaaggcttccaggaggctgggcgtactccccgtcttgtcctgggtgatgttcacaggaacaggcatctgcagagattcacgctgctgcccccttcagcgtggaactcatcgctcagcctgtgcctacccacactcagttccacggattcactgcatgtttgctgaggcctccttgtcctgctgggctctggggacacagctggggaggaaaaagtcaccatccctgccctgactgtacagcatcctcagcgacaacacaaacccagtgtgctcagacagcccaaaccaaggtggcttcgaggaggcaggtggaggtggccagaggatgccggtcaggaactcggaggagttagcagggtgagaagatgctttagagatcttagaagacaaggaggctctccccaggagggcgagggagggacttgtgctccaggcagaaaagacagtttgtgcagaaggacagaaatggcgtgtcctcagaggacagtgggctttcagtacggctggaacatgaggtccaaggtgggaacgagtcagaggtccagctgaggagacccgcagggctgggggataggaggtctgtggctcagctgagtctaaacttttcctctgaaggccgggcagtcatcaaagcgctgtaagcaagggaggggcgtggcctgctttgcaggtagaaagcccgcttggtagcagggagcagggggcaggatgctgaaaggctgctgtggaaaccccggtgcagtgggggcagccctctggaaaagtgggtgcagtttctaatacacatcaccctcaccttccctgtggcctagaagtgccgcttctcagtcttcacccaaatgcccaaatgaaaacagatggcacacaaagactcccatgggaacggcccggcagcaagctggtgacagcgagcctccatcgccgggaaacagagctgcaggtgttcaggcaggggacgggttcagcagtgagaagggggaaccgctggtctgcacatcggtgtggtgaccagcagagacgcaatgtcgagccacagaagccaggcacaagagagaacgtcctgcgcggttccatctatgccaacatcgagaacaggcacaactgatgtatgggacggaagtcagaaaaggggttgactgctgagccgggcccggtggctcacgcttgtaatcccagcacgggaggccaaagcgggatgatcacttgagcccaggagtttgagaccagcctgggcaacgtgacacggggcacaccggcaggaatgccttctttttttttttttttttttttttttttgagaggcagtctcactctgttgcccaggctggagtgcaatggcacgatgtcggctcactgcagcctccacctcccaggatcaagcgattcttctgccctcagcctcccgagtagctgggattacaggcacacgccaccatgcccagctaattttgtatgtttagtagagatgggtttcaccatgttggtcaggctggtctctcgaactcctgacgtcatgatccatctgcctcagcctccgcaaaatgctgggattacaggcgtgagccaccgcactcagctggaatgcctttttttttttttttttcccaagactgggtctaacccagcctggagtgcagtggtgtgatctccgcctcctgagttcaaactattctcctgccttagcctcccaagcagttgggaccacagccacacaccaccatactgggctaattttttgtatttttagtagagatggggtttcaccatgttggccaggctggtctcccaactcctgatctcaagtgatccacctgccttagcctctcaaggtgctgggactacaggtgtgacccaccgcgcccggcctggaatcactttttggctcgtctggtctggttttcagagcaggagcctcagaacctcctagccaggagtgcacttacaaagttcctggtacaagccccacccacagcaaggccgcggagatgcaagctccattcccgccgcttctctggacagtggaaaactagagacaaatctagagagggttgcccagaccaaggtaaagcaaagaagggcctccaggcagagccgcgcagtgcagttgcggggaggcggccacgggcgagcccacgccctggaaggacagagcagagaaaccgggtggggaggtcctcccaggtcagtccatgcaggggcctgtcagtgctgggccatcagtctggggtgggcctggggacagcaggaactcctgccggatgttcagtagagcagggcagggtctaatttgtagtatatcagattctggaggtatcagagccttggtagaaaaggacaggactctggaatcctgctttgcctagtgacaggagcccaaaggccaggaaactccccagaatgccaggaggcccggcactatggcttctctgtagagaaaggtgcagatcggaccaggcatggcagctaatgcctataatcccagcactttgggaggccgaggtgggtggatcacaaggtcaggagttcgagaccagcctggccaacatggtgaaaccccgtgtctactaaaaataaaaaaaaaaatcagccgggcgtggcgcctgcaatcccagctacttgggaggctgaggcaggagaatcacttgaacccgggatgcagaggttgcagtgagccaagattgtgccattgtactgcagcctgggtgacagagcaagactccatctcaacaacaacaacaaaaaagaaaggtgcagagtgctcgcaggctgggctggccctgcgtctggagaggggcannnnnnnnnnnnnnnnnnnnatggctcacatgactgtcagttatgtcactgaccctacctatgccagaagtcaaggcctagaatgtttgtggagtctgataagagcagtacacagggtttgtttggtttggtttgttttgttttaaagcagctgtgggaaaaagaaaaaaaggaaagtgatggtccttccccctccagagggacaacgacctctctgtcgagggcaagggactcgtgctggaatggtcacacgcttgttaggaaggaatggaagcctgggcaagggactggagtctgcagacctcctcatgctgcaaagtgacctcctggtatgcaggggacctgggcactcgcccttagggccactgtcactgctgggtcacaggaaaccggcagggcccttgggggcagggacacgcaggtggggctccagttttctgcagaatgagggaggcatgtgcaagaacccagccgtggggactgacagcccttccaggcagaattctagcacatgcttatgggttaggatcctgtatggagaagctgtcacccagagggtctaccctggattccccaggagggccaggccacatgcctgtcattcttgctgtgcctatggactggtcccaaggagggtgtaggcagagaggcccctggtggagtttctcatcctagcctagagtagcggctctcaaacccaagcaagcatcaggaccacccagaaggcgcgtgaaagcgcagatggccgggcccacacccagaacttctgatctactgggtctcgggtgagcctgagaatctgcatttctgatgcgtttccaggtgctgctggtgctcctgctgctgctgctgctccagggacccacacttggagaatgactgccctggagggcagttgttgggaaatgcaggctgcatggcaggaaagtgactggctgcagagagctggatgattaacacccacagggaaaggcccaggatttggtggacagaggtggggggaacccaccgtttacggaggagctaggacgtgtcaggcagcaagccaccttggggaacaggtattactattcctgttatatagatgaggagattgaggctcagagaagagaagcaacttgcccaagaacacccagctaggaagttccagagcttagacgcaacccagagttcctgagtgcatggacaggaccctttccacctagccgtcttccaggaacagagctgttcccactggagacagcatctctaatggtgaaccacagggctctgtcttcacctttggccaattcaaaattattatcaaacacgtaaacatattgacaggctcactcctgtaatcccagcactttgggaggctgaggcaagcgaatcactggagtccaggagtttgagaccaccagcgtgaagaacatggtgaaaccccaactctactaaaaatacaaaactgagccgggcatggtgacacaagcctgtaatcccagctcctcaagaggctaaggcacaagaatagctggaactcaggaggcagaggtttctgtgcaccactgcactccagcctgggtgacacagcaagactgtctcaaaaaaataaaaagtaagtgtatgaaaggcgtgtcaatccatatgcatacagtataaagccaagaggagccacgcctgctgaaaaatgttttaagagttggccaggcgcagtggctcacgcctgtaatcccagcactttgggaggccgaggcgggcagatcacctgaggtcaggagttcgagaccagctggccaacattgtgaaaccccatctgtactaaaaatacaaaaattagccaggcatggtggggcatgcctgtaatcccagctacttgggaggttgaggcaggagaatcgcttgaacctgggaggcagaggttgcagtgagcagagattgcaccactgcattccagcctgggtggcagagcgagactccatctcaaaaaacaaaaaagagtctatcagcaaagtctgaaagcaacgggattcattccttccttcaattaatgtttatggagctaccgttatgccctgggccctgtgctaggcatctgtgatacacccagtgaactcagcaaaacacagaaggtccttgtcccaccgaattgcctttccttaggattattgttcattacacaaatataatggaaattagaattttaaaaactcacataaaattccttggccctagcaatcagtctggcttctttctttctccctgatccctttccagctcctgcccagcggcctacacatcggacgcagcatcagcccggtctcatcatctgcttgtcttattgccgctctgccgcctggttctctaactccttttcttaaggctgcatgatattcctctctgggcatttgcctgtgtttgctgaatggttctcatagttggacacggaagttgctcccagttttttcactattaatattagtattagtattaatgctgcagttgatgcctccttgtctattgtaaccatttctcgattgggtgtttttcccctggaactttttcctttacgattgtaatttgggtccggcgtggtggctcacacctgtaatcccaaaactttgggaggctgaggtgggtggagcacttgaggtcaggagttccagaccagcctggccaacatggtgaaacctcgtctctactaaagaaaaaaaaaaaaaaaaagactgtaatttggggctcagagtatggccacgcttaggatgaaagacatgaaacggccaaggggaaacgccaaattcaaagtccattgagttcaaagtcagtgttatgggaactgagtcagggaaagggctaatcctgcacgcggtgaatgagcaaggtgccgacggggttctctcttccaggtggccgattcagaggccctttgggcttcccgtgagccacccccaccccaaccagggtcatcagcaggcccctgccatcctgctggcctggctcctctgaagatgaacttttcctttagaacctgtggctgttccttcaacggggcaatgaatgtattttacaaaacagatgggctgccaggtggagtgggggtgtgatgtatgtggcacctccacaggccaggcaatttctgggttgcatctcggctcatcctccaacagccgcagggatagaggctctcagcccaggccatcgccggggacaaaactccccatgtccagccacaccccagcccagggatgtcagacccctctgggccggggcctgggtgtcagtgtattttaaaatctccccagcggatcacaatgtgcagcggagacagaggctccgccagcagacaagtgccgctatccccgtctcacacacagaaatggaagcgctgagaggttcagccacaggcccggagtcacacagccgaaaatgacggagcccagtcccagcttgtctgacgccaaagtggagggcttttacacagctgggccggacctcctgaccactcgaactctgcggcaggcacattccctctcccgccgagattctcccttgggttttagaaaaaagagggaggaatcagggaacacaggatgtggctgcctgaagacacgggagcctccgcagcctcacccctgtgcggccaccctttcccaccctcctcctatggctcctcaccttcctccccgttccctgggccctggctccccagctgtgacaccatcttctccagggggcaatagtgaccctgcacccccaccccctggagctgggtgatgctctctcccctgagcagggcgctgacagctcacacccgtgccctcagtggctttgcctccagacagactgaagtctgaatccctttaccccacttcatttcctatggccttgggaaggctcctccggctttcttcgtctgtaaactaaaatcggtattgtaaatatctgctcacctctgtgttctgggagaatcgatgaaacagtgtgggtgaacaggctctgtaaaccttgtggcaccaaacaaatattagttgtttcatgagctggaatggcctgacctcttcatgccacagctccgggcaggacggactgacagccccagctctgccattgaccatgacttgggccacaccttacactcagggcgtccgtttcctcacctgtagtgtggggaagataatagcaccgtgccctcctcgctggactggtgtgcaggtctaaagcacgggcccaagaaatccacctacagtgtgggtggccgtggacatgggcgggcccttcaggacctgcgggctggggcgtggtgaacacggccgtgtttctggacctgtgcctttgcacctgaggcaagaaggaggcttccttccttgctttgctgtatgtctttgcctggaggtgcccaactctgcagctgggttcgagcctcagctctgtcactcacactgtgtggcctcaggcttgagatccgcctctctgagcgtcagctgtgcctaaagagccctctgttcacagtgcccaatgcctgcaggtgcccagcaatggcagagctgtgggagccactggctgaggaagagggaggcaagagacagaggcgggaagggatgaggaggagtcaagagaggccccttcgaatagctctgggatttcttaggcagagagtgatggtggttttccaacaggggcccagggatccattttgataccaagaacaccagggatgcaacctgaggccacccctacccgcttttccctggcttctcagctcccagacagcctgcaggggggccgagggaggccgagggaggcctggggagggggcctgccatccagcaccaggggctgctgtgtgggagctcctccccagtgccaggccccttccttcagcctgcatggatcagctgccaccaccccaacactccacgttggcaggagcagtacacagatggggaaaccgaggctcagaaggaaagcacctctactgaccgcactgcctgcctgggcgcttgcagcactgcagggtgaccaactgtcttggcttacccaggcctgggggttcctgggacagagtgaggctttcagtgagaaaccctggaatgtcccagctcctgttagcaacagtgccgaagtccacaccagcagtgtccaacaaagacccgacgagagccacgtgtgtgtcctccaatgtcccagtagcaaagttaaaatgaaaagagatgggtgaaattaattttaataatatattctttttttttttttaagatggagtctcgctctgtcgcccaggctgaagtgcagtgactcagtcttagctcactgcaacctccgcttcccgggttcaagcaattctcctccctcagactcctgagtagctgggattacaggtgaccgccaccatgccctgccaatttttatatttttagtagagacggagtttcaccatattggccaggccggtctcaaactcctgacctcaggtgatctgcccgcctcagccttccacggtgctgggattacaggcgtgagctaccatacccggcctaattttaataatatgttctatctatcccagtatgtcagatattttccttattttcattgcaacatgtaatccatattaaaattatgaatgagatattttacctttttggtactaattctttgaattctggcatgtattttacatttacaactgcagttgacaaaatacaggctgccagggaaatttgaatttcagataaacaagaaataaacttttagtgtaagtatgtcctgtgcaatattgaagatacactaaaagtttgtttcttatttatctgaaattcaaatttccctggaacctctgttgtcttttgctgcctctagaaaccctcttgtgagcacgcctgaatttggaggatcacgtcacaagctctcaatagccacttgaactcatggccttaaagagcacaaggcaggtccaggggaaccagggcacccactggcacccaagacagccagccccctcaagtcagcctgcaaagacccatttggctcctcccctctctgcagcccctctaaccatcgcccttttgcctgcccttaacagtatcggcctttgtcttagtcaagctttcgaggagcaactcagcaattctgttaccgataatcacctaacaggtaaacaagatggcagggaggaaagtccacgtctcgccccacagttccccatatcagcaaatcttcaaattctagaacaaggtcagggtcagcaggggcagggcaggtttggaggaaggccaggccaagcccaggagaagagacagggtccagggaagcccacctccttcctgggtctcccctccagacccccaagacccccagcctcaggccttctcaagccccagccttaaggagttgagcactccagggtggggggtctctgatcctgggtgcctgtctctctctgcctcagtttacacattcaaaaccactgggaagccacagaccaggcaccgtgggatggggaagtggagaccgagaggctgctgccggggaaatatgcagtgcagacaagaggtacgtcggcggcagctgcatccctccctgccctcatgttcaaaagccctgtctaggtcctggtgtgttggagctgcacattcagagcgtcagagtgttggtcacaaggccacagctggaacagaagcccagagagggaggcttccccccccaggtcacacagcacacctgaggtggggctagacactggccaggagctgaggctcagagcaaggggcttcctgctgcccctccaccatgtggggcactgctcctgagggccccgggaggaaaggaatacgagggcccatttcccctgggtaaaactgagactgaggggccatgcctcgtcaaagcctacccagcctgccagggctgaacccacagacagctcccacctacccagcctcatgcagggtgcagccccaggctggacgcatcacgtgattttgggggcctagtactaaatggaaattcaggatattcatgtcaaaattaacaattttaaggcagtggcagcagagcattaaaccaaactccgggctcttctgatcacagggccctgagcacaggtcacccagggaagcagaggaggggaaggagagacgcagctcagtcccggctccctccccagccctccaggctctctgtgcacatggccccaactgtgcctaacctcttccccaagcctttttcaccccagcttctcattgtgctccctaaacccttacccccagctatcaggccctcccttactgccagcactggcagatacgtacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctcgatccctcgttctgcctgccccctgcgctcttgtgtgctgtcgggtcggcgtgtccgggggggccgcccgcttctcgctggtgtttccttccctctcttttctctcccgcttgttctgctgcccgttcgctctcccgcggcgacgaggctttccccttgcttgttcgcggcggggggtggggggggggagacggtgggtgctgctgcgtctgcgtcggggtcttctccgtgctcttgcgttggtcgccgccggttgcgtcggcgtgttttgtcttgtgtgcctgccgttgtcgctgcgtgtttccgtcggccttccccgtcgtcgttgggtgcctcgtctcgtcctgcccttccttccttctctgcatgcggtgcgtgcgtcctgcgctgcgtacgttccctgcactgccctgcctggcgcgtgccgccaggcccttcccggcttccctgcctacctccgtccgtgccctccctccgtccctccctgcctgcctcccgccgtccctccctacttccctccctccctgccttcctccctccttccccccctgcttccctccctccctggctcccttctgtttaaccgatgttgagtgcctatgtgtcctaagcgctgttctagacactgtgtagagcagtcacgaatatacttccctgcccacacagagctcacattctggtttgggaagagagacaataaaataattcagaaataggccaggtgtggcatctcacgcctgtaatcccagcactttggaaggctgaggcgggcggatcatctgaggtcgggagttcgagaccagccttgccaacatggtgaaaccctatctctaccaaaaatacaaaattagccgggcgtggtggcacatgcctgtaatctcagctactcaggaggctgaggcaggggaatcacttgagcccgggaggcgtaggttgcagtgaaccgagatcgcgccattgcaccccagcctgggaaacaagagcgaaactccttctcaaaataataataattaagaaacagcaaggtgtggggtgtgcagtgctacccacataaaacaggagagaagagcctgggagcaggcttcaagttctaagcatggcagacaagaaggatgtcatttaaaccctcacggccactctggtagagacaatctgtgacttggccccagttttcagatgaggaaactgaggtgcgggccctaaggcagcttgccagagccctgcagctgggaaatggcaaagctggattcgcagcccaggcaggctggtgccagagggcttttggggattggagggtgcagtgaaatccaggtggaatgcgggaactggacggggtttcgccacttaaggggactgttattttaactgtgtgcgggacaaagccatcccctcttcgcttatggcaaaggccaggctggctcattcagaggtcactggttccttctccagagactgagccccagggatgggggtctggctagggggaggtggctgggagggagccccaccctaggccccctggcaggccgcccagcaggggccctttaaggctggccatgaggcaggcagcgtgacacccgcccagtgtgcaagttcattcatcacgggcccctgctgactcacgcttatgaaagtgattttcctggccccgcccactgcctgcgccgcctcctccctccccgtgaaataccctcacttccctctggcctctcagagcctcttggatccccacagggtaatgggtgtcccgatctcgcgggggactctgtgatccgtgttcccctgaccctcctagtgcacaacttggccgggctcactgggctcctgcaccactgcctgtcaggtgagtgtccggggccaggttccggggcagggaatcaggcacatcccaggcacccgtggcaagcccagctggaccggagggtctgcagagccctggcgccaggcgggggtcccgggtggtcctgagtggaggccctcgcctgggttctctggagcccggcaggattctcccctacaccaggttcctcccagatcctcagctgtgtccctgtccaggtgcctggtaccctcagccaagcagctgaagcggccacagtcccagcgtaccctgggccatgtgaccgccgctcctagcaggaaagaggggtgtggccagcccgggcttactgcccagctgttccaaggccactgggtcggcagccaggctgggtgccttctgggtttctgcttctcctgctcaggagggacagagcccttgggtgcccatgaacagcccccatccctggaggtcccagcgacttagcttctctccggaggctcaagagtgcggcgggttgggagggcggcccctgggaggctggggagctgcaggagaccctgggctccaggtgtgcggcactggggcgagggctcgtctgtgataaatggcaagtgccgcttgcgtggacagaccaccccctcacactttagcccccccagggcttcgtgtcactttcttggtctccctgtaatcagctgttttactggaggggagttggcagaactaagatttgtcacatggccgtggtcttggaccctcctagttgacctggggcaagacgcccactcctcctgaccagcttttcttcctctgcacaatggggataagaacacccacctcctggggtgtcttcaaaggcaaaggagtaaatggccactagaggtgccaaagaaacgcagacctacaggtgtcccagagtctcagagcagtttgcagctttaacaacctcagaagtacaaatgccgcacacttgaaagaaacgtcagtcgaaggtgcaactgttttcatttcttttatcctgtttgcctttgtgaaatttgaaacatcaatttttaatgttaacttctttccatcaacatctgccatcttcaattaaagggacttaaaaagataacattaaaaattgattcttccaactccgtaaaactaaaaagcacaaaaggaattgaaatgaaacttttgaactctcttttgtaagttggcagcatatttgtccgaggttatgagtgacagcgtcaagctgcttcggactttggggcgtcctgtgtcactctgaacgggaagtgacttctcaggtccagcccctgggtggtgacctcatgtatgtggcatccagaagcttctgttcaagagcctgaggacagtcccaggagggagccctggacttggagccccaaagccctggtggtaaaccagtgtcctctgctgcctgcaaagggtgggaaggggcagccagttctgattcctcattggccagcaggggctcctgcaaatgcccttcttggggtggtgggaaaatctgaaagaacaaaggaggggcagggcatggcccagggtgggcgcactggggcagatggagcaggttggctcacttgtttggtgaaggggctggggtgcctgggggtgtcagcccacggggatcaaatatcagttccatcgcccaccggctctgtagcctcagggcacggcttcacctctcctagccttagtctcctcatctgcaaagtgggttgctaggaggatcaaaggaggtgatgcggggaagccctttaccaggaggtcccatgctccccagtggctgctgttcccggggaccatgatgaggactgaggggcccagagccattcgagggtatcaggagcaagccagagaaagcactctgagacccgtagtcctgttctccaaggcctctgggtatactcagcacccagagtcaatgagaaatgatcccttcccagccagaacaccaggtcctcagctgtccctctgcctccccgcctgccactagcgctgcgacagagaagtgggggaccctggaacggacactgcacgttccacccggcagaggggtctcagcaggacctctcacagcacttggggcacagagaaggctctggagcagggcggcctgggctctgatccagcccagcctgcaagagctggttcaaccaccttgcaaactataaagggcggtgagaaacgctctggccctcagagtacttacaacaacccgattaaataaggattcaatttgttaacgtgtattaagtgttgagatcatgcctggcacccagcccactccacagaagtatggaaatgtcagccacatgctgtctttgttgttcttgtaactactactactattataattggtggcagcgtccccctgaaatctccccctcaaggcaggcagcctggggtcttgtagggagctgagcatgaagaggccatgtggtccctggtgactgcagcatgtcaccttccttctctctggaaagggaggaggaggtcttcggtgctgggcacacgagcttgcctagacaggacacggaggctgtccctggcccccacgccagtggaggcaagaaaggctatgctcaagggagcagagagcaccgacacaggggtccctgacagaccccttccccgctaggcacatcctcaccctcggagcctccttctcctcacctgcaagacagaggtgacagggctcacctctcaaggctgctgagcgggctggacgctactgcttagatgcaacctccttgcaaactgtagagtgctctgagaaggtcagttgttgtcactgtgggggcgacacataggtcctctcagtggcccatctgtgtggcagtttctcatccctctcctcgggacctgcctggaggtggacgaaggtgtttctgtcaccctgcacacatcagaggccacacactggtctcagctgtgtttggttggccttttaagcatcttccaaaactgtgcgttcattcattgcccacttcttcaactcagatcattcacatagaaatccagattcccactttctctggaagaattctggaggcaggtggccctgggcccccacccctggccactccgggtggtccaagccctgtgcccgcccacttgagtgtgacacctggatgggccctggatctcgagggacaggccgagtggtgtgggtggtggcactggcagggtcttggcaccagtgagccctgggtttcaaagccagctgtgtgacactgagaagtttgtgcgacctctctgagccccgtttacacatctgtgaaatgggacattaatatggccagggctgcacagggtcagcgtgaggcggatatgagaaaaagcatgtcaaatacccggtacacagtaagtgccaaatgctcatcatccctgtgcccacaagggtgttgccttgtggtcctcaggatggcagcatgtggccctcgggtgaggctggtgtccgctgctagctggtgtggggaagaaggtaggtctgatggtcctctgggaaccggcagctctaggaccagcacttgggtccctttgagcgatttgggcctgcggccagcagagggcgcggctgccccagagatggcaggttcaccagcacgtccccaaacctggccactgcttccatttccccaagtccatcccagctcctggggcaggccacagcgctggcccattccctgtggcagattcactccaggcaggtgcttcccgtctgtgatcctactgtgtccctcaaccaccctaggaggtagggactcattgcttccattttacagatgaggaaactgagacccagagaggcccgggaatgggataggaagcaacgtgccagggctggatgacgagtccaccaggccacactgggactcgaggactgtggcccacagaagggtctggcagggctggttcctgggttgggcaggaatggcctctcgggaagacagataatgagtttcggggactgttactgccccagtgagatgggagagtagagtgaggctcggagggacagtggctgcctggggcaaccaggcccgaggaggggagggcacattctgcatgactggggaggggtggggcaaacagcctgtttggagcagaggctgtgtgagagcaagaagggagtcccgtcagatatgtctcatggggaccccggaccagatcctgagggccacaggaggccaccctagctgggaggtgaagtggctgtgtggacacccaggcctcacccgaatggactcttccttcccctctcccccactccaggtccgctgccagccccaagccccccaccagccatgagctcctccagaaaggaccacctcggcgccagcagctcagagcccctcccggtcatcattgtgggtgagtgtcaggccccagccagggaggggctccgctgagccttccgggtaccccccaggtctgagggcaggagctgggcaagtccaggcctggtgtcttttttcgtttttggggtttattttttatttatttatttatttatttatttatttgagacaaagtctcactctgtcgcccaggctggagtgcagtagtgcaatcttggttcactgcaacctctccctcccgggctcaagcgattctcctgcttcagcctcccaagtagctgggattacaggtgcatgccaccatgcccagctaacttttgtatttttagtagagatggggtttcgccatgtcggccaggctggtctcgaactcctgacctcaagtgatctgcctgcctcagcctcccaaagtgctgggattataggtgtgaaccaccatgcctggcccaggcctggcctctttacagtggtctttaaattaagccattgagcgtttactatgtggccagtgctaggcttagcagtttataagctatcattccctttcacacttccgagaacccaggggtctagaacacacccatcagctggaggcgacccggcgtggcgcagggaggcctggtcctgagcccacactgatcccatgactaccctgtgcccagcactgtgctaggtgcccacatgagaggacacacagtagcggcttatgattcctgtcctctgtctgcacaaatggggacagatgaccctccagtatgcaggcgtccaattaagccacgtgagatggtcatttctgtaaggcaaaagcagatgggtgcctgtgatttcatatggttcttcctggtatcctgcatatgagtaatattccgaatcagacgagataagaagaggggaaaggacagataaaaagagaagcgctatcacagggctgtgcctggtgaatcgcccaggaagcgccacagatggcagcgcagttcttcagacgtgcaagcagcagacccaacaggcggctcagcacccctgagcgcccacaagcacccaccactcaagttcgcccccaggccacgtagcaatctgtgctacattcactcatccatctgacctagttcttagcaatctcagaatctcagtcgcgtcgtcagatgttccctctgtctgggttttaatcccggctcgtctatcttccggccgtgtgaccacaggcaagtaacttaacctctctgtgcccatttcctcaagtataaaaggaggaaaagagtggcacttacctcgctaaagctgttgtgaggctgttgtgaaagctctcagtacaattcctggcacagagtaagctctcagcagttgttcattccttctttttaaaagtattattaggcacagtgtctggcacaggctaagggcttaataaatatttatttttatgaatgaaggataaatgaatgaatgcgccacatctagatcaaagccctccacagtagtgtcccccacctgaaaaggccaccccctttaacctccaccctctctccccaggtaacggcccctctggtatctgcctgtcctacctgctctccggctacacaccctacacgaagccagatgccatccacccacaccccctgctgcagaggaagctcaccgaggccccgggggtctccatcctggaccaggtgggtcagcctggggccagagctctgggtagtacatacccgcccttggaaaactaccgccgctttcccagggaaaaacaaaagtgtgtgtttgctggaaacaagactaaacaaagaattcgagagtccacaaagtcagccacggagatcgtgaaagagaaatcagagacccacaaatgccacacgatctagggctcactatgccctaggccggttgttctcaaggaggggatgatttttctcctcggggggcacctggcaatgtctggagacaatttgggttgtcatggcagggtgacggtactaccaaatctagcagggtggaggccagggatgctggcaaacatccagcactgcacaggacaacgagggtggtgagactgaaatatgtgtggtggagcttctcaaccttggccccactgacatttggatgactttgttctggctacaaagaatgatctggctcaaatgtcagtgcggccaaggttgagaaactccaccacagatatttcagtcccactacctcctgcccacaagggtttgcaaatcctccctccgtaccccttgtcttccactgtgctcctccacgacctccccttgtcgacctccctcgtcaggcagtgtacatcctcctgttcccttcccgcccctgagttggagatgaggaaataggtcttgaccatttgatctagatcagcatttttcaaagtgctctctatagaatactagttcctcagtataatatagagagaaaaatgtccccactccagtaaaacagggacacactgggtttggcaaaattaaacaggtaaatgatggctgcaggacttgtcagagcctttaatatgcccgtctgtgttatctgctgttaagaggcagcacctcccaagctgatctgaccacactgatattagggtagggatgtaggaccaggcaatcgctccagtctcacccaagcttgcgcatttggtctgtactctggggcccttggcctcctagaaagacctcaaaacgagagcttcaaactacccccagggtgcgcatctctctgagaccctccagtgccagggaaatggcccggccccagtccccacgttcctgcccagcctcaggctctgggaagacgaccccgccctcctccagcagcccctctgacctatgcccccctccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcacgtgagtggggcagcgagggcatggcttgtggggggctctctccctcgttctccccacttggggctgggactctggcatctccctttcctcattctccaccccgcaaccctgcctctccctcctccctctacccagccccagcaaaggcctcccatgccctctagccccaaatgggttcaggcgagcagaggcctggaccaaagtgttcctttccctgcagtccatcgaaggctccatggtgatcctgagccaaggccagtggatggggctcccggacctggaggtcaaggactggatgcagaagaagcgaaggtgaggccgccccggaacgccttgggggacacggaaggttgggcctgtgaacccagaaaatctgagacaggtctcagttaatttagaaagtttatttttccaaggttgaggacgcgcccgtgacagcctcaggaagtcctaatgacatgtgcccaaggtgatccggcacagcttggttttatacattttagggagacatgagacatcaatcaatatttgtaagaagtacattggttcggtctggaaagctgggccagcttgaagcaaaggcaggaagtggggagggggcttccaggtcgcaggtaggtgagagataaacagttgcattcttttgaggttctgatgagcctctccaaatgaggcgatcagatacgcatctatctcagggagcagaggggtgacttggaatggaatgggaggcagggtggccctcagcagttctcagcttgacttttccctttagcttagtgatttgggggatttcacaggccccccacagtgagcccgtgagccagaggtacaggggcttcagagtgcatctggtctgtcttcctcttcttccagagggggaaactgaggctcagatagggaaaggacttgtccaccccacatgagtgggggtgagcagcagagctgggctcacccgaggaccccctgtcccgtgcaagcagcagaccgccctgtcacatggcccccaactgggcctccccatagtgccccagcctctaaggagggggtaacacctggcccctgagccccacgccctgccccgtgcctctggcacaggtcccccagtccttgtggtctcccttcagccctttcctctattctgagcctggcctagaacaatctttctgggtcagctaatagggtgactttcttttttcttttcttttttttttttttaatgcttttgctacaggtgagtttcatccttaaccatgagcccccaagttgggtaaattaactcacctaaggtcatgcaggttattggaaatgcagaaggaaaacagctcaccccaaacccacacttctccacgccctttcactcctggggtattttttccccatctggcttcctgccccatcatggccaccctagagaaaaggtttgtgaaccctgaatatttgagatgggtctcagttaatttaggaagttttgtttgtttatttgttgtttgtttttaatgaagtctccctctgtcgcccaggctggagtgcagtggcgcgatctcagctcactgcaagctccgcctcccaggttcaagccattctcctgccccagcctcccgagtagctgggactacaggtgcccaccaccacacccggctaattattttttgtatttttagtagagacggggtttcaccgtgttagccaggatggtctcgatctcctgatctcgtgatccgcccacctcggcctcccaaagtgctgggattacaggcgtgagccaccacgccaggctaatttaggaagtttaattgccaaggttgaagacgcacaaccatgacacagcctcaggaggtcctgataacatgtacacatggtggtcggggcacagcctggctgtatacgttagggagacttgagacatcaatcactatatgtaagatggacattggttccgtccagaggcgggacaactccagcagggaggggtgtttccaggtctcagacaggtgagagacaaacggttgcattctttcgagtttcttataagcctttccaaaggaggcaatcaggtgtgcatttatctcagtgggcagagggaagactttgagtaggacgggaggcagctttgccctaggcagttccctgcttgacttttcctttaacttagtgatttgggggccccaagattgatttgcctctcacagtttcaatcactgaataaaggagttctagtccctgctcctcctggggtgcatccactcaatgagaagctgccccagcgcagatacctgggtgcagtctgcctctcgggaagccctgcttcctccgcccccagggctgtgaccaggcctgtgtccccaacggcaggcactccaggcgtccccctccaggcctcactatctctttgatgcgaagactcttctgcatgtttggcaggaagacttccaggtttgtgtagctacatgttagtaggcagccagaaacttacatttcgcttgtaagcacagccttttataggctcattttgcattttcacattgtatcccaagcgtttcatgtggtgaagtcacagcgttcaaaaccatccttttacatggcctcacaatattcccaaaggcgagtgagcatccccagtccagcaaatcttcaccgaatgcttattatgtgccaggccttgggcttagacgtcagagcacaaaaccaccgcagacacaccccctgcctcatggcactgccaaggttacccagcccctgccagccctggagcattcattctttccattgtgtcattattataaataactctgcacagaacatgctcttgggaccgttctgtgtcacaatctttacaaaaactgagaaaagaatgactgcccacagagataaattccagggtcgcagacgggctgcgctgggttgactggcacggccttgggggtccattgtcagctcctgctacatgtagccggacggcaggtggcacaggattctcccgtatgggagttcatcttgaaccatgagcccacaagctgggtagattaactcatctaaggtcacacagtgagatacaggaaggtgctagaatgatgcaaagcctgtcattcaaccgccacaagaatgggcctgcagtcactgcccctggaaagagtgacaatccaaacaacaacaacaataatagaatacctcctgctgctgcgtgggctgggaacgatggtgagtgcgtcacatgggagtctttaaatcaactttaaatcaactttttgactacatataggctgggtgcggtggcgcaagcctgtaatcccagcactttgggaggccgaggctggtggatcacttgaggtcaagagttcgaaaccatcctggccaacatggcaaaaccccatctctaataaaaatacaaaaattagccaggtatggcgctgcatgcctgtagttccagctgctcaggaggccgaggtatgagaatcacctgagcccgggaggcaggggctgcagcgagctgagatcacaccacggcactccagcctgggcagcagagtgagactctgtctcaaaaaattaaaataaaataaaataaaataaaataaaataataaattggctacatatagaaaagtacgtaactcctgtgagtacaggttgatgaaatttctcaaggtaagcacagagaatgaagaagcaggccccctcccagaagcccccatgccctttctgatcaggatcccattccccatccccggaggtaacccctctcttgacatccagctccatagatgagttctgcctgtttctgaactctgtaaaaatggaatcataccatatttaatcatttgaggtgacaatcatggtggcctatccttacatggcacttacttccagtcaggttccatcctaagcactttgtgtttgtcagctcaccaaatcctccccacgacctcacgaaataggtcctgccaccaacatcttcctcattttgcaaactggggaaacagacacagctccctgatggcagagtcaggattcgagcccaggcagcggggctctggaggctgccctctgaaccccaccctacaccaccctagagcatcctacaccaccctacaccacctctcctgagggaggcacccttgttagctccattttacagaagaggagactgaggcttagagaggttgaattacctggcctagtcctacagctacagcctagtccagctccagggcctgacactgccctggacatctcccgtcccacccagccccccaacccctaacagtgtctgactctggcgtcctgcatcctccccaacagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcggaccctgtcctcatcattggcgcggggctgtcagcggccgacgcggtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcaggggctgactttgcagtggatcctgaccagccgctgagcgccaagaggaaccccattgacgtggaccccttcacctaccagagcacccgccaggagggcctgtacgccatggggccgctggccggggacaacttcgtgaggtttgtgcaggggggcgccttggctgtggccagctccctgctaaggaaggagaccaggaagccaccctaacactcggccagacccgctggctcccaggccctgagaggacagagatgaccacatccctgctggatgcaggacccgtccaaagatgccccggggaggggtgtcagcccacgttgctggcctttggggtcaagaggagtagggatcccaggctgccctggacttagaccagtgtctgaggtggtaacagcggccgcaggccagggttggcctagacctgggatttgtggggaaagctgctggtgtgaccagctgagcacccagccaggagacctgcagccctgcgccttccagaagcaggtcccaaataaagccagtgcccacctgctctcatgcgtctgaggactctgtgctcggagggagctgcgttcccggaaccctgcactgggctggggggaagggaggaaaggggattgtgggaggagtcctggggcatgtggtcctggatgaggtccatggctggggccttggggtacaaaggatggtgccccaagtgtgggggcagttgagcgggcagctgtactagagtctgggggtgggagtggcgggtgtgtgcaggcagtgatgtccaggagggcgctgcagccccgccccctccgcagcctgtcccaggcctccctcctctctgttctgccatgcggcctcctttcagtccctcctgctggccaggtctctgcctgccccaaggcctttgcacagagagtccccagcccaggacagtttcccgcctttctttaactccttttccttgggatgtctcagcataagaatcacttcctctaggaagcctcttctgacacaaacccctccactgccgtcacagcaaatactcctttcatggtctaaggtgctaccttttcatagcagtgcagtttttttttcttttttttgagacagagtctcattttgtcacccaggctggagtgctgtggcgcttggttcactacaacctctgcttctgggttgaaatgattctcctgtctcagcctcccaagtagctgggattacaggtgactgccacctcgcccagctagttattgtatttttaatagagacggggtttcaccatgttggccaggctggtcttgaactcctgacctcaagtgatccgccctctttggctccccaaagtgttggtatcacaggcatgagccaccacacccttccagcagttcagttttaattgttcatttgtttgtggaatcatttcagtgtttggctctgcccacttggatgtaagctccaggagctctgggagaccaagtacaccatctgttttgcccattgctggaactccgtggttgggcacctgcctggcacctagtgggttctccttaattcatcttttaaatggatgggtggatggatggatgggaggatgggtgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagccccctctgtggctgcgcccgcgcccctcgccccggcgggcagtcctcaggccccgcgcccggccggcgggggtgggggcggcggggagcgggcacgtgctcggggtcggccggcccgccccccggcgccggccagtccccgcggtgtcgcggccgcgggggcagcgggagagagggcggggcggcgcgggcagcgcggggagggggtcgcgcgggggcgggccgcagctgggcgggggtcggcgggcttccgggcggcggcggcgggcgcggcgcgatgtgcgagcgggcggcgcgcctgtgcagggccggcgcgcacaggctgctccgggagccgccgcagcagggccgggcgctgggcgggctgctgcgctgggtgggcgccaggatgggcgagccccgggagtcgctggcccccgccgcccccgcggaccccggcccagcctcgccgcgcgggggcaccgccgtcatcctggacgtgagtacgcgccggccgggaccccctgccgtggcctccgctgggacccggagccccctccgcccctcgggcggaccccgacgccgcgacccgcgaggccctccctacccgggcaggagacccccggcccctccgcgtgccggagcgggagcccccagccccgccacgtccaggccggtctccagcccagtcctctccctggaccgggagacccccctcctccgcccctccaccggcgcttctcggagtccctgcctgcccacagtggggagccgtgagcccccggacccggccactgtccccctagttttgtccaagccaaacccccaccctttaccccgcgggaccggagcccctcgccgcgtccagccgcctcctcctctccatcccggatcctgtccggagcgatacttttctgagacccctaacaacccctacctctagcccacctctcttcgccctagaccctgagcccccgttcatctcacgctcaaagaccctttgccccagctactgccactttaaaagtgaagccccctccccaccttctgtcttctcgtctcctttccattgagccagagccatcgcccatcagccctgagctggtacccctctggtcttccccaccccgcccccttccattccaagtcctctgttcccttccccacacccctctaccctacagagagctgggtcctcttcatggaccagactcacccctcacccctcctaactcccctgggacccaaatcacccatctctgggaagcccacctcaccctcccacccgccccacccgggagggaggaatcttcagggggcggctcggaggaggaggacttctcccagcagagagtgctaggaggaggtggaggaggcttctggggatgttgactgcgtgtttcagcgagggtcctgctggggtggggctgggggctgcctctgcctgtgtggtggatttctgggagagtggtgggtgtgtgtgaatgtgcacacgcgtgtatcgcggatccctgtgagtcgggggattccctcccttcctctctcctcttccctgctcctggaacccttggccggggtctgggctgggagggccggccagagcagggggagctctagagtgccacactcgcaggcacacattcacacactcacgcactcgcttacgcacgcacacacagccagagacacacccatgcagccaaaccatcccctcctcaggacccccgcagagctcccactgaaagtcctgggcagagccctgcagccccaagctgccctgcatggaagccctgcccagtcagggtgggggctctgaggttccatctcctcacctgccaaaaggagtgatgagcggggggtggggcgggaggtgctcatgcagactcctggagctggctgacattaccaggtgtcagccctgccatgtcactcatgtgttcagcattcctgcccagagccggcacctacctggtgcctggcctcaagggggatctgggacacccagatagggaccccagttttgaggagccttgcccagtcaggaacggggctgcggggtgcccaggctggatctttgaggagggcttggggatctgaggttcagccaggaggaggggtgatgtttgagaggccctcccatagctgtgcttcagtctcaccgcccaggtgcctagaaatgaccaagggtgccccctttctcgttgcctggagggatggggggcgagggcatctgtcctttaccccaaggcgaggacagagggtggaagggtcagagtgagtattacctcctcctcctccatggctgacctggccccagcagccctccctggtgtcgggaaatgtgtacatgttgctgcctctccctgggtctcagtaccctccttgttaaaacaagccactgagattggggtgggggccaccgcagaagctgggatccttctcaggctttaaagtgctggtgggcagggcgccgtggctcacgcctgtaatcccagcactttgggaggccgaggcgggtggatcacctgaggtcaggggttcgagaccagcttgaccaacaaggtgaaacctcgtctctactaaaaaatacaaaaattagccagttgtgatggcgggcgtctgtagtcccagctactcggaaggctgatacaggagaattgcttgaacccgggaggcagaagttgcagtgagccaagatcgcgccactgcactccagcctgggtgacagagcgagaccccatctcaaaaaaaaaaaaaatagtgctggtgaatcagtccccgtgggaactggttacagtgaaaggtctgactccactacagtgcagagtaggtgggacatcctgcattgcaaacaagctcctgcaggacccaaacagctcctgtgaatagcaaggtcttagcgcacaggtgtcaacattgggcctgggaggctttaaaaatgctgaaatcagagtgggcctcacagcagctgattcagtcaccctggggtgtggcccgggctgaggaggttttgaaagctctccaggcgatggtgttggaaggggcggaaagctgccttcgagcctcagcctggcaagcagcacctgccagccagaccttgaggaaaggggagcagctctgtcccacggattcagatgtcactggaaaggcagaacgaggaggcacctggtcttgtaggttcaggccagccttggagctgccctccacccatccctgcctaatgcagccggaacttcgtctgcggctgcttttctgaactcttggcgtcctgtttctcctcctgcaccccaaaattaacgcagtcctgcccgtggctggcattgtcaccaggccttgcaaacacctctgtcggactttgcccaacctccctggaaacacaccaggggttttggaaggactgcagtggtaaaggttgtggcgctccctgggacactgattcggagtgtggttgtgtgcagctgagcgtttggcggtgggtgaagccacgtggactgatgactgtggacctacacctgcagggatggccgtgggcctgcgtgtgtgtgtcagcgtggctgggagcaggctggtggtactggcagccgcttccacgtgggtgaggggagggcctctgtctgcaacatccctcatcagttccccctggatcccagcccggggagggggagagggaaggggggctcagcttcccaggaccctaagctgctcctgggagaagagaaggatcccagtatccggtcagaggctgcaggaagcgcttgcctctccctggcccagggctgactccgcctctcttttctgcagattttccgccgtgcggacaaaaatggtgagtttcccttccaggccgacggccgccccactccttctgtcctcgtgcttcatggggaagggatcagggataggagacaagcgcaaccttgaacctaaaggtttggagtgcaggggtctgaagttagaaggccaaatcctgctgctgctctgtgccttgacctccctgtctgtaaaacgggaatcctagtagggcctacttagtagggacagctccactcaagggctcagtgagtcttgtctgtgatgccaagaacaatgactggccgtggtaagggctgggtgtactttaggccttttcctagctgggctggaccagaggagcccgggctggggcccagaaaccctccttgaaaggaagccgccagcctcacgctaggcccttcacaagccttggtgcagttcttcatcgtagcaacctgagcagtcagtgctcttgcctctgttgacaccatagcagcccagagaggttaagcaatttgccccagggttgcccagctgcatgaaggaaacggaggctctcctgaagaccggggcccttttccctttctctctcagcctctttaaaaatgtgagcagcgccttgttgtggccacggaattcatagcgctccacttctcccgactccttggaggggcttcacttgcagaaggagcccaggccttgagagaataagcacgtttaggcggcccagctgagcctcggctgacaaaaagcaccttcttaaaaataccagaatcattattacagttgcaacgcaactcaccgtggacttgaaccaagacagattccctctctgggccttggttttcccgtgggtaaagtggggcaataacacttgccctgcctccttccctgggttttggggaaaagccagagaggcggtgtgggtgacaaatgtttttaaagagaatcgcgtgctcccggtatgttcattcattgagaaaatgcacatcaagtaccaagcctgtggcaggggaagagcacgcaacagagaccctgtgacctgccccagggcccttggtccccaacgcctctggccccggttcctctcctgcacaagctgcagttgagggtggcagctctggcctgggtctccagcacccgcctcatccctgggagttcctgttgacggctcccacccagggcggttgcagggtggagttggaggccttgggcatggtgggagggcaggtgcacaggcctgggctggaatcagttccaacgagtctcccaccctggcctcctgcatccctggggggtgacagtgaccactcccaggcctctggggaagaaggaccatcagcagtgattccatacggagcagaggaggaataagagggacgtagggagatgaagtggctctggaaaaacagccgtagcatcatggcctgaaaagccttggagatgaggaggggaaatcagggggctgtccctgagatggggtcgccggagccctcagcgtcattgcctgtgtgctggcctggctcctccagcaggttgagaggtagggatttgggtttgtcccttgtcccgggcctgatacccagcacacagtaggtcctcggtaaatgtctgtagacttggtggacgtgtttgttggtgagagcgtggctgtgcgtatctcggtgactcagcagcgtgaggctgttgggaatgcgtgtgtccagcgtgggcctctagccatggctgtgcatcccgagtgtgtgtgcagttagtgtgcgtgtgtggcttcctgagtgtgcagctctgcaggagccactgcagtgtatacacttgggcaggtggtgcctggccccctcgggcacagatggggttctgtccttgctgcaggctccccccatcagaggccatgtgtccaccccctgagcacagctgtgggactctcagtttccttactgcagcctcctcaaaggccgagcctgttccttctccttggggcttacatcttaccagccaccactatgtgaccgttaggggctgtcaccagggtgaatgtgggtgtgagatgcgggttccagcaagagcttcccaggtcccccagcctgactgcctaggctcaagtcctggctcagccgcgtaccggctctggcctcaggcaagtcaccaaattctgcagtctcagtttccttatctgtaaatgggaataattacagcacccacctcagagggctgtctgaggatagatagttgctctcctggcttcgctcattgaagatatcaataagtccccgctgctctgcctcaaatgcctcggaaatgggagtccgcaggtgtggcttgtccagaggggtttgattcctctgtgctcagcagggaattcggtctgggggaggctgccagcagtcactgaacgtctgttatgcaccaggacttgaatgtgctttttcctttaatcttcattgtgatcctcctgagacaagaagtatcaacccccaccctccttccagatgacgaaaacaaggctcggagatggcacgtgatattcttcacatggtcggggggcagcggtgcaggcaggttctgattcaacacagcagcttaaaagcttgtaggagtggggatgggacttggtgtgggtatagataggggagtggtgtgggaatagaatggctggggaaagaggaatgagtgtaggggtgagaataggtgtcaaggaggtgtggatccaagaatgagagcaggtgtgcagggaggtgtgggtgcagggatgagagcaggtgtgcagggaggcgtgggtgcggggatgggaacaggtgtgcagggaggtgtgggtgcagggatgggaacaggtgtgcagggaggtgtgggtgcgggaatgtgaaccggtgtgcagggatgagagcaggtgtgcagggaggtgtgcagggatgagagcaggtgtgcagggaggtgtgggtgcagggatgagaacaggtgtgcagggatgagagcaggtgtgcagggaggtgtgcagggatgagagcaggtgtgcagggaggtgtgggtgcagggatgggaacaggtgtgcagggaggtgttggtgcggggatgggaacaggtgtgcagggaggtgttggtgcgggaatgtgaaccggtgtgcagggaggcgtgggtgcggggatgggaacaggtgtgcagggatgagagcaggtgtgcagggaggtgtgggtgcggggatgggaacaggtgtgcagggatgagaacaggtgtgcagggggtgcagatgtggaggccgataggcccacaagcacacacaggactgctcaacactgacgctagccctgcctcacgtgtccacaggaaggatggatgggatgcctcaggggagcgggagatggggtgcaaactcaaaggaccccccaggctgcccttaggacttagagattacaggaacaaaggctcagggctgccctgtcagggtggctcctgtgacagagacttgtttggctgagctggataccggatgcccagtccctatgggaaggttagcatgaggggcctgactggcagcctgggacataaactcagggggtggcagagggctgagtggcagacagcatttcccttcagggacatggacgctgacaggctgacaggctcttggcatttgaaaggtcatggagacagagagtgagtttgtgctaattagcaaagacacctgcaaacggcccgcttggggtctctggcaaaagtgccagcgcgggcccgcttggcctgtctaattggactgggggcctacgtagggcatgttttttcctcattagtgaattcattagggccgtgatcaggcgttcaggataaatgtcagccgaaagcttagtgagggggcaccttgctggcctctgtctgcctgctctccctgtgtgccgagggggcaccttgctggtctctggctgcctgctctccctgtgtgcagagggggcccaaggtacctggacaggcacgtggggagatgagccagccagagggaggctgggattggggctcacaacccctgtcatgcccatggtgactgcccctcacccaaagtgggggtgcctgagccagcacccaccccctgctgggtaggtggcgatgt

SEQ ID NO: 869 - DNA, 1898 bp, Homo sapiens
cccctctaaccatcgcccttttgcctgcccttaacagtatcggcctttgtcttagtcaagctttcgaggagcaactcagcaattctgttaccgataatcacctaacaggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcggaccctgtcctcatcattggcgcggggctgtcagcggccgacgcggtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcaggggctgactttgcagtggatcctgaccagccgctgagcgccaagaggaaccccattgacgtggaccccttcacctaccagagcacccgccaggagggcctgtacgccatggggccgctggccggggacaacttcgtgaggtttgtgcaggggggcgccttggctgtggccagctccctgctaaggaaggagaccaggaagccaccctaacactcggccagacccgctggctcccaggccctgagaggacagagatgaccacatccctgctggatgcaggacccgtccaaagatgccccggggaggggtgtcagcccacgttgctggcctttggggtcaagaggagtagggatcccaggctgccctggacttagaccagtgtctgaggtggtaacagcggccgcaggccagggttggcctagacctgggatttgtggggaaagctgctggtgtgaccagctgagcacccagccaggagacctgcagccctgcgccttccagaagcaggtcccaaataaagccagtgcccacctg

SEQ ID NO: 870 - protein, 523 aa, Homo sapiens
PLTIALLPALNSIGLCLSQAFEEQLSNSVTDNHLTGPLPAPSPPPAMSSSRKDHLGASSSEPLPVIIVGNGPSGICLSYLLSGYTPYTKPDAIHPHPLLQRKLTEAPGVSILDQDLDYLSEGLEGRSQSPVALLFDALLRPDTDFGGNMKSVLTWKHRKEHAIPHVVLGRNLPGGAWHSIEGSMVILSQGQWMGLPDLEVKDWMQKKRRGLRNSRATAGDIAHYYRDYVVKKGLGHNFVSGAVVTAVEWGTPDPSSCGAQDSSPLFQVSGFLTRNQAQQPFSLWARNVVLATGTFDSPARLGIPGEALPFIHHELSALEAATRVGAVTPASDPVLIIGAGLSAADAVLYARHYNIPVIHAFRRAVDDPGLVFNQLPKMLYPEYHKVHQMMREQSILSPSPYEGYRSLPRHQLLCFKEDCQAVFQDLEGVEKVFGVSLVLVLIGSHPDLSFLPGAGADFAVDPDQPLSAKRNPIDVDPFTYQSTRQEGLYAMGPLAGDNFVRFVQGGALAVASSLLRKETRKPP

SEQ ID NO: 871 - DNA, 164841 bp, Mus musculus
  misc_feature (1)...(164841): n = A,T,C or G
cagctattctggatcaaactcctctccaagctgactgattcaatctggcttctcttggcttcccactgaattattctgcttggcctctaactctggctattttaatctttgggctccttgttctctgattattattctcaatggctcgtgcttacctgcattgcacgagctgcactgactcaacttattcaagggagctccactgcattgcctaaagtcaactcaactgcactcactgaactgccctctccctgactcactctgtgctgttcttaagtagcttctcttttctgtctgttttcttgagagggagccatatcctgtttctgactcattctgttaaatccttctctgattagtcacttgtctgcccctcaataagaagtaactttcaaacatggctgcttccttttacaaactaactttactgaagtcactttttgggattaaatgtgtgtaccaagggcatgtctgtattccaaccagattctactgtattccagggtgtgcctgcattctggcttgactgtatctttggctgtgattccttgcctgagtagccatgatactgggttaaaattcctctacaatagcaactgtgcagctctgtgctccctgtccttctaaagaccacttgtcaaaatatgagcagttctttctgtgggaagcctgactttccctttgaaagtaattaattatatctggttttctaggcaacggctccatcagtttacttatgctcagtttttgctgcacagtaaagtgcaacttgaaaaatcaagtttcaagttctaaaatttttgaatctactgttagtatctcatctttaaatacacttaatatcccagaaattgtcaaatgtcaaggaaatccttataaatgaaacatgaagacaaagcacagaaagattatgctttgaagataaagaatctagatgtgaatttaagattttagaaagagtgagagaggcaacggaaaacatgttagatgagttggaggatcaagttgagaaataagagagcaaatattggaaaattagaggttactataggatgttcaatatttgaataatagctcggagagtgaaataaggagaaaatgaggaaagcatgcataccattagaatattttcaggtatgaaagatataaatttgctggttgaaaatcccagctcgttcctagaaaacccaatgaagcaaattgccactccagtatctattcagtgcagctacagacccataagcttcatggagcaaactcagcccaggagcctaagcaataaaaataaataaataaataaataaataaataaataaataaaaaatcatagtaagcatgctttggcctcctaaaaagaagtccttggaagttacaaaaggtgatactttaaaaatttaaatggccaaatggaaatgaattcagtcttgaagtttatagtgagccaagcaaccagttgtaagcatagattagggactttttttgtccacaaaaaatttcagtaagtccttacagaatgcacctcactgtggtgaagacttaaccaggaaagaggaagtggtgtggttggggaagggacatcctggaacagtcaccaaagctaatgccttggcagctctggtagccttcaaaggggaccttatagggctggtgagcaggaagacaggttaatagagtcaaagaagggactactggggtggggggacaaggaaccagtcagagagggaagggcacagggaaggacaggagggagcatgaagatatatatttgaaaatactataacaagacttgtcactttgtatggtaatcatttaaaaaattagaagaatgtcaccataggaattagagcctacactgctaccacaggactgaggatttgaagttctggaaggaaagggaagaccaggaaaggcaaaagtctgagctatacatataagtactgcatgtggtaacaggagtgggatttgtgggcacaacagagaagagctacagttcttcacagctgatctccagtggtggtcgtggaatgaccaggagtcaggggggaagtttaaatggagagccaaagagagtgggtttaagctactctgtctgtggatctcagcatttcttcctcattacttcattctggaaataagattcaaataggatgaaatattttatttctgctgcttggaccccaatttcatgtcagtctctctctctctctctctctctctctctctctctctctctctctctctcatccaactctgtctcaaaatatgcaggtggagaattggggaaaattgttcccacattaatccagatgtcacagtatatatcatattagtttgtctcttcacacgctggcatgcaatggacacctcttaatcacattaaattcccaaacacaaaggtgaatttatgcttccacatacaatgactacatacgtacatagagacatgaaatgtttgcagaagagaacacatcctgctggcatggctctttgtctggtgatagcatctttgtttagctacaccacactgtctgtgtcataccttatgtttacttcttttggtttactgaaatgaggttttgctatttagcgtggctggtacaacattgactatgtagatcaggctgacctcaaacttttgacagttgtcaatggtacttggaatacaggcatgcatcacaacacctggcttatacttttcaatctaaatatttggataccaagttaagtacaatccacacttctgtgtgatccagcagaataataagaacaagcaaatattgatatttgatacctgtataaagtaaaaagactatttattaccatttaatctgtttttataactaagaaaacaattttatctattatactggacagtcaataccttatctgatttgtataacagagaaacagtatgtgtggcttataactataacttcaccacagaggcacagctaggtttgagccagttcatagatccagacttctttaatagatgaagccaaatctaaaactataaatctttctcctgtccatcctcagtaagagttagtgttattagatgaccatgttcaagaagggaaaataactagactttggggggaccctcagatactactttaaagctaatttttgatgcccccaaatattatcaactgtggtctaccacaaggagggttccaccacaaggaggggtgtttatgaacatttggtctgtctgtctgtctgtctgtctgtctgtctcactcacttgattctatctcccagtgggactagtcagcccccaggttcatctcatgcttattttctcagttctattttgaatagagtagttgtcttcaggaactcaaagaaccccctattagttttcttactaatgtatattttttctattatatttaaaacatttcctccatattggttcaacatagtggcttctagaaatccatttaacatttcaaggtaaaatacacctaaaaagcaacaaaaccacagtaaaggtaaaataaagatggaaacaaactggaagaagcaatgagggtagcacaggaactacctgccaagagctctcactcacttgctgagggtgagctgtaagtctgcctgcccttgaagatggtgtttgaaatggtgtatctgccgtagatgctaagactgagaagttctggggaggatgttatctgctcagttgtttatcccagccacaccacaaacagattagctattgtgcaaacagagtggaagagataccccattcatagcagtgaaaattgaacccaagtcttagataactgagaatctccatgtatctcttgttttcacaataatgtttgcttccaaaagctgcagtcacacacaagaatactgaagtgatgcagttaaaaagtgtgtgggcacagacgattagagaagggaaataacttcaaattttcaggtcagatcttgagcttgctctagtgatctggtctgatctggattttctttagaatcaacaatatggccttctaaattatttccaggagacggagaacaaaatcaagaaataggagttatcacatcagcatagagatgagttctcaagaggcaggactagcttttggagaatcaaacatttatacattttaaaaacattaaataagtaattatggtgggactttttaaaacaacaagttgggctagataagaactgatctgtgacgttagtgaaaatttttcttattaatttaatttatctatacaaacataataaatgagcatgtgccatctcatgtaggtaggaaaacggacatttaacatatttaagaggaaaaattttcataatccatactgacacaatgtcacaaaatgccaaaattgtcccagcctgtaatactacatgtacccttaacaaatatcaacaatgaataaaaacattgtgggaaactttagtctgaggctatgaatatctgataacataaaagataagagactctgaatcagtcagtgaatgaaagcaagagtcagtgccaaattcaaccaaatctgtgaacataaacactcaagattcagaaaaagctgagtctgtcctaccctagccctgtcctgcagacaggagatcaatcatgagcattctctgtatgctgcggaaactatgcgtctgccacctcctgaatgtgactgtgaagcaatgccatgggcagtattctgccagctgtagcctatgtgaggggaagactgacaaactccactccagcacattctttaaggttttcttcatttatactaatatacataaaaaccactctgaaaaggcaaaagccaaacagaaaagaaacatactttcaactcaaatcagaagacataatttgtattaacaggctacattttacaacacaaaagacagtacgaagacaatagagaaggaatatattacatcttcagagagataactgaaaaggaaataaaatgatttacacatactaggggtgcatggttttgtttaaaagccaagaattactagttaaaactttgctgcaagcacactgaaaaaaaaagtaatttattcttattttatgtgcgatcatgttttgcctatatgtatgtctgtgagaaggtgtcagatccctggaactagagttaacagacagctataagctgccacatgggtgctgggagttgaaccatagtcatttaaaggagcagcccatgctctgaaacactgaaccatctctccagcccacaaagccactttggttactaataattaagaaatgtattgttggggccggagaggtgactcagcagttaagagcactgactgctcttccagaggacctaagttcaattctcagcaaccatatggtggatcacaaccatctgtaatgagatctgatgccctcttctggtatgactgaagacaactctagtgtactcatatacataaaataaataattctttaaaaaaatgtatgtattgtttgttttttagtgagaaagaattttcatacaatgaaatatcattaaatctttatggaagcaatttgaagggaagagaaagagagagagagagagagagagagagagagagagagagagagagaggcagagacagtgagagacagagaacacaaaggtatatggtatatgcaactgtccagttcaactttcctagttttaggaatttatcatgtaaaatcatgtgaagcagtactttttaaaatcagaaaaaaagatgacaatgtaggcaattgactaaataaaatgcaaatgtacatgattttatgaaaggaaaaaaaaaatgacagtgaactgaactccaaggcacacttaaaacattgaggtctgaattagtatccatgtcgctccaaagagagacactaggatgcaaaagaggtaagaacacatggataaatgtacatagcttcacatatatgtgagcatacacacacacacacacacacacacacacacacacacacattgattggcaagcacaaaaatagctaaaggatttacctctgaacatctactcaaatgtgggaagctatacgaaagtaaaacacactctaagaaagagaacaggctgcctgggagagggaggtgccaggggcttagacaggagggtagttttcaaaaactgaaaacttaagctatctgaatgaatgatacaaaataaaagaagacacaagaatttccagccacctgagatatctcacactcctgttctttcaaccttctagctgaaaggagaaagagccatgagaaactgttaaaggtaagaaaatggcatgcataaatacacccacttgattgataggcacccatattttattaagactatattcagctctggaagtgtggaagtggactcataactcaaaaggcttttcaagaataaactgtttccaaggggagagagccattctgacagcagtgaataatgtggagtatgcctcatcagtgtgttttgtaaacaaacactgggcacacacctatttacaaagctccttaatgaaaccagtcaactagaagaaaatatctcttgtctccagaatggagtgactgtgaaccaccagctctaacaacagcacattctgagcttagaaacaaaagggagcaaagacacgtacgggattaagatctttcacagtttgggatccagtgaggctatgctttaagtgggagaccgatcctagattcttgaaataaatacttagtgtggggacaaggaaaagattttatacagataagtttgtggcaaaaatcaagcgtaagtctttaaatacagctttgtgacagactttaaggttctgttctatcctttacaaagatggaggagaccagaatatgatcaaaaaatactcaggcatcttttctcccagtgtctatctttgtgtgtgtgtgtgtgtgtgtgtgtgtgttattaaacacatttgaccataggctgcaaaagtgatgtgttaaattcttttctcacacattggacactgaagctggccactctaaaatatttcaggttaagacagggcaacccaaaggagcgacattctgaagtattgggggataagcagcccataaatccaatctattcactgatgactttgctctcagacaccttagaccccatggcaaattcctaaaagatggattttaggtagaagaggtgaaagggaacttgatctaatttcctgaaactactgccaaagaagtggagatccagataactgtgcaaagtaacccagtaacgtagtgcgacatacccttgtgtttgtgctcatttgaatggttgctgataaatgcatcacgcttaagtgtgttcagagctatgcaggaaccgagaagcttattcagggaagcgttttctttcctcttgaatttcatccgtacagggcagcacactgggtgagaggagagagtgctgcttatcaagctggagagagaatagcctatgctgagttgtttccagtcatttccaaattttgtgataaaatgtcaacagttaagaacactgtgtgctcttccagaggactgagggttcaattcccagcatccacatgtccactgacaacggtctgtaagtctattccctggagatctgacaccctcttgtggccttgaaagggaccaggaacacatgcaacatacttgcacacacgcaggcaaaacaccaacacacacacacacacacacacacacacaaacacacacacactaaatatatatttttttaaataaaagttgaggatttgagaagctgggtcaaagtaactgcttccatgtgtcctgtcagaagtttgcaccctgtgggcaagtctcatggctcaattttcttatcaaggaaacggcaccagtaacttcaactctggctcacttagtcgttctcagggaccccaattcctagaacagaaatatcacagccaaatagtggagtgattaataaacatggctattaaagcccccattacttctatatgattcttcagttcaaatttctgagcccatgcagaaactgaaggaacaaaagggagaattgaaatagtacaaaatgttattaaggagcctgggctgggcatgtgtttgtaatcctagctcttaggtggtggaggcagagggattgggaattctaggtcagccttactaggatgagttccaggttggcctgggctacaacccaatctcaaaaataaaaccaaccaacagccactaaaaagctacagtaacaacgtgcctagtaacacatttaaagagacgtctatattgccacgtctaatattatagattcttatcttttgctcaaagaagacatacattatttccctatattgccaagtctaacattatagattcttatcttctgttcaaagaggaaatacattattcccaatagcagtgaatgtatggcagacgatttcactagattaaaattggtagcacctaatgtttttaatgagtgatatagtaagtagttctccaactcagggcatttgaagtttaattcagaccttgggaaacaaaggaggggtaaaaattaagaacaaaacaaactagtggtaaacattcgatttctgaagaagaaagctcccaattttttgagtattgcaaagtatcacatatgtttgtgaaatctgttgggaaaaaaataaagtaaaggaaaaaaaacagctgtgtggaaaggtaaaggcaatgggaaatactaaacttactccttaaactgagcatgcgtttcaatttctggggacgtctgccttcagagcagggctaggatttaaattttgggaaaagggcagaggtttgtcttcttgtttttttttttttttaaaggctgaagtgttttttcagaagcagcagtctcatcctggcactcaggaggaaagtagaaggtaccttcagttccccatcaaattcttctggagaaaggctaattggtgaggtgggaatcgaccccattgttcccgagaggacaccttgggtgtgaacagcaagggcaggccatatcgctcaccctaggtgctcttcagtttagaccatccctctgggaaagccgggtgagcattatttttcttacacgaagctctctgcatgccgtcagtactctttaggacctcagggaaaccggagcgtttctggctttaggacccaggaactctgaggcagcctggctttagatgtcttggaccacagcaccacctacttatagaagcatcccgagccttagcttgtctgcatctccatcggaaagtgcgctggccacatcccttcggcctccgggcagtgttctgtctcccttagctcaggcagcgagaaacttcagctgtgaagtggtggtggagagagccctgggagcagcgactggacccggacaccaagaagagagtggacgcgcccctcgactaggaatcgctctcgcaggcggagacccagcatctcagcgcctgcggtcgcgcttgcccggccgcgcgcttttgctaggcgccgccaagccccgaggaccctcgggggtccgcgggacccttctgcagccggcggaatcctaaagctgccaagagctcccggcgggtgtcggcaaactttttccgagcccacgtgctgaccaaacagcccggctcgcttccagagcctggcatggagcgccgcgcctaggcacgccgtgcagcccgagagacgcgagcgcacggtaggtgatctacacctggtgctggggcgctgggatagcccatccggggagcgaaaggcttcagagcgccccttgaaagccctgcgctcggctgcttctagagcgcctttccttctgcagagctcgcacaacgccctttccccagggtcagaaggcactgctccgcagaggttgctaattcactgattgtaatcaccttcctctccaagtctcctgcagctgtgccatctgcgttaaactgcttgcgtgggtcgtgccagtgagttcgcgtcctccctccctcctttctttaaactaagaggcgcgaaggtgcaggtacctcctccgggttctctcagtcctccacccacccagcttctcttttcctcctctcccaggttcaccgtggagggagagatgctcatcgagccaaattgatcattgcagccccagggcagtgacatctgtctctgagtcctccctaggagcgcgacccgcactgtctccttccaggagcccgtcatttcctcgacttttgagaggtgtctctccccagcccgaccgtccagatgcgtttttgcctcttctcatttgccctcatcattctgaactgtatggattacagccagtgccaaggcaaccgatggagacgcaataagcgaggtgggtcgcgctcggctgaaggtgcgtggagttcctgagtgggtgggagtgcttattcacatttaggctttggggactcgagggacaggactgtgctctgcaccccagtttttgtgtgggctaccactgaccattctcagggtcacagaactccacagaaagcttccttctgtccctagtgggtgcgatgggaccttagaagcattgggagcttgatgtgctgggcttccctcccgcaagcgcccagggatttatcatgtggttcacagtctgtgccacctctcctgaactcttctttggatcacatttcttatgtggcaccatttttctagttttctccttttgtcttcttaatcatcttccttgaagtccaagtgtctttaatttcccgacccacgtgtgccctaaatcctgctccagataattttagacatggtctggcgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcatgggagaacctgagttgcggagaaaaaaaaaaaaaaagcaacactgttccacttttccggaaccctagcagagatgggaatttaatgaattaagtagcgactcctactctggctttctcagggagttctcccctacagcgtgaatgtttgttacaaataagcccacattgccctgtttgttttctcaaaagcggcagtttctgggaagggttttgtactcaatgagattcatgtgagtctttttaaatgctcgcttctccatccatcacttgtgtgaagggtgaaggcagatggaagcctccagaaagatttcagagaattcaactttagtgtgcacatatttctggactcctgtcttccagtcttactggggaggggcagctaaaccaagggcatttttgagccagacacaatgaagttttctgtagcgacgtaaacacgtacagcatcacacaggcatagcgttgaagtactagcacagggccctttgttagcacctgaggagagtcagttgtctgaccaccaatttggtctttttacactgatagagtttgtcatgaggcttggagaccttggctttgtttttccaggctataaacgactctgatgggataaagactctggccctgaagctagttttggagggatcaatgctgttgttgacattttgagggggcattaagctttcctcatgagctgaagagcttggcctattccagagcaaaacttcacgtcatccatggtgtgtgacaatcaacgaactagtgttttttaatttgctacgtgtctctggcttattataaagaacacatatatccaccccagtcttttttttttttttctgcatcatttctgacatttgaggaatgtttctttatttcagaggttactacatataaaacatcatggagaaagtcctcttcaaaagctgggagagtttgatgttgctacccaactttgaaaagtgactctttatctcttctcacctcttccaacaggaccctttctccatgccattatgttttcaggtgttgtttggcagatgtggcaatacttatatcattattactattattattattattactattattattattatattgtggtctgcagtgtttggagaagctatgtctgctttaaaaaaaaactggaactgaaaatcaattttgttgaaaatacaaaagctcataaagtttgcaaaatacagaagtacctaaaactccttagcacattcctgactattacatgacttggacttctgattcccactgctggcccctgtgcttgcgtgcagaagaattaggggcattgtctgagatacagtgtggagatgctgctgagtggagaatggtatcacagcactcctgcggccaggagcgatactgcatgcctttatttctcctgtagggccatctcccaggctctgtgcctgtgctttccttcttgcgtgtgtgaatcacatcctattttgttttcagagcttgctttcgaaaaaaatctcttgcagctattgccatctatagtcccaagctctgacatttaaaaacccacttagaaagtgtgcaggggtaatgtgtgccagagcaaccttgtcatttcctaaagtttgaaggctttcatgtacatgtcaatgggtatggctgtttcaaaaagtgtctatcaaagtatgtttctggctttctctccctcaacagatgtctcttcctgaatcccaagtttatgcctgaaataactacagtttttaaagtgaccatactatctgtgccaacaaagggtgcactgtgtttttaattaaaagtggaactacttaaaggactggctagacagcgcagggtcatagtagcttttctgccctgcaaggaagcttaagggactgtattgtgagcatattgaaatgaatagagatctaactcaagttgtgtgaattgtccctcctcacaaacttaagctgcttttaattgatctcatgtccactgattgatcctataccaattgttgtgcataccaaacaattggcttttccaaaggagattgatttaaattaaggtttggtgttttttctttctttctttctttttttctttttctttctttctttcttccttcctttctttctttctttctttctttctttctttctttctttctttctttctttctttctttctttttttctttttccttcctttctttttttttttttttttgtgaatgcctgtctaccagccaaatcgtgtcaatactgacagttgacatgctagagcctattgtggtatcaacatttccccttgctcctttgttttgtatagtggcagttaaatattaccttctaggaaaaaagtgattactactttaaaaaaaaaaggtgctgtagcataaaagatgagttatttccttggctttgtgctctgatgcaggcaggcagcaatggcaccaggattggttaggcttgcccctgggacctgattttctttttttctttttttcttttcttttttttttttattccatctgcaaataatcaaaccttcactgtggcatattctcagaacttctttggcattatgtttagtctgctccatgatctcagatgctccttaatatcattttcttaatgaaataaaatccttggcagagatcagatcatttagtcagttaaaatcaattgcatccagtctgaaatagagagcaaatgtatcctttagccccacgttttattccaaagataaccagaggattgagaaaataaaatttcaacctcgtcaactttcgggcaaaactatctcatgaagaccgtcatagacttcagctgagctttctccctttatttcataaaagtgcatttaatggtccctaatagggcccagctgaaacaattttattaattaggcacaaacacagtggtaagaatgcctatccttgtagaagggacacacatgctgatatttggggagactgattggcaactcatgtttcgtctccatggtaactgctcacagttgttagccccttcctcttcacttagtaaaacagttcctacaagctactgttaaccaccactatctgtctagagttcttgtgagtaaactgcattcataaatgggtgttgttttttttttagctgtatttacttactttatcataagccacgttttttagcttaattatcgaaaatgtaaaatataactttattatggtttcatagaattttccaagtttggactatggtggccatggcagagtcaggggtgtgcatagagaagagatttcttgaggaagctcttgagagcaaccaggcttccggacctgtaactggtgtggctggtgggtgtggcactccaagtgctgttgcttgtaaccttttctctcagaggcttccagcagtcctccatccataaccgcttgtgctcacaaaattacttttggcttcttctacaaaaatggtttgtttatcacaaatggtgtggtgtttctggaagctgaggttggagaaaaagacaaacagtttctctttaactgcacagagctaaattagtttgtcatttatagtttaatgaagagatgtaaaggtatttgttttccataagtactttttaataatggcttatttcttccagtatcctttcaaaaatacaaactagcacatggaacatattaacctacacttaaaagcttcaaaatacattttgtatgtatgcttgctttttttttaagttcccaagtagttcagaaaagttgatgtgatgtttaactttcaaaataaacatgttctttttttccttctcttttcttttctcccacccccaacccccatcctcattggctgcttttgcttccagcattattgcatcattttttctggccagagttttaaccagtacaaggaggtcaggagattgctgagctcagaccaacatcttatttgccactgacacttggaagggagtcagaataggtgacgttctcctagccttccatttaattctggcttactttatctgctcttcaaacaaagcccaagtagcatctaatattgcagcaatcacaagttagaaatgacacttctcattacttaatgcaaacctacctcctgatttattcagggactggccagttcatagattatccaggctatttattcttttatttcttttattccaactgactgcctttaaatctcttttcctctttttggatacagtcactcttatccctccaagtccaggaaatagataacagacaaatcttttgctataatgcttgatctgttaatctctgctgaaaagaagtgctaagctttgggatgatgaaagacgtttaaatttttggtacttttcagggtgtctttagggccattatcctgccttctccttatccagagcaaatcaaggactaatcacaaggggagggccatattatggtttcagctgaaacaaatgtaccagatgataattatggtcttaaaatgcatataacacacacacattatatatatatatatatacatacatatatacacacacacatgcatatatcataatgaaggtgtctatagatgcattttttttgtgtgtgtgaagagagtacagtagaaaaggttctataatggagatttagctttttagaactaaaatgatatttttgctcattttcccccttgtctttcatttccttttgcttttcttttaggatgtaaagattaggaccatggtagggtgatgagatgaggctgttatttcttgctaagtccagtgttgcctctcttctctcctctggaaccttccttcccatcagagtttttaggtattctgcactgctgctaggtattctgcactgttttgatttattttttagttaacatacacaataaatagctttgttatggcctttccacacatatatgtcattatactttgttcatctcaaatctctctcactgacctttcacttcttatcctgtcttgctggccacctacttcttctcataagtgactgctctgtcacaggtcacatgtattcctttgctttctcttgttaagtcacctctcttatcataattactttccaatcttcttcccttttcttcgttttcttctcctgcttgctctgcttggtcatcttgggggcatcattcactttgcaattggttacagtctggcttctaattccatcctttttctgaaaggattttctatccaagattattggtcttcacttttacagtagttttctttaatagcaaaacagaagttagttgttgaagttatcttttaaaaataactttataataggccaggcagtggtgatgcagacctttaatcctagcactccagaggttgaggcaggaggatatctgtcagttcaaggacagcctggtctttgaagctagttcaaggacagccagggctacacggagaaaccctgtctcaaaaaaccaagcatccaaacaaccattcacaaccaaccaaacaaataactttataaaatgattttatgtgtatgtatgggtgttttgcctatatgtatgtttgtgtaccacatatgtaactggtgcctaggacctggtgaccaagaatgcagatcctctgagactgagttacagacagttgtgagcagccatgtgggtgctagcaattgagctcgggtcctgtagaaaagcagccagtactcttaactactgagtcatcttgacagtctggagaaaagttttctggatggccatttgtactctgtgtttcctgatggtctcactttgatctcccgtactcatccctcaggcgataacctattctttttcctagtgcgggctaaatcctctgtccagtgacaccaggttttagttcccgttttctatacacccctgtttgttggttcttattgacaatagatggtacctcttatttatttacctttattctctttatcttccttccatagcttttctttaactcttacttccataaccaggcttaactttagttcttagcttttcatttttggcttcagattacagcacactcagacttctcaacaactactgatacttgggtggatgttttatgcaaacttggtcttgacaacttatttcctcctcatggctctctcctggatatgtgcctttgcttgtgttcctgggttccagtcatggggtttctgtgtgttaaaactgtgagctttgctcttgttttgatatttcttctgctgtctaaaattgtatcagttcaattgaacagttgaagctaaactttactgtagaatatgccttagatatatctatgttttgtgagtgtatcttttccatttccaagcatatttcctatcttggacatcatagcctccttatctaacagctttatgctttctataccccagccctttagaacgctgccatgtgcatcatttgcagacacagatctactcatattatttgcccacaaaccccaaacactccagtcactgtcctacccacaaagggtagcatctctttatatggtagtcagtgttctcaccttctgattgaaatatgttcctaacctcctcccagcctactaaagcatcacatagttaaactccatcaggctacttcactttctttattaaaatgcaacattagccagttaaaataccattgcttttgatggccttcctggaagtacctgttcatcttttctaaggcccggtgacattatacctatttaatttcatagcgttacatgataattctcaatggacaatacctatggtactgccatcttgacaatccttgttccccaaagagtctttcctacacaacaaatagatattgagtagatttcattgtccctaggaaattttggtgacttaaaatttacagtgttttatacatacttcaaattttagtgcttaactgcctattgttgcctcactgtttactctggatgtctatgaacgttcccagtcagcacatgcatatggatccaggtgcctacctgtcattcaagtgatagtttgattgtttcttaagtggcttttgacttggggacaaggtagggaaacacctgaggcaggcatgcctatatttcaaaaaccacctctttagagaaaggggcaacaatggacttgtgcactctggttactttattcatatgaatgaagaaattattgaggagaaagtaattgaaagatatgcactttcttaaaaggcattcatactaatacactagataaattactgcaagaaaatttaatctttattttggtacttgtgactttgatataatacattcatacaatcatagctcagagagacacaggtatgctcatgtatttatgaagtcaaattcctttgtagatgcaaagaggctacatggggtgtgattatgtagttcctctcagaattctggtatttcattgctgcatgggggtggggcttgcttcataaggatgaagagctgcttagtaagataataggtgaactgtaaagtgaattgttaagaactgaatgggtataatgagacgctaacacttcagactcagtcagcatttattgttatataaatatttgcaaaaaatagaaataaattttaattttgatccagaaggtttggagactgttattagtctcaaaatgtcttatacctcataattacactaataaagaactgggattaaataattggaagtaaaggttggagaaattaagggaccataaatatattataataaaaacttgaaaaattggtatgttttcaccaatctgatacatgaattatagcaacttcttatttctaatgcatgaagagccagaacttgtgaccatgaacataagaatacacttgggtttgcatttgtcttacacatagacttctagtggcaggtatttggggatatgcacacattataatcagaataatcaataaagagtagagaaacctattaaaatatgtttacttctttactctaaaatgtagttgaacaaattggagatagtttttcttatattgtcatttgaggaaaatatttatagtttacctgaagtgactctattttaatgatatatgggtaaaaggaatacttgccaaggagactttttcttgctcagcacatttccattgagcacaggtgataaatttgggatttaggagaggggcaacagcttttgtatgcttcctgaaatgaaaaacaacactgtttcctttgggggaagggaaggcaatgtagatctaggcctttccctaaagtgtccaggtagtactcgcttcaattctttcctttaatagtttaagaaatgttggttaattgaatagtggagaaaccttaatgaacacagtatctaatagctgcttcaaagcgatgcaaattttgttttctaaaagcttttattcctgtgtggggtttcagtcattctctagggcacatctaccataaggccacagcagaagccacagcaaataattactttggcatagtccttttccttaatgataatagttcacctttctagtagcaaagacctcctttagagaacacacctctttcaaaatacccctttcacctagttacataaagacaagaaatagtgcctcacagaaaagtctagttcctattccatggatatgagatgcccatgatgctgtcaagtttccatggtcttcagttatgcacatatgctaatttgtatgtcagttgtaccactgttgtgtgtcagcttctggtatacaaaaagtaagacttaaagaaggctattccttcctgatgaaacaacattgaaacgatcacagttaacacatttggatttaaaaaaatgataattgataattctacataacatctagagagcttatacaatataataaatgtaagagaatttgctaaaacctcaaagaatctaatttcatcccaggaacaaggtacatctatctacctatccattctgtctacagcaagatagttatgatataaaattctgttataattttcaggcagcaatttggatcaccaggttgtaacaatatgagcatatgcatcaaactctcagtctacagaatgctgagagccagggtttgttactcgtgcattctgggatggtgtgctgagactaggtcccaatttctgcatcaacccactaaaagattttttttgtaccacagtggcttttgtctcctacctgttgctgagaaaacacaacttgtgaatcaaaccacctcagcaattaagatgtatagaccaatagagggcacactctgcattcttttcctgcttggttcctaaggttctgcaggatctgtacctatttgctgccttggcagctctgctctctccactgataatgtgattatcttgatgccattagctagaggaatgaaagcagcgagtacttaaagctttaactcttcccaagcactttggcttgggttcttcatcttctttccagaaacaaaccttacagttttaatgcctgtgacatggatattaaagttggaatttgtcctggtttgcagttaaacaccagcttctgtaccctattagagaaatgttaatttaaaattattatttaaatgtttcccattaaagtgcatgcttaaaagtgtaagacattgataaagtttggagtcacttaaaggactccaaatgctcaattctctttaatctttatagatggatctattgcacatgaacagttacccttcgtatgttactgcttgcaaatggtcatctaatcttaacatgaaaatataacatttacccttttcaaaaggtgtactttccccatcttttgtaataaaatgtaagtcatagtttaaaatctattacttcattcttcttcttcttacatgtattctaacactgctttcttgtactcaaagctggcctgtaatgtgcaaggatttatgtgatgtcagtgttaacttgcatagtagctacccccacctcctttttgtacaagactttgaagcccaacttggctttgtcccactgggatgtccagtctgctctctccatgaggattaattgaatcatagtgcagtatatatcctgtgattgaatgacacatcttatatacaccccccccagatagatccctttgagataactatgtttgttattctcagctattccatgggcattgatggttattgaatgccctgctttgtctcagacatgcttgctgaaggtacagttaactccggagaatttcagtcaaggctcccagttctcatacctaaggaggccctaaaatgaagcagtcttgttcttcggtgtgtgtgtgtgtgttaatagataaataattatttaattatttaataattattaaatatttaattattgaaaaattaaagctaagttttggcacttttttgttgatgttttaaaggtaccttctctcttacatatgcatcccctcactttgtatgtgcgtgtatgcttaaagtcaggcttatagggtactgtgaggggcttttacatgctagttctggactataatgggactatgataagttagatgaatggaatgaatgaacttgctcaaattttctgtttcttcaaggaccgtgctatctacctaatgatggagagaaggtagaattattctttctgtagcttttctttcacttgatatctgttgctacccacctattccagcatagcatggtggagaaactttgctggagtcaggagaccacctaaataggacaaatgaaacaaaacaacaacaaaaccccactgatgtctataaagtggacatttgacagtttcccaaatcactcttagtgggttggttgaggttagtgtattgtggttttgggaaggaatgtttgaccattcctaacggcgagtcatgccatagtcagtatgactcttgatggaatcctgccaattatgaatgactgtttactttcctttaagacatgttatctgagaattcatagaaagctggaaaacttgtagattggacttcagtgtgatctacttgctcctttatataaaagagaattaatcttctgtgggtacatctctacctgtgtaccaagcactcaaatttggttaaattcagagagaaaagtttgaagcaattaaggggatagttctaggaaaaagaagagcagagtcaagatggtcatctctagttgcatgaggctcatcaagtgggaagagaatttaaattcctctactcttgcgtgaatataacattaaagttacattaggcataaggaggaagaggaatgtttatatttagaaaactatccattaaacaaaatagaaaacttcccattaattaaagagacacttaaacatgctgactttagaatttgctcttgccaagcaacagggaccgttatggggatgtattgagtaagcagttgccaaattctcgatatttgaggaccattcacaaaggataagttagaatgtggataactgaattcatgtgacaccccattgctacttgcatatgaactcttgataaaaagctgtttgtcacatgaaactaaagaagaaagaagaccaaattggatacttcgttccttcttagaatggagaacaaaatacccatgaaaggagttacagaaacaaagtttggagcagagcctgaaggaacgactatccagagattgccccacttggggatccaccccataaacaaccaccaaaaacagtcactaggtagatgccaacaagagcctgctgacaggagcctgatatagctgtctcctgtgaggttctgctagtgcctggctaatacagaagtggattctcacagtcatccattggacagagcacaaggtccccaatgagggagccatagaaataccagggagctgaaggggactgaagccccataaaaggaacatcgttatgaactaaccagtacccctagagctccttggaactataccaccaatcaaagataacaaacacatggtggaacttctggttctagctgtatatgtagcagaggatggcctagtcagtcatcaatgggaggagaggcccttggtcctgtgaaggctctgtgccccagtataggagaatgccaggaccaggaatgggggtgggtggtttggggagcatggggtcaggggaggggataggggattttcggaggggaaacttggaaaggggataacatttgaaatgtaaatggagaaaatatctaataaaaaaatggggcgagctgtttttacacagatgatgaggctatttctaaacagaggacaggaaacaaaattgcttcttaaagtattctccaaatcatcagtaaggccttcagtcataggtaatgcattttgatgtttggtcagaattcctaaaagagaaggtacgattattagttcttacatgtcattgatgtcactttgaagaattatagctataactagcatgagcaggttccatatagatactgtttgctataatgaggtaactagagtagaagataagtacttgacaaatattgatcagcaactacaacttaaaatagcataatgggtttaagaagctgtttggacatttagattgctatctgtgacaagtaatgagatttattttgtccttgctttttctaattagcaattgtaaagtaaatgtttcctttatggcttaaaaatgagggtcagtagagagaggcactcataaagaaatatgtgcccaacagcatagatattggcttccttaacgagttgtttcatttgtatctatatatatgaagaggaatttaatgttctgaagtggcttgaaagaagaaggcaaatgtattcactcaagcaagacagaaaacaacaacaacaaaaataaagaagctgttccgataaagcagtgtatgtagttattgcaattatgtactgtatttattaattactgtatttggttaagaatggatttgcgttcactggggaggaacttctggtataatggaggcctctgtctttagtcttacttgaagcaatattttcttagagattcagttgaagacacattgtatgtgagccattgttttgtagagtgtgaagcagactaggaaatgactatgttgaatgactgatcatagaagcaaagcagtgactggaaactataggatgaatttactgatgaaatctttaaacacaaaacacagagccttcactttttaagggtgaagaactaattgtgtgaactgattggagatgatggatattcgttgttttgtttgtttgttttgttcaggtttgtttttagataaagttgtactctctagcccttttgatagcaagttcctttttctcctggcttagtagtgctcagataagaggtgtgtgtgttaccacattgaattttattgatttttgacttctcttaagattatgatgcatggctggagagatggctcagtggttaagagcattgattgctcttctagaaggtcccgagttcaattctcagcaaccataaccatctgtaatgggatctgatgccctcttctggtgtgtctaaagacagttaccatgtactcacatatataaaataaataaataattaaaaaaaagattatgatgtgacaaaatcaaaagaggcatacttatcttgactcaataataaaacagattaagcccccaatctatggcagtcttctgtactcttctgaattttgctgctttcagaagggtatcagaagcacacattatgatattgtatggtttctaggtgctgctgtaactgagtgccacatttagttggatgaaagtaccaaagacttactttcctacaggtttggaagctgcatacccaatattaagataataacaagtcagcaagcttaggcctctgctgagactctaatctcttgtctgtccctgcttctggtagacacatatccctaggacagctggtaccatggttctagcctgtctcctccttcatatgctcacttctctctgtgtttctctctcttttctaatgagaaccatagttatgataggtgtggtggtacaggcctgttaacgtagcatttgtcaggccaaggaagaaagagaatcaggaattcaaggcccgtctgggatacatggtgaaactttgtcttaaaacaaaataacagataaagaataccagttaatactgtattaacattcaacttactggtatcttgtttacaactatgaaaacaggtactagggataaggtatatttttggactacatagtactgcacataatatactgactgcatcaaaacctacagtccttaaattgtactttattttcaacacagcctgataccattatgtggtgataaagttatgtggagcagtagtggtgataggcacagttcacacaaatcaagaatcatcctaatggcagcccacaggcttgggaatgcagtcaccttggaggtaggatgctttagaaatatctcatgcatgttaatgtttggagtatataatctccagttcgtctctgcttgtgcagttctacttaacatcatgaatctaaagattcacgcattcattcatttatagaatcagtctacacattgattttgcttatcacttagcccttcttctgaagccaaacctggggttcagcagtttcccccaaagcttactgtcctctaatctgggagtacactttaggaaacactatagcaacctcgagactgccttctgtcatggcttgtagtgttagttatccttttgtccctgtgatcatgagcaatatctgacactggcatttggaagtatatgaaattcttgggagaccatctaagtgtttgagaattttatacatgagtactctatttagtctttccacctctcactttctctttacaacttctttgtcatcttcagtcttgcttgaattcctggcctctctttccttcttttattgttacatacatgtgcgcgcatgtatgtatataaatacagcctggtgagtttatttcctgttacctgcatgtgcatttgtctagggcagacagaccacttgggattcagtaatcaatcaggaagcttcatcttaaagcaggctaattctccctctcccagcagccattaattgcctcgtggctcttcatctaggggtggggccttttgagacttcccacatcaacattagtgtgtcaactggtggtggtactgtgtaggtcttgttcttttaaagcttcggtgaacttttaaaggtgcatagaaaggtagagggtagagtagcacataaatcttcatgtctatcatgaacattaaacaaaagagaatcccctatacttaatgttggttcatggtgcttctgcttgttaaaatggtataaagcaaacaccaggttcatgctgcctcatgctatgtatttctgaatgcatttcttataaacatgggcagatttttgccaggttgtaatgtcattcaggtgtctaacaaaattattccttggcagtagcaattattaaacaaatatagtagattgttacaattatcttggttctctttgggtagctggcatgcataaatcaacattaaagaaaacctactacccacccattcatttcatttactacccacccttcaagattctcttgaagaggcaccatcagttgtgttctcaccattagatttgggcatatggggaatcatgtatttttttttattgtcatctgatataggaggccctagctcaccatgggcagtatgtctgtctaggcaggcaggtcttcctgagcatatgagcaagccagaggaagcagttaaataagcagtgctccttggtggtctctgctacagttccttcttggaagttccttccatgacttcctgcaatggtgtatggtggtgtggcagtggtaagataaaataaatccctctcccactgaactgcttttgcttgtgagacttctcacagccgcagaatgcaaactagaccattatttacttgaatccatttttctgtgacattttcacatgtatgtcatatttttttcaagatttcctgattctttgccactgaggtaaaaattgtattcttttgaccccctctctcttcctcctcctctctcccttcttctctctcccttcccctccccctttacctctccctccctccctccccatnnnnnnnnnnnnnnnnnnnnnnnnnnnnnnnnnnnnnnnnnnnnnnnnnnnnnnnnnnnnnnnnnnnnnnnnnnnnnnnnnctttataaagatcagttttacatggaaatgtttaacctttggcatttggtcacttgcttctttgtgtggtttatttaacttcttcctttatattccacaattttggccaatgaagatttttttttctggaagccttgattagatttaggttcactcttctggctaagatacttcacaaggattgctgtgagcatcatgatactttacaccagagggcacagcacacacatcttgagatactaagaaacaggttcttgtggtaccagctggcttgatcccttcatttgtcaggttcccattagcctttcatctactgtttgcttctattgatgatctttgtctgagtcatcatttcattagaggttgcaaaatagtgtggcttaaaaaattcttcctacatttattagctgaaattctattaacaactgtttcttttcaaccatagatgttttgttgtgaaacacaagtctcatagcaagagtaagcaaaacagacaaaaccaaaccccaagtaaaacaaaacaaaaaccctacttctccattagctactaaaatttcacagtaaagcgttgatcttcgtgacccaagacaatgagtgatttttttttttcactacaggaaaatcaaatgcttctgtttgtgtcagaccactgcttgtcagatgggacaggccacactttcagcaacttctgtctcctggaacagtcctgtaaaagagcatcaaaaagatgttgtgaatagtgtcaaggggaggtaattgctaggcttttgcaaacctgaattctgttagacatcttctagggaactgttaacagcttttcagagaagctcctgagtgattaaggagctgcttcagcctagtgtactctgaggtttattaaataaataaattaattaaaaaaacaaaacaaaacagaacaattccccaaacaaatataagaaaataacactcccccccaaaaaaaacccacttggtgcaactttaacacccagtggaaagtttcgagagaaggggaaggaacatctttgagaattgtatgtttagaatacaaataatgccacctgagaagaattaggttcttcaaagtttgactcacaaggtagccacttagaaacggtgacagtagcccatccgtggctgactttctgttagatagttcatcctgtagacttagagagagaagtgcttactgattttatctttagttgttgatagagaaattgtaaacaaacaaacacacctcacaaacaacaactaccccaaacaagcaacaacaacaatattaaaaaccttttcctagtttatggttgcagctagttcttcttgataaaactctttaactggctaaacactgaactcaccactgttacccaagttaacaatggtatagaattaataataatttttctacctaacagttagagtcacattttttcttattgagagatgaagtgaagggactttttattagttatgaatatttattgtgaaaattatagtgtatgtagatcataagaaccctgtttccagagcaatacaacactgctggtcagatttccttgtgcagaaagcatcttcatggtacattttgaaaatggtcactggggattgaaccccagagccttaggttccagagaagctctgtaccactgagccacattctaggctgtgaactgcttttaaaaaagcaaaaaaaagaattagtaatgcatacaggttcttatactaataaaagaaagaataaattatttttcttcaatttgtacagtacttttttcagtaagtaaacaagcaagtggcatctcataattgagtataaagacagaaattactcgtaccagccttttaaaaatttggtttctgaaagttgttttgtcaataaacgttctactttgtcaggatggtctttggacaaaatgagaggttttaatccttgcatttatgtaatgagttggcttttatagatgtagtttataaaatgcatatgactctcaaattaattaattaataagaggcaaatagatgccactaccacgaaagacccaaactgtcagtaatctttccaccaagcagtgactaaccactgttaacattttgaattttttcattttagttgttattttcttctctgacatagcataaaattaaggaaaaacgttaaaacaggcatgtgttctaactattctaataatttgtaaggtctgcaccatagaacattcatgatgaaaatttaaaatctgatttttgttgggtagttactgctgaaaattgtcatttatgagttgatttttaattacgtgtctggctgtgtatatgagtccaggtgcctgaagaagccagaagggggcatcagatcccccagagcagcagttacagggcagagtgtaagaccccatgcatggcccaatgagctggagatcagagtctgaaagctcaagaggcagtctgaaacattgagcaacaagttaagtcttaaacatttctagctctaatattgaaaactttaaatgctgctataattaatgaatatcctatgcattttcagtttttcttaggtatcattgacagaatagatatattataatggttacatttactggctgatttatgtgtgctgaacatactttcttcttgcattctgctttggtttgtgatgctggtattgaactcaggtatagtaggcaagttctctaccaccaacctatttttcaactccttgaaacagttttgttgttgttgttttgttttgtttttttaaagtgtagagtagagtttattaagggcatggggaggaggagtgaagagggtagtagcgtcagagaaagacagaaaggcagagagaggaagagagggaggtggggaaggagggagtagaggcctgccatgagcatgtgggaagagaagggggaagggagtgggaagagaaggaagggtgaagggaaagcaagagagtaagcaaaacatggttcttaaggttgtattttatttagtcattcaaaatcctcttggcaggctttattctctctcactcgttggtgtcagaggcaccagtgattgaatggcatttccaaagtcacagagttggaaatggcagactagaggttcagtctaggaatcccagctcagttttggccttgaccaccaaaatggagatgtgaagctatggattttactgccactgggtttcggtttctagaacactgtattctttgtgattctctaggtgagaatgatagatgtattgctttgagcctttgataatgttttatttttgtttttaataaagatcttgcttaaatctattcctattgaaaacatagttatctacctccctcaaccccaaatagcatatatttaaatagcctttcccatggctccaaataaggttacacgttattccatggcttaactcactgtgatggtttatatatgcttggcccagggagtggcactattagaaagtgtggctctgtttgagaaggtgtgtcactgtgggtgagagttttaaggcccttctcctagctgcctggaagtgaatattctgctagcagccttcagatgaggatgtagaactctcagctcctcctgtaccatgcctgcctgatgccgccatgttcctgccttgatgataatggactgaacttctgaacctgtaagccagccccaattaaatgttctccttagaagagttgccttggtcatagtgtctgttcacagtagtaaaaccctaactaagacactcatattccttattttttttcagagatgcatatacttttctgtagtatcaacacattactatcctctagatcttctgctttttgtaggtcaccttatggccatcttcctctctacccacaccggtagccttccaattcattttgtgttctcttcttcactgtgcattcagagtgatggttataaaacaagtctgagtatttggttctccagcttaagtgtttcagtgcattgtgtccattatatcccaaataagtctcaatctccttgcccagtctagaatacaaagtgacctaagccctatctgctttccacctctgctttgttacttcaggcctctcctttctgttttcaaacactcaaattgtatttttgtattaagactgctattgattgtcctgtgggctgttgagacaagtttcttcttagtacctggaaaggattgaaatattattttttcttctgttttctgtagtaaactctcagggacggaacatggcacaaactgaaatgtgtgtgctcttctaagccggcgatgaggactctctggactttataccccgagagtcttacatctcttactctacttccagctccattaagttgagtcagctgtttatttctcaaccattctagaattttctctatgttcctgtaataggcaacaccaggcattcattggtttcatttcccctttttgtttcattactacatagtgtttcccagcatcctttgcagtggtacacacagtttgattggtgaaatgatgtgttatactcccacaagtgtccctagtaagccctttgcaggagccacacatgaggctgaatcccttgccacgttatttattgaggcaggaactcttcttttgttcaacacagcgatgtttaaatccgagttaagaaagggaatataagggagacagagtcaatatttaagattagttaaatgtgaatcacaacagcaattaacaaaattgtcagtccaacattgacaagttcacttagccagcttgtattggtctctgcctcctgtgtgctggaattacatgtggctttcacatctatacctgttggctttttatgtggatgttgcggatctgaactctggtcctcatgccttgtgtcgcatgtgatttattcacggagccacctctccagcactcctttctacacagttccatcccatgtcctatgttatagctttaacaagacctttatgacctcaggtcttgtaccaaatctcaatccatttgtgcattttttccatgcattcttaatttagttgatgaaacctttggaaaagaatctgttttatatgtgttctttgaatcatttaacatctgttaggacccacaggaagaagcagccaactttgatgaagaatgtctttgtgccagaaccccctcctgctgatggaggaacacatccccattttatttttgctaaatttgtagtcttgatttagacaccacactattccttccagttccatttattgttcttatttgatgacctccaatggcacgctgtttagattgtttagagagatggaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgcctcagcgcctctgtgcttccgcctgttccagaagctgtcaggttctctggcgcaccctctcacctgttcagactaatttcctaagttcggcgggtctcggaccaagatggtgaccgctgctgctgtggcttaggccgcctcccccagccgggcgggcacctgtcctccggtccggacggtggctggctgtccccggcccacaaagggtgctgcctcagcgcctctgtgcttccgcctgttccagaagctgtcaggttctctggcgcaccctctcacctgttcagactaatttcctaagttcggcgggtcccggaccaagatggcgaccgctgctgctgtggcttaggtcgcctccccagccgggcgggcacctgtcctccggtccggaaggtggccggttgtccccggcccacaaagggtgctgcctcagcgcctctgtgcttccgcttgttccagaagctgtcaggttctctggcacaccctctcacctgttcagactaatttcctaagttcggcgggtcccggaccaagatggcgaccgctgctgctgtggcttaggccgcctccccagccgggtccatcccatgtcttatgttatagctttaacaagacctttatgacctcaggtcttgtaccaaatctcaatccatttgtgcatttttttccatgcattcttaatttagttgatgaaacctttggaaaagaatctgttttatatgtgttcttcgaatcatttaatatctgttaggacccacaggaagaagcagccaactttgatgaagaatgtctttgtgccagaaccccctcctgctgatggaggaacatatccccattttatttttgctaaatttgtagtcttgatttagaccccacactattccttccagttccatttattgttcttatttgatgacctccaatggcacgctgtttagattgtttagagagatggaagccttttttgtttgtttgtttagcactcacattttttacttaactttttaattttatatgcatttgtttggtgnnnnnnnnnnnnnnnnnnnntcatagagtcaatatttagttcttgtacattttaagtgtgttttgatgggattgtgtcagtatgctaggtgttacttgaatagattaaggtattgacatgtgccttgctcagactcagcagtgatagagcagtgttctacaaacaatgcttatggctcctggtacccagttctaatatgaacactaatctggccacataggatatggttgtttctttacaaaagttttggtttaaaaactggtcactgacgattctgagtcttagctctttattttcccaccgtgcctcaagccatgtgcacatccttttgtttccttctgccactgaatagagcatttttcttcctttcttatcttctgaatagtgttaaagatgtacttgctaaatgttccatggtgtatgtggtgtgagaaaaatgtataattgttctcgatttggatgttttgcaaggcagtcaaatcccaagatttgatcatccaagataaatgatagcacattttatctttgcagttgtgaactcttcttatgtctccctgcaaatatataatcgttttcttttcataaagccataggcctaaattatggcagctcattaacaaatggtttccatactttgaaacctgtgtggacaagcctcatttgggcagaaactgccttgatttgcattttctgagatagagctgggacttttatattgaactatacctgttttgtttttgtttttgtttttgtttttggctcctaggagataataggtgtttcacatatttactcacattgatctggcacaatgattctttctttcctcgaatagagatggtgaagtgaagggagagaagttgtatgtggctgtgttttatattacacagtttaattccaaccatatatatggatatatatatcctggagtttgactgtgtggctgtctggatacagtcaacagttagcaaatcgttcatgtctcctctgcaactcactcatgacagtggaggaaaaaaatgttactgtttaggacgatatgtcaggactgtatatacagacaaaatggctagcttttgatgtctagggtaaatgaataacataattcagataatattgcattgcagttacatatgggtcagactattctgcctcagtcccctgaaactgtattacttgtaagtcttggtatttatagagtgaataaaatctctggatgatcttaaatatatcacattatataataaagggagaaaggaattcctatttgtttagattttgagcccatttctaatacatgggctttgcaaccaaaatattagtgttatgtcttctagaatcagaatctttgtgtggtcgattcctaaatatacctcgctttctctttgggctgaaggatgagtggctttttatgactgctcatgtacatagttaaatttttggtgtaacatgtcttgggacaggtcatcatctgtgggacttgtattcacagaccatagagctcttgagtacccactgggcatcaggcattatgttgaaagtaattattctttgtaagtcagtaaacatatttcttttgtttattttcttaaagtggaaaaccaggtgcttttgcttcttttcttcctggctgttaacacaatcttttggacaaatgacttcttcatttccctttcccttgagtattctgccccacagggacatctttccttcccagtccctggctcgaatagctgtcaccaggctgtagagcggtcacattccatagcttcttgcctggctatcacagtaataaagttcagccaagttgtcacgggtatctctttaattttctttcaaattaaacatggaatgagagaatgttggcgcacttcagaagcagaggtgctaagactatgttttgggtcttttccaagatgtctaatttttcctccgcaaaatacattagtaaaaagtccagccaaaagacagccatcctcctgtagcagtttaccaaaagagtgatctgaaatattagatgcaacttcagaaaccaatttttgtttcgaagtatgaagcacatagaccttgtttggcagtgttccacagacaaaggagctgaaagacactcctcacccggcaaggttgcagagcccgagtggaggactaccctttggcacacagctatttcacgctaggcttttttttttttttaatctctctaaagcttttaccaaaaagaaggcagatttttttttaagtggcaaaacattaatcttacatataaacagaggaagcattttaatcaaaacaaacttccagctacaaattgagaatagcagccacgtggtttaaaagctcagtttgtcaaggcccttgttgttacttaattgctcttccctctcctcctcactgactggtggcccaggctctttcactttcctcagcccagagccaggatcattcccagccagtgcctcttccccttgggcaatgagagctcctgttcctcttggaggtttttgtttgtttgtttgtttgtttttgttgttgtttatgtgtagtgtgttccagctttgtgcttttccagggcttgttggatttacacttagttgcagcccaatgtagttgttgttgatggtaaagcttataggcaaagggttggagcgggtcaggcatgtgagaaagcaggcttctccagctgtcctgcatagaaaacagcaattcctcagttctgtgatactctgcctgcttcctgctgccttcatctgcctcttaccactgttggtgggtggctcggcaagcttgtcctcaccgactcccacagaccagcccttcgcttctccttcctctttgcttctaggtatctgaagaaagccacatgagcaacaaatggttcagtttctgtactggctccaggcatcgtcctgcctttcagtgtttaatgagtgtacaggcaaatgctcttaccattgagctatatcttcctcctgtgattttttttccaaacctttactgcccctgctaaacaaagacgattcactcattctctctctttgtctctcccttcctcctttaattcccttctctgtcctccctcctctcttttcccctcttcctctctctcctctcttcctccctcttccctcccttcctcctcccccttcctttcctctcttgtctttctcaggtgtgttttccttctttcctttctaataagcaaatatcaaaatttagaacacaggtggtgctgaagacaattttcaatttgatttacatatttgtattgtgaggagtgaataagtaaaacagtccttagagggcgattggtaatttcagttaaaacatgaagaaaaaaaatttatgtcctgggaaggtatttggtcttaggaggctattacatgttttagtgtcctgtgcacatatgtgtatctttatcagccctgacagtgtaagtgtatcttccatgtttgatttggtgtgtgtgttttgttgttgtatgtctgacttggtgtgtgtgtgtgcaggggtgtgctgttgttggtggtggtgctggtctgtgtatggtactgtatacttgcttgtgtgtgtagaggtttgacgttgatgcttgttctgtatcttctctctctgtttttgtcttttgtctgggtttctattgaacttcaagctcactgatagggctaggcttgctggccaggtagtgagtgccagccatcccaatacaaccttttcataggtttgaccacaatttgtacgcagcaataatcttctgttttgttattgccgttgtagctccatcctgtgactgggcttatttagtcaatattccaagtctcaaatagagggaaagcagatattacaacttttcacttgaatttataatcaaagtacaaataaaggataacccctatgtccatacaaagatgcagcctttgacaattgtcctgcactggcttcctctgtcttttctcttgtctctgctacaggcatttgttattttcacttttacttatctttatcaattatacagaaagctcactataacattttcaaatgtggatgtaatgtatttttatcatattcattccatctatcctctcctatttcctctggccatttctctagatccttttcctttcccagctaattaattttctagtatcattgtgtgtgtgtgtgtgtgtgtgtgtgtatgtgtgtacacgcacacaccattgtagttttttagggtttcttatgatattttgtgtaaaggataatatataagggcatgaccttcatacccgtggttacactactgataaatatgtctttctcccagcaaccactataaatattttagagcaaatctaatatgtatttatcctaacactctgaattattcatttatgatgtgttcatttttagcaatgcattgtcacatttatcaaaagtaataactgctcagtaccactgaatactttcttgcccgattcctaagattatatcaacaaatttgtattcatattttgtttaattgaatcaacatctggttaggaaaagcataccatagagacacaattaaagaatactttaatttcgatgtagtttcaggatgtgaggagggaatcagaggtagagaaggagacagagacagaaagggagagagaggaaaaaaaacccaaaaaactcaaccacctcactgaattccatggaaggaactaattgcttcctccttactgggcactatgagctatccccacccctcccagagaaggagcaatgtgaggcactgtttaaacaatgtaacccaaagcttctagtttaaggactgattacgtttcacattgcattcctgtcagcacagatgcaatgatttcatgttctaaagttaggcctgcaattactgttttgattgctcttaggaaaagcacacaaatcacatagtgactcagcaaaaggtgttggtggtgggttggaacttttagctttccagataggacgtaaagaatggacacttggtattgccttttgagaacgtgatgggacgcatgcccgtgcctcccccatgttcccagctcagcaccgaagcacagactgccatcttttcttcatttgttgtttatatatttttttcttaaaacagtgattgtgtacatctgagttgcaaatatctacatctgctgcctcctgtacttgacaaggtgtctcttgtcagagactgaccatgaactcttgtagctaaatgtttgctctgagctttggatcttcttgtccccacgtcttgagttctggggttcaaggtgtgcactaccaccacaggttttatgtagtgctgggaatggaacccagagccttggttgttatcgctggctcagcttcattctcactccatgagctatgtttagtaagcagtaagcatatgttcacaaagacctacaaggatatatattttcttttctaaatatttactttttgcaagtgtgtgtgtgtgtgtgtgtgtgtgtgtgtgcgtgtatgtgtgtgtgtgagagaagagagagagagagagagagaaagaggaaaacttttgatttttctctccctctctccctactttatttttgagccagctgtcttgtttctcatgctgagctgtatagggaagaagaatccagctggttcttctgtctccatggcccaccttaccacagatgtgctgagattacagcctccagccattgcatcaggctggttttatgtgggtcctggggatcaaagttatcaggcttacatggcaagcacttttgtctctcgatccatctccctggcttcaggatttatttatttcttcttaagagaaaagtgtgattccaaagaagcttaattttgaacattaattgatgtctatgtggtggtaccttgaatattttcatggtgaatacatgaaaagatactctgagtcacatgggacgtagtacctgccttagggaggtgcctaagatgcttgtcacctgagagtgagaaggatgagagatatggaagggactaggaccaagcagaattttataaagaatacatcccttgaacaaaggccatagctaacaggagatgctagagaagttatgatacaacttgggtacataatatatcctcgagacaaaagaggatctttaacaatttgtgttatagtacttaacaagaaacacttttttcttctaaagatagcaaagaagactgacagagagaagttaatttttatttccttattttaatcatgaagtcaagaaaaaaatacctaaagaatactgaatcaaaagaggactgtgtttacttatttatataaactgcattgtcctcaaaagccagaaactgtccttatgaggatggcaacactgatgtgtgtctactctcaacaagcttatcatttcaggaatgaagtgtcatctgtgagctcacagaggatttgtaacacagggtcagtaagcatggttttagattctggtgaatatgtttggtaaagccaaaagctggtagatatcataggtacttttctgtgactttcttgtcttcttgtcctatttttgttgtctttagaataaactttaattttttaattggacaaagagatcaaaggttttggtttcagaggcacgatcaagtcagtagttgcctttttgctcatgcctgtggtctagtcaaggtttctggattaaagccctcacctatactagctgtgccttggtgacagctccagctgctttgttcttcctttctgtttcttgccaggttagccattgctagagttgatgagtcacttgtactgcagttttgatgaaacatcaaccttcttctagtccattgccttatctttcatgatttgagctagaaaaatggaggaggtgaattggtgcctaatcaagacttgagctgaatatagcaagcttatgtcttttctgatacaagggtacattttttggcccctctgttccattctcaggaagcagcaaaagaaacaaattccaactaaattaccagtcttccacattcccaatgccagcaaaatttattctcacattttcattctcattatatcttatatatatatatatatatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaaatggtatttcactaccgtcatccactccctctggctcttagaatctttctgccccatctctgatggtgatccctgagccttggggcaggggtatagtatagatgtttgtctgtcacatttagggctgagcctttcatgatcttctctgcctattcacccactgttagtctctattaatcaccatctgttgcatgaagaagtttctctggtgaaggttgaaagaggcatgaatccacatcatacagataggaatatagagggtgatagtctgtgcattttgcagcataatggtgttagggtcttccttagggcctatgacctaggaagccatgttgctttgttttgtttgtttttctcacttaacaatactagacatgagcttcatcttggggagtaagctttaaactgatcagaagtgatttgtcaatcccactgcattaatgctactattggcatgagtagatgtagcttcctggtcagccactactatagttctcaggattcaaagctggctaagactgattgatggtgaatcgtcttccatgtaaagtgtctgtcagaaccataaaagctggctaatagagatgaaactttgaatttgtaccagcttgacttccccatgtcctacagtccatttatgtagggccttaccatcaagtcctagagagtaaccaaaagcaatggcaacagccgctaatgtttaaggtggggggcatgtttataagttctgttgtaaaattatttcagaagtagaaaatggttaaatattgtataaaaatcctgatcttccatttactttgacttcttgggtggtaatatttgatactattttcctcatggaaacctgtagacatggacactacctctatagggagaatatataggaaagagtgtagatctaggaatataaaaccagatgaaactgcattggtaaaggaagtaaaacatcctagtgatttacagtttctcacatgtacttattgtagtatttattttgaagtatattggtgagtatttgcttctcttgcctaaacttggacatatttgattttcattgcaaaatagttttagacttctgggaaggttaaaaattgcacattgcttattatctgcttcaattctttaaatgttaaaattatatcatgtttaatactttagctaattttaatattagctaattttccagagactttgtaggttacctccagaaacctccatgcacacttactgccttaaaaccaaagccttgtaatttgtaaatcagatgttcttaagacaaggatgataaagctgtgacagaattgtctagtacatagggtttattgaaattttgctgctgcccagtaatggttatttgtagtaaaagggaaactctgttttacagcctgtcctccatcacatgtttgggtttaacattttgtttctttattttcctttaatctggatcacttgagacatccaggggtccttgactttctggatcttgacaatgtttttttgttttgttttgttttttttttatttttttattgagaataagttgttcattcagtatattttgaacatgttttccccttgataataataaaacaaagaaagcaagcaaaccaaaacagaataaaacaaacagaagaaaaagaaccaaagaaaaatcatacaagaaacacagagatgcagagacacacatatacacataggaatcccatcaaaatattaaagtggaagctatattatgtatgtaaaggacctgtgccgttaaacacacacatagacaaacacacatagacacacacacacaaacacacacacaatcacacacacacacacaccccttgacaaaacattatgagacaaagttcttccaaagaggcttgtgtttgccaactactgctgggtctggggattgctcataagagttttttgcatccttagagagactccattggatagaactaattttttcatttgcagttggttactgattggagatagctactgggttagggatggaagcctgtgtccacttttcctttcaaccctgagacccgtctggtgtagacctgtgcaggccctgcccatgatgccagtctctgagttcatatggatctgttgtatttggaaggccctgtttccttggtgccctccaacttctttggctcctacactttttttctgcctcctctttcatagggctccctgagccattagaggagggatttggttggagactttccatttaatgttctacagtttttagtctttgcatattttccaggtgtgggtctctattttgttttccatctgctgcaggaagtagcttctctgatgatagccaaacaaagcacaggcatatgagtatagcaatatgccatcaggagtcatgttaaggctaccttccttgatcagaacagtagtgtttggttttgccataggtttggtttagcctatctagtgtcaagttcgttttcatacaagcagtgttgggaaagggttccatctcttgatgagggtattaagtcccatcagatattggttggttacttccccaagcttagcatcactgttgcatattttgcaggcagttcaccactgtggatggaagggcttagacctgggttgatgtttacagttctcctttggtcatatgcagagcactttctagtaccatgaacattagtctgtggttggcgctggcttgacttctacatactcaatgaaatgtgtatgtgttatctgaagcagtagggtctttctttcagtttgtggagagcaatcaacagacttggcaaaagcctgggttatttgcaggctcccctggggctcctttgccaacctctggattagatataacccattcccatcactgcaagcttcctttggtgatgagaaatgtccagtttgggctccatctccattgttatttggcattttatgtttgggaaacttctactacattaagtttccaatgaactcttaaatgatccttagttttagctgtccttccctcatcttattcacctccagctatcctgtattttctaccctacccctgtctcatttgatcctcctcttttctggtaactctgttccatagttttatgtcaatgtgacataaactggaattatctgaaaagggagaacttgaattgagaaaatgcttctgtaagaccagactgtaggcacgtcagtaaacagcacccctctatatcctcttcattagctcttgcacccaggatcctgacctgatggaattcctatcctgatttcatttgatgatgaacagtgatataggaatgtaaggcaaagttgctttggttgtgatgtttcatcacagcaatagtaaccctcactaaaacactccctgatccgtaactatcaattctcgagaatgttggtctgtagctcaatcttctgttcgcacttttctcatgcttcactgtgattggtctgaagcatttcatctctgtctgggatatgataggaatgttttccctcagtgcattttatcagaaagcacctggcgccatgctgatccaattctggtgatattgattcttgtcactgcattgcagtttagtttgcacagtctctagtttcactttaatattaccaagtatcttatgtaagaaactatattgaatattgcttcttaaaaaaaaaagggaggagttatgtgggagttttgaaagcagtggtctcaaccttatggggtgtcaatgaccgtttcacaggagtcacctaaagccattggaaaacacagatctttacattatgattcataatagtcgcaaaatcagaggagtaaaatcataagaagtagcaatgaaaataattttatggttggggtcaccacaacatgagggagctttaaaaggtcaccgcattaagaaggatgagnnnnnnnnnnnnnnnnnnnntgagggagttttaaaaggtccccgccattaggaaggatgagagccactggtttagagggagaaaaggagcaatgtaactatatgataatttcaaaaaataaaaatatatcatcttttaaattctaaaatatattttttgtatgtatatttgacagcgcatgcatgcaatggcatatatgtaaagattagaggacatcttgctgttgttgtcttctgtacttccatcatggagattctgggccccaaacactgatcatctgcttttgttggcaagtgctttatctgctgagccatcttgctgccctgatatttgcttcttatcacacattcattaaatgcttttagctagagtaagaaattaagacaagatttctagcaaatgctcttttagttccttgattgtttcatagttgttgaatggaattttatagtaggggataattttcccttcttcctgctttatgtattcatagatttatttaggctctgttgactcatgatttgatcttttctgctatggattggttataatctgccatttatcttgttgctcagataatctctgactgggcatgggtctctctggactctgtggcacattcttaaccttctgggaacactgtgatgctctctggaaccagatgtatctccagcagatttgtactttttttgacccagcctttgagtcagcaatgctccaagagtcctttggttgacaagggaaacttagaaaacaaaatctgtatgctggataaatactttgcttttgggcctttgaagcaatcgaagcctggaaggaggcacgtgtctgtgtacatacctctatataaattcacatagacattcttctgtccttatctattttgagttccttttccctaatccttgtgattttttttttttaatttcaatatggcgcacagtaacataattcggaaaggtgaaacagtgtagaaagaggtgtttgtattttcagcagaccactatgttaataccattcacactcttctttcttttccattctgttttctcctgcttgcagtaggtacctagtctttcttgtttccagtttaatttatattatgtttggttttggcacaaaaaagtccatatgtatactttcacacttaccttttgttttggaatcaaaagatagtatataatcacatatttgatattctttagcatttaagctcttttatattttgcctatcagtatataagtccttatcaggaatcttagtaattttttttcccgagacaatatctcactatgtagctgtgactatcctggagttctgtagaccaggctagcctcaaactctggagctctgcctgcctctgcttctcaagtctgagaagtattcattttaaatgatgaatgtattatactccattaaattgatgtaacataatttattcaactgctctcctgtatatagctatttatattttctacagtattttaagtcaaaagttgcgtagaattttgctgcaaaaataacctgcaaatatattttattgttactatttttactttacttaagcattccagctttttaaaaggtgtctttggtgaagtggatctttgaattacatttgttaaagtgttttctttcctttaaaagtactctgaatatatgaatttgttagcttcttttaaacatagaaacatactatattgggactatacaccatgaaatttcagtaattcaagtcatgtttaatgtgtggtcaaaagaacccttatgcttcctggctttttattatcttaggtaatctgagtagcttctaacaagaggttctaaaagaatttgggtagctggttttagagcggtaattgagacacaactctgcataactccttccatccaccgcttcctccccttgcacaggacagagggcttaaagaccatgagcttggccatgtgtactgcctgagtaagagctgatattttattatcagttctttgacatgcattttctaagtgtggttatcgaatacctagtatccataatcataacaaagtgtctattaaatgcagccatatctaccacagctttaaaatgttgctttaaaatagagatgagacaaggcactctgccacagttcactgttcccattttctgtctggttgtccacctatgaagaagcctgtcttagttttacttgtgcattcattctcttgagtgttcaaatgctgctggctgcttgactcttaatctgcaaatcaaagcatatcatttgagttcagatgccatgtgttgcactttatctgatcctcatgcacttgacctccagttgcctccacaaaggccctgttgtttcgggtctgttttattctaaccagaagctgggggtttctaagtgttgctttccgatgcgctttggaggcagactgtttgtgctcctccaggatggtgaaaccctcgtgttttctcaactattgagttcagagcatttgactaaaggaatagaattttgttgtctcgaagtaatgttgaagaggggtcatctttactgattgattctaaagagtaaatcattgagtatgtatgaatcggagtgaactgtgggagttaatttaaactgattattaagcgatttattataaagaatcaatttccctgtctccctgtctttttctccatccttttcctcccattctcatttttatatatctgtaatctacaaatatatctttgttatatacggggagggggtaaaagcatgtttctcaagattcttttactgtttttcccttaatacaagtgtagtttggacttatattttgttgtgtgtgttggagagatccagcatgggtgattactagagtcctgtgattctcagccttcctaatgcggcaaccctttaatatataattcctcatgttgaggtgaccccctaaccaggcatttattttttgctgctacttagggactatgattttgctagtgtaattaattatagtgtaaatatcttatatgcaggacatctgctatgtgacccctataaaaaagttgttgaagccccaagtcaaacaaatgtgcatgatcctcacttcccatagttatatgtgttaagagcacctaacgtgatcaagttctgtttgttcctatgtttattagctacccaaacctccattccacataaactcatatgtgtttaggcctggagatagagtggaagtgctatttcttcccagagcaatccccccatgggtaaggacatgaagaaaatcccctaaatttcaatgctattggtagaaaggagagaggtactgcttccattcttggacacatgctgagccatgtacattctcctttgctcatgcctgttctcttgttctggctcttgctttcacttatcttcccaacctctcaagaagaagagggagactttctgaggtatatgctgcctcttgaaagtactaagaatgagatgagactttctttaatgggctgctaaggcttagagaactgaggtgtaggaatagcatgttagggaagacctctttttattgctctctgtgcccattgacctatgaccctaacgggcaaacaaagataaggctattccttttcctttaagaggtagacaacactgctcccgtcaagcatgctgggagacttatgtccctccaacactaatgttctccaggctcacgagaacaaaagcagtttctacctgtgttacaggaagggtactatgggagaggttttatgtttaaaagcaacttaaaatgaaaagaaatgtttttttcccatatgttaaaactatagtatattcttatttgtttttacttatggaatctgtgttctgtactatggaagtgacatccaactagaaagtgaagcttgggggtaactgaagaaagggaacctttaataagaagtaatttatttctatatctcattgagtcaaactgtttcagtaagttaatgatttatttggcaaggagatacagttgattatcctttaagcagatgatctatacaatatcttaatgctgtttacaatggtggtgaaaaagccttagagatagatttccctttgcctcccaatgttctattaaatgtggcacaccatgcaggcatacattgtttgactgtatgttcctgatgataaggagccttaatttagtttctaaggaggcaagtaaaaagagtatgtgctagagagagactgggaagagtggagggagggacagctgtaaccaagatctattgtagggagctggagagatggatcagcatttaagagtactagctgctcttccagaggtcctgatttcaattcccaacaaccacattgtggctcacaaccatctgtaataggatctcatgacctcttctggtgtatctgaagacatgacagtgtactcatatacttaaataaaatattttttacaaagaatatataccatcccatatacagtcaacaaatgcagacactattgtggatgccaagaagtacatgctgacaggagcctgatatagctgactcctgagaggctctgccagagcctgacatgtacagaggtagatgctcacagccaaccagtgaacttatcacagagtccccaatggaggagttagagaaagaactgtaggaactgaaagggtttgcagccccataggaggaacaacaatatgaaccaactagtactcccccagagctcccagggactaatccatcaaccaaagagggacccatggctccagctgcatatgtagcagaggatggccttattgggcatcaatgggagaagagacccttggtcaggtgaaggcttgatgctccagtgtagaggaatgtgagggtggggaggcggggtggatgggtaaagggggcacactctcatagaagcaggaggagaggggatgggataggggatttctaggggtggaaattgaggataacatttgaaatgaaaataaaatatccaatgaaaaaagatattttgtatgagaaaggaggtaattgtttattgctttagttcatcattggtacatcccaggatacagtaaataacaaaaaaaaatgtgtgttagtggacatatgaagaaaatggagactatatgaagcatgaattggaataataactcagaataaggacatgatggtttggatgtattcttggagtagatgaaaaacaggaataggaattcaaagtttggatttcatgctttgtataccagtcctgaatcaggatgctatttaacattatttgggaagtgggagaaaaatggataatgggtaaaataataacaatggataataatccataatagattttaaagtatgataaagggactttatttctaaataaagcctttagatatttttctggaaaagacattaggaagatatgagggtttagagcatggagttatgaagactgatatattctagaataaatacatttgctacatttaagtgtaccataagctgagttttagaactattgtaaatatgcatgcagtaacagatacagttcttgagttggcatgaaatccattttaatatgtgaatcattgcatttaaaggccaaaattactaaaagatgaaggcatggaatttagagtattggcactttcagattttgggtcttttacagatgaaattttagcacttggtgatatatgcatttagttttaatgctttgtctgggttttcaatcatatccataccccctttctgtcatattaaacacagacatttggcaaataagaacaaagagattaaactcttactaaatacaaaattcctttggcttgaatgatgtctttatttttgctgagtctagaaatacataagctttaaccaatactgggacagcatgaattttgaaatcatacatgtatggccttgtctcatatatagaaaagtacttctgtgtggcctagtgttatttggtatggttctggttaaactgtttggcagtttgaggtctccctgttgacctaacagaggtttgggaaatatcagtaaaataccacagtgtgagatgatttattacaaatgtcttgtatcattaatataagcattcttcctttggacgtccattttttttttaatttaaggaaatgtgaaagctcttggatcctgtaggtaaacgagaccacatttctcagtggcccaccttaaaatgagttgatttgtgttttcctccctctttccatttcttctgtccttccaagcatctcctatatcacaatgtggtcttaaattaactgtgtagtaggaagtgagcttgaacttctgatgagcctctgaatgctgagatcacagccctgtgtcaccatgcttggttatgttttgctgagatacatatgccagggctttgcctgttaggcagtcactctacccactgagctatatcacaaccccacctccttgtgtgtgattctgacatttcttactttatgagtcattttctctggaatgttatttcttctctaaatgtatcctccaattaaaccgaaaacccttcagtttgtctgaatccggtcttagcatgttagaatactttaactattttatccttttgagtagaggaatccttgttcgtagtctttgatatataatcaactgcactactgtcttatataaggcctgctttacttttatcttgggatttctctcaatcatcttaaggattcccccaacttctcaattgtgttcgataccctgtttcctagattctcttacctttacaacccttgggacatacccaagagtagctcattgagaaaagatatatgcatcatactgtcttaagaccatacatgactgctttgagtgatagtggtatttattagatctctttactcttagggagcagcctctggatggccattactcttctcttctcttctcttctcttctcttctcttctcttctcttctcttctcttctcttctcttctcttctcttctcttctcttctcttctcttctcccccccctctctctctgtgtgtgtgtgtgtttgtgtgtttgctaagcaagtgctttatcatagagctaaatcacaacctttctaactgttctttccagctcttttcaaagagttcaatttagaagctgatgcttctcttgcaagctctcgttctttctagcaatttcttacttttatcatcaaaaatggtgagggttgttgataactaatatcttatttttgtttggtgaactaaggctggatagtaaagtttcaaaagcaattttttttcaaaaagttttacagtaggaattaaaagacctcagtgtagctgggcttactcctgggtacaagaaataaggtctgggacttattatcaaagagcatgagagtaggcaagcagagatgggagtatataggaagtcactaaaagaagccatgagtagaggggattctgaaaagactgaactctctccatgactttaccagggggatgagatgtccaggaatgagggattccatcagacatccagactgactattccctcttaacttgcatagtcagttctagcattaattgtgcccagtaatggaccaaattcaaggactggggaagaagacgtctcagagaagtttggtgaaagtttgatcaaggagaaagcttttgtcatggtttgggttcttgaaactattattacatggggtcaaatattagcaaaaacatcaaggtagtctttataatatttatcaagaatattgtcatttttgtatgtatataacacatgctaagaattttaaacaaaggatagtgctaatcaagtaaatatgacaaatattgcatgttgattgcattgtttagtctcttttatgggtcctagaattcttccaagctatgtaaacacacacacacacacacacacacacacacacacacacacacacacacagaccccttcacaaatatgacatgaaagcatcaagaagaataggagaagaaaagaaaagaatggagaaaggatgtggtaagactaaatggagataacgggaaaggatgatatggttaatgtaattgtctacatgaaacctaatactatgtaacattaatatacacaaggacaattgtataaaaattgtgagggagaataatgttataatagaattgcctcataagcctagttatgcctagatgttataaccatctgaccagttaaatataattatgtatttatatgacaaaaagtgattgaatttttgtatttaaaacaaaattgttactatggaattgcaagatgcattatgctatttcagttgtggctgacaaactatctcaaaactgataggttgcataattttcttcagaggaaagacagaggaatcttggcacatttaaaaggttgagttagtcttaatttactatgattggagtacgtacaggttgcactattagctataaataccaataaactctggcaaaatgtagaagtctagaccagtgggggaaaattgttggcccttcttcaaatctgcgagacagacacatttatggtaatcatggtgaacagttatatgtatgaaagtcaaaactaagccagtgaaagcagaaagctaaaaaagccaatataaatttagtttggttaggtttctagtatgctgataccatattattattgactcttaggatcatgaggccctggaaacaattctttaaatttagtacagaatatttctattacatttgaacaaataaaaatatgcataatggaccgataatgccccagaaagatatagaacaccagtaacaaacatagaagagggatttaaaaatggtcaggataaaaggcatccatccatggagtaaaaaataggggcaacagagatctctagagggtgtcatggagatatgtaatcattttgttttgacggtttgatgcgatgggtgatatgtacagtatagtccaagatgtagccagccctaaattaaaaatgatcacctccaccaaaggtcattaacttatagaactggttacttaagaggaagtaggagtgaaaatacaaagaacataaaaaaatgacttaactatgtgaagactcatgatggtttcttataaagatgaatatttgggcattgtcttaacttttgagattgacagtaaaaaataaccccctgttccctatagcatgtgcctcagagacgacatcagaatccaagatgggaacacttgtaaagtttgacccattgtagatggaccattaggctcagatatcagccagatatgcacatataaatttagagtaaatcctaatatgagagttacaagttttgatggataaaaatcagaggaacttaacttttatatttctttgtctttgttagttctcctttagatagggtgccttcaaaactcatttttccaggtttttgggagaaagatttattatatagaccatatttgactacaatagtaattacccatctgggtgtttcttgtattggaggttggatagagtctactaattatctcaaagagcagaactttcaaatttcccttgtacataacttcaatttcccttttcagattatgcaatagaaatctcctcttcagtttttatggcttaatttttgtgatacatgttttacatatgtaggaaatcacaaggataattttaggcttctcaggaacaatggtttgttttacctatcctttctttggaatgtgaggtggtatgttaaaatctagttgaaatcttccttaattgcatggaagataggcccaagatgcagcttttgttgatgatgatgttgcagggcagaggactacattttgcatagcaagactttaaagcatccctgccaatttagcaccacagtttgtgctaaatcaatcttggtttcagatttcctactccacatgttatctgaagggcagaggaataatgagagcaaattatatgaataagagctaagtattgtttatttgagtattgaattagtttataaatttatttctattctgattctcagtctttctctccctcttggtcctgcccacctcattatctctataagtattttcattgaattgaaaaaaaaatatgagcaaacacaggcttaagtgacacaaatgtttctagatacctttaaactcaaacacacagggttccagctctgtgtactttgcctaattgctggcagtaaaaatgagcaaagggatttagggcttacgaatgttctacttggagggagttgtaattaaggttattaaggtctttgggttcctgtgtgttttaagcaaattaggactttatgtgttctttaaagagacagtaactctccacttcacagctatttccttgctgtgttcagtaagtgcagttagcacatgctggctaaactacacatgccctgctttgttctttcagggaaatcactgattaggtgaacctttgtctgctttgttttaaattagttctgtatttgaaactctggacaacttaaagcaaggacaaaggagtggagggtcacgatgagtactttgttatcaaaattactatggtaatataattattctgagtttctttattctgacagaataattattagcctttttgaacatgggaactggttttattaaccaaaaataatgtgggtccctgcaagatgttaccataaaaacaacaacaacaacttgcagcaacagtattgacactattgtataatatttccttgcatatgtgtaaaagaaagatctgttcttcgaaatgtccttgctcagtggtgcaaatagtaactttattttccatacttgaagttagtttctatttcaagaattagagaaaattttcttagtggaaaattaatttgtagtaaattgtcccaattaattgtttttccatttcattttccaggtgagccctttgttctaccccccccacccccccacacacacttttacaccaaggattccatcatgtttggggagggaaggccatagagggccagagtcctgtgatgctgcacttcctgctgtggctgccattgctcatctgtcctcttccttgcctggtacatgtcattgcatagcagcaatatgagtgggggctcactctgctcacctttcagattctgaatttctgtcctggctctgtggttgtctctagcctgtgttctctcagttcatcatagacaaattttgggtggcctcctgtactgcttctggctagagaggccacttcaagttctctttgcctggaggtctctctaccttctctcctgagctgtcactttgagtgtcaagagaaggagtattcctggtgggtgctactatggtgtgtcatttgttatcagattcttaaactcatcagcaggatatagctaacaattttaccatttctataaggtgagaaactgtgtctccttggaaggacctattcaacctctgtttccagttctttccctcaacatttttatcctgccaaagtaggtaatttgttctgatagttaccgttccatgtttacctatgagaacatttattgttctgagtcttgagtttctggttttaatactcaaagccaagtgtcttacaatgcagtaaaattaaaggaaagaacagagctttgttccaagattttaaaattctgtttggaaacttaaaatttgagcatctgtcttactttctttgacaatcttctctgagccagcaaattccacttgtgtatttgagtgtaaaaaagaccaagggctgaatgaagtgaaaggaaaaagcccctctcagttaatatttcaaaatatcatgttgtacatggtatatgtacttttttaagtaaagaaaaatagaaatacatactattttataatctgtcccctaaatcttttacatattaacactgttacacataatcaatcagtggctattttgcagtcaatatcaatagtcgttaggtattttgtatnnnnnnnnnnnnnnnnnnnntatttgcagtcaatatcaatagtcgttaggtataaagtattttgtagatgtacagtaaggtagttagctgactttaaacaaactcaataatctaagttgaatttatttgtgcatttacccaattaattatttttttcagctagattcttggaaatgatatttttgggttaggtataaaattcagtattgtgaagttctattctaggagatttatatcaccaggatagatatttgagaacccatttccttttttttctcctttaacatttaattaaataattaattaattaatcaattactttatttacatcccaaatgttgcctcccctccaggtccaggcaccaaaccctgatgctattcattactgatgctctcttgtgcttgcttgcccagaggccagtttttttttttttctttgtaaaaaaaaaattgttttgcccaactataggctgtaggtgtctttattcaaccagtaggttgaaattaaagagcaaggttacatgttatgatttccttgtccctgagggcaaccagaccttggggggtagtatttagtattataaaacatagcaacagatcaaacctcaacacctgttgtttggtatagagcatttgctgttaagtcattcagggagctctcatctcctttcatctcctctttcctttccttttttggagatagaacctttctatgtaattctggatgggaacttgctatgtagaccaggttggcccacctctgcctcttgagtgctgggattaaagggttgtgttaccacatgcagatgagttttctttattaaaaatatttatttttaatactttttaaacaatatgtataattatgtgcacatctctgcaggcaggtgctgatggaggccagaggtgtcagatcccctagggctggagttacaggtgattgcaaactgcctcacatggatgctgggaactgaacttgggtcctctggaagagggctcactgtttatcactgagctatcttatctacccagtcccaaagatttttctttcttttttttttttttccctgcaaataatgttttctttttcttttttttaactagatgttttcttcatttacatttcaaatgctatcccctttcttagtttcctctctgaaaatcccctatacccttccccctctctctgttccccaacccacccacttccacttcctggccctggcattcctctatactggggcatagaatctttgcaagaccaatggccagaggccaatttttaagtttactttttaaatttttctaaaaaaaaattgtttttgagtatttacttttttttcatactctttcatactctttcatactctttcatactctttcatactctttcatactctttcatacctttctttctttctttctttctttctttctttctttctttcttttattttcttttatttgatatttacagtatcctgtaagtatttcatccccttactactggattcaacactccattctcacctatgtatctaacttgagtttttgttttttgtttgtttgtttgtttgtttgttttccaatttagttgtgttgcccagatactcttgacagcggggccctctctgtagtggtcagcatattactgtcacataagtaaagaaaactaactgtccctcataagaaggagatgctatcagatgccagtagcttctcagctagtagtatggtttcatgagcatcaacatctcccttctccaccttctcatgctgggatttttgtctggcttgatcttgtgcaggccttgtgtatgttgttaaaactgttatgagtccatatgtgccactttcctgttctgtttgaaacattgtttacttaaaggtattcacttctgactcttacaatctttctactgactcttctgtgaagatactagagccttgtggggagacatatgctataactctcccatttatggttgataactctatagtgccttagttctcttcatattggccagttgatggtctctgtgttaattgatatctactgtaagctgaagcctctctgatgagggttgagagataaactaatatgtgggtatagcaataaatcatgtgcagtgattttcattctagactcctttagcagaaagataatactaggttctctttcaagatgtattactcatctatccacagattcttggctctattaacagtgcaaggtttatgccatgaagtgagccttatatccaattataaagtggttggatactcctttaacattcatgccactattgtgccagtgggaatcttgttaggcagatttttgggggattatcccacaatcataggctattacattaaaacatatataatattattatatttttatattttataataatattattatatttttatatatgctatttgtatatattttagaaagctttttagccaattgtagcattttatttaattctaataaatttctttttacttgattagtcttcatacaattctccagaacttcattatatattttaatgattacaatatgacagagaaagaaaacaaacagtgagttaaggaatccccctgcccttcctctctattcttttaccctagtttcacacactgtactgcatgcagaggaattgtatgccattgtgtccaggacagatcagctttgaaacaatgtaggtgctttatggagaaattaatgtagtcattttttaacctaatgacacacacagccagaaaagaacattcaatctatttggaatatggaggcacaatttctttttttttccttcagtatactaactgggtttgaaataaacattttacatctctcctgggtgggttctatggttaaactttcctaatcataaagatataaaaatcatgttggtggctatattttctattcaactttttattcattaatgctttgtagagttatcagtcatatattagatactattctgaacatatttatattttatataaactaatagtgagctatataaggagaaatgtatatgtaatttaaaatacaaagatttatttaagtatgtatttctcttttttttcttttctatttttttggatattttatttatttatatttcaaatgttctcccctttcctggtttcccctctggaaacccctatcccatcactcctccccctgcttctttgatggtgctccccccaccccttcctccctacctggcattctgctatactggggcatcgacccttcacagaaccaagggcctctcctcccattgatatccaagaaggccatcctttgctacatatgaggctggaaccatgggttgctctatgtgtactctttgtttggtgatttagttactggggggggggggatctggttggttgatgttgttctttctatggggttgcaaaccccttcagctccttcagtcttttctctaactcctccattgaggaccaatggtttaggaagcttctacagaatagatttccagttggcttattcagaaggtctttagttctcattatccctccccatattctcccttgtagtccaccctcctatccatggttaaagagggacattggagacaaaaaggttaaatgttcacttaaaaaataagacagggtctcactatgttacccggcctgacctagatcttatgattctctggcctcagtgggaaagccagtatttctcaaagaatcaatattctatgctcaagatcggatggcgaggactttcatttgtttctttaaacttttctgtttttttttggctaggttttcaaatattctcataaaaatttgttatttgttgtatgatacaacattcccaatgtgttgcttttcttttcatggctttatctttttccagatatatgactttgtcacatatcctaccagtaaacttttactctatgagcatagacttaaagaattgcaagcattgtgcatagtgtatttgtttgacatggctataaaattaagaaacatttacatgtgtttataatagtttcatatgtgaatctaatttggtttttattaatactatttatatgataacatctgttctttttatgccggttctactaagttccagttaaaaaaccatcatgttatggattaacaattaatttacactgaggacatttgcaatggtttataagaagactcaaggattcttgtgagtgactgaatcagatgtcagtgaaaggttgtcgaagacagcatgaactttgctgtgttgcccaaatgagaatgctgcttcctagaggccaggctgctgccttgttcggggagtgaggtttcctacaagcatcacatacagagatggactctgtgttaaatacacgaatttgaatacaactcactgctactctgctctagctgatgacttaagcaggactgttggcatgccaccttcctttttgagaatgagcaagaaattgagaatttttattaaacatatttctatatgatacaagtaaaacaaaaatgagactttgtaatagctcagctgtgtgtgcaacattataataaaccagttcccccagaaagcagctaattctacttcttgccctgtgcgtgtgtgtgtgtgtgtgtgtgtgtgtgtgtgtgtgtgtgtgtgtgtgtatgcatgtgtgtttgcatacacacttgtctctgtggatcagtgtaaggattctgtcttgtattgaacaaaaaccaatcttataatcagtgtttacgacttttgcttttccccatttgctgcaccccctttggagatctgttattggcagggcactgttagtgagaatgaaaggaataaagagtaagaaaatggtttccatggtgccaaattcttcatccctgaaaatgcagttggagattgtatgataaaatatttgcaagtgtctgctgacaaaacatctgtttagaagtggacacctagttacaagacactgggaggggagtgcacaaggcactttgttgcattttttggtgatgctaagttcgattacttagttgacatgggtttgatcaaaccacttcattggttgtgaaggcagcatagttcattagagttatgagataatcccttgggtaacttcagacacacacacacacacacacacacacacacacacacacacaccttcatccattggtattacgttagtaagatatattttggttaatgatcacaaactagtaattgctgtatcactatcagattttaaggcattctataataccattctataataaaattctgtaatacaactggcttaggctataaaaatgccaacaacaagacaacgaatagtgaatgatttgttttgaattaaataaaaataaacagctcgtggcaacacatactccctaattagtttgtggataggtggaacatggcatttcagagataactgagcatatgtggaagcagacaagaggtttagcatttcatccttgttacatatctgaggtctaacaataacattgtggctatagaagactatatccttcctctgggaagctctctgatgtttcatttccattgcactttgaagctatttactttgagaaaattaataaactgcaatatttttgtcttctttccaagtagcactttacatgctactaggtaggtttaatgcctcaggaaacttgccctttgacctgcatttattttaggattattctactatttttttctcccgagtatatctttttacattgtttatttaaatgtttgactttatcagtgagctttgtatcaactatgctgaattctctagaacttcattaatttctctaccttatgattcttattttgtaaatattctaattccttctctagtttgggaagtttagctgtaagtacaaaactgccttcctgagctttgcagtcatggtttgtaactctgttttctccagtggaattacactgaatatagcagtcactccagggcaggactcatgctcaggagtagttgaccaacatatgatggactctgaagggtgtgtgtgtgtgtgtgtgtgtgtgtgtgtgtgtgtgtgtgtgtgtatgtatgtatgtatgtatgtatgtatgtatgtactggtgggatttttgtttttttttgtttgtttcttttttgaggggtattgttttattttgtcttcttggttttgtttttgtattggtagggaggggaagaggatctggaagaatttgatggaggggagaaatatcaaaattaaattaaaaatgttttaaataataaaaatgtaataaaaagaaaaaagtatgatactcatgaaaggactatttcagactggaaatgtaaagagacaggaaaacctgatgcaatgtgtgacatagggtgagattctagttagaaaaaaaagctatcaatgactataaaggatagtattagaataattgatacaacaggttccaggatgataatcaagtaagtttgaaagacaaatatttttgataatatttattgaatcctgaaaacttgagataaagacctaatgtttgaaaatatgcatatgattcagaattacatgtataaatatttgagtatacattttgttgttttgtgtgtttgtattgtttcatatgcctattcaaatttatgtataagaatcctttttgagagtcatcaagtactattaacagttttcaattaatgcatatacatacatacatacatacatacatatatgtactttttacttgtaatgttcacgggagggaatgaagtcaggttagtgagcagcttactcccaaatctgtccacacttctctctttggtgcatccttaaagtccagtttgggtcatttgaatggggttctaaggctttttaattacataggtatgctttctgagtgacttcaaaggccccttagccagaatgggctctgtcttcaaagacagtgaagagagtggctcatttgcaggaaattgcatggtttgagggtgatttttgttttctttgaacttgtcaagtagagctccctgcttaaaaagtgctggccttttgctatctgaccaaacagttaaagacttttcatttatagttttggagatttctctttaacttctgccagaagaaacctgtaactcagtttcccccattatcctctttgatgtaacagcagttttatttggaagtgttggttggaggtgtattcacgattttcatggttttaatgccttttctttctagatgctgtatatgttttgcttagtgggggaacgtaaaacatggcttcttttgaagtaaaaggcgagggccagatttaagctgtgtgacctcagaaagcattctttatttgtttattacttcgtatgcctgaagattctgaatgatacgtatgttctcaagaaatccaagaagtgttgctcttctgtcatgtagcgtgttctccatgggaactctttacgtttgcgtttctgttctgtttgacatccttctttttcttcatctgaatttacagaatcatcttagaataaatttcatttggggcatcagttatggattaaggtgaagttagcatatccaccaatgaaagcatattaaaatgctttaataaataacataggacattggtttgaaaattaagaacaaaatctttgtgaggagatattatagtgaactagtttgatgcctgtgtgtacagctgcacatttgtagtgcaaatgatggcccacgttgaatatgcacagggacacactactgtgtaaaagtgaaagtcataactataattactaatgcatgataatctttgctaaacttaagtattagtggttctccataaagttaaacagttttcttgttttcaagcaaaacagagctaacaaggctgtgtccattcttacttcaaaacctcagtgttgagcactgtggaagtttcttcctctacatcacagggactccgtagttgatttctttttgtgggttttatatttgacatgaagtaggccgttcagtttgtttttccatttattactctaaaagttaagatgatgtaagcaggagttagccactaccttgttttctagagagtaggtggcctatgtagagttgttgaatacagtatggcatcccttccttccttttaagttagtaataatcttggtaggtagaaaggaagtctttgcatagtggcagttctatgggccagacactgacacatatgtttcagtacttacttagcaagcatgcaaaactcttttcacatagtgttaaagtaagaagtatttaaatgttttatggaacacaaaattgggtttgggagcatttattttctatttaagtaaatagattatctccttgtataaacacaggaccatgtgaaagtggtggtttcacaatcttcacgaatgtatatatttagatctgcttgtggtggggttaccatgagcacagcattgtgcctatattttgtcatgggtcttttaagtatgttgttaaagcctaagccaagtttaagcatgagtaatttgtatagcacagcagtttctaaccatggcttagagggtctcacgcattctaactttaagattttcttttggcattagaacagattcatggagtaaattatgtttgtgtggatcccaacaggtggcttgttttatagagcatatgataggattcttgctttgttttgaaaagaaggaccattttctaaactttttttgttggaaaaaaaaaagagcagtaccaactcagccattatgtttctttacttaataattaaatgctatgggtactaccagctgaagaccttatgttgatggtggctggttgttttcttcttctcctcttccctccccctctcccctcccctacctcttcccctcccctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctctctcccatctatctgcctgttttttgatttcatttgtactgctgtaataaaatattccaataaaaggcagcttaggagagaaaagagaaaaggggttatttcagcttatagttttaggtcccaatccatcattatggggaagttaaggcaggaacacattcacagccaagagcagagaataatggatccatgtatgttcacttgcttattggtttgtgcttagctaattttttttttacccttttatagttcatacctgtctagggaatggttctgtgcacagtgaacagggtttttatctagcatatatcttaaataagacactcttaaatggaaatgcccaatggagacaatgccacattgaatgtatcttcccaggattttaagttatgtcaggttgacaattaaagctaatcattgtgaatgtatatgtgtatacattgtgctttgcattgtgacctatgtgctttttggatgctccttcaagtttctgtgactcctgacaacagtgtatgcagctttcctttgcttcaatttttgatgaaatacatattaaagggatgttgcattttcttaaggtggaatgagtttaccaaacttacttttgctttagcaaccattggtatagtcattccatctcttccaggcttgcagcttgtcttgaatattaatgaagtctattagttgttatgttagaaagagaatgtttttatcacatactgaataggtctgctctgcccataagcaatgcccggtaacgcagcatctccattttgcccctctgtcttttgtagacccacagacatttaagtgttctgagcttcttggaacatcttagctgacttgtgctgcagattgtcttttttcctcgaactgtatttaaaacaaaatcccaggctgtgaaccatcctgtggctgtaattaatcatggctgtaaatgttttcccatagtaccagtttatgaagcttatggctgaagtagtgctggctctggagggtaattagggatttataattgttgtactgatgtttgggatgatattagcacttcatgtgttaaaatagatttgtgactcttaaatctcttcataatttaaattctacattcttctaatggtaagtttttctactatgacatgtgttttgttagaagcaaaatgttacagttgaagatctttaattcagagtactgatttcagaccagggtgtggcagcactttcgtatgacttagttcttttatttatttttattttttattaatcattctattcatttatatctccaatgattcccccttccagcttacccttccacaaacccctcccacatctgctatttccccacttccctttgcctctatgacagtgctcccctccactttctccctcccgaccgctccagcatctccctacgctagggcattaaacctccacaggaccaagggcttcccctcccattgatgtcagacaaggccatcctctgtaacaaatatatctggagtcatggatccctccctgtactctacttggttgtggtctagtccctgggagcactggtggtccagtcagttgacattgttcttcctgtgggtttgcaatccttctctatttttccagtccttctgctggctccccaaccagggtcccggagctcagtctgatggttggctctaagcatccacatctgcactggtcagttgctggcagaacttcccaaggcacacccacaccagattcctgtcaccaagcacctcttctcatcagcaaaagtgtgagggtttggtgtctgcaaacagaatggatccccaggtggggcagtgcctgatagccctaccttcagtctctgctccatttttttgtcccagtcttattatattttattttttttggacaggaacatttctgggttgaaaatttttgagatgggtgggtggctttttcccttgactgggggctatgcctacatgcctgtgatttagttcttagttcaagtcaggtatttattttgagctccagagcatgatgctcccaaaatcaaaacaaaaaaaaaatcatttctagaagagagttccatattttgggagtgaatatattttagaaatattctttttctaatgaatacttttagatataaggagatatccaaatttttattactgacacaattcaggtgtataaaatagaattattaaataacatttctacctcagcagtggataattctcaaaggtcctgtttgagtgtgaagtcacagcttactaaaccttattttattttactttgttgttcctttgtttttcctttatttattcattttattaaaaatggattttttcatatagtttttactgggtataacggtccctccctgcagcttctcccagatcttctctacctctgcaactgctcaacactcacacttttctcattctctcttattagaaaacaagtgggcatctagaaaataataataaaagaaaacaaacgaatcataatagggcaaagcaagcaaacaaacaaaagcagccagagaaaaccataagaaacacatagatgcaaagacacactcatttgcacacacaggaatcctataaatacacaaaaaacagaagctataatatataaacagaagactgtaaggttaaaacaaacaaaccactgagttcattttgtgttgaatgctgagcatggggcctgcccatgtggtctgtatacccagtaagcctctgtgggagaaacttagtttctccttgctagtaatcagttggtgctagatgctggattagagatgagggtttatacccacttcccgttgcagcacttgttccctatcttgtgtaagcctcatttggaaaagaactgttgaaggacttgagatgagaaatgaacaaaaatcctgagagtatcatttagctctagaagttcaaaatccttagaacttttttgcataaaatttacccttggttattatgtttctatattaaattcatgtttattttctttcctaaatttataatggatgccatttagtagtgtatatctaaattttaataacatttaaaatttcaaatattttcaaccttggctatgatgacttgtgaacatcattttatatacttttaaaaaatttaaaattttttaaaaataaatataaaatttgttttcatgttactgcattccatgatttatggtgatattttatgcaactattaatttcgtgcaaaccaggaaagtatccagataggagttaaggatttttagcaaatgttttttgactcaataattgatggccttggttgcttcattgagtgtgttgatataccgaattgctggattttcatagcagtgttgtcagggccttatggaaagcatctgggaacaagttaagttgtattggatcccattcaaattgtcgatgccacaaatttactcatttttactatacactttggacttttggatgagtatgcacattagaaattttatgattagctccaataataaagtgacactgacattttagtttgaaaatctgtgtaattcaccgtagcatagtatttaatgagcaaatgaggagtgatgttcaggggctgacaggctattgttgagaaataggcatccgtccctttgtaaaacttagatgcctgtacctagaagaacttagtgcgtgtcttctttggtaggggttaactccagaaacaggagagcaattttaaaaagtatcaggaacattggaaacagaaggctggtcaacatatgagataaaaaatgtgtatagctggatacatttaacacacgatcaaacttaaaacatcccaattaattaaaaaaaaaagggtcagacttggtttgcaatttcaaaggaacacacttgaatcaacagaattatgttcaagttctaaggatgctgccttttctcatgatacaagtactggcaatgtggttttgctccttgattcaaacctatccaggagatggctggcctcatgcagaatcaccatggcctttttcagtggtctccatgtttcatgtgaggagcttctttccagtcttgggtgggcctagatttgggagcatgttttggttggaagtactaggctctgggtctcagcaggctttgaggttggagaagttgaagcttacaggaaaaacacaaataaaccatggtcatcaaagctgagaattaggaactgtttattcacctgcacacttgaattaaatctcacagaaataggcagaatcatttgacttgtgaccttgatagaatagtcatgtctaagtttctgttttgcctgtgtttggatacagagttagggtagttaccatacataatagatggaaatattctggccgaattactcttggagtattgatttacaatacagagaagtctgcggagataattggcgtggaatgaaggtcagttaaactggaaagtctgctggatgatcggggcaagagagtcaactggtaaacctcatgttgctcttgttcttaggagatcacttaggttcgggtgtggcccatcactcctgctttacaagcatccctcatgggtcaggttatacagatgggaagatagagactatggcattcgttccctaattcacttttattgcttaagtctgtcaaggtccaattaaccaaagcaatgttttgtaacagttttaagaataccttttaaaaaataagtgtagggcaaaattggttgactctgaaatctttgtggtcaagattaaagtcgtcttttgattcataaatgcaaaacaagaaagcctttaatttgtgttgattctcttggttctgtaattcttactatgtacttcttactatggagtatgatttacgatgataaagtgctcttggtttgacctttgaacgcaaagcaagtatagcttcccttgagtgttgtgatcactgtggaatagaaaaccccacttcaacattcttccatgagtataaaccttacaaattctcctctcccttcaaagctagctttgcaattcgaataaccttttacaaatctgtaattaactccaagagcagaggacaggcagcactgggtgcagacagacctatatgctgggctctggatgcagcatctgccagcaactcctgttcctgctctggtctcctagttgttcagacaagagttctaaatgccaatccacagggcagggggctttaggtggacactctttgtggacaactctgaaaacgagagagctggcctgttcctagtcaatttttctattccatcacagcttctcatttcatctttgttgctcttccccagctatctacactctatcatttgctctattgctgtattactgttttccctttcttacacagagatagtcaactggttctatttgttaaaacttacacttgccgcagacaccaacaacagtattagagtaaaaccatttttgaaggtaactgggaatataaagaagctgcttggatctgctttattaaaaaaaaaatcacaatctctggttgcgttactatgcagtggaaatactacagagatcataagtgaggaaattcatttaacaatgtaattcagggtgaatgagcccagaattgagctctataagtattcaaaggagattagcagaactaagaataaagagtggaatcaagtgggtagcagatgttgtaagagtgtcatagaatatgagaaggaaaacaactttagcaacctacgctgtaaagattatatgtttagcaaaaggatgtcctcttatactaaaaaattcttcctatggggtggaaaacccattcagctccttcagtccttccccttatctgtccattggggtctccatgctcaatctgatggttgtatgtgagcatcctcatctgtattgctaaggctctggcagatagagatttttttcttttctttttataatctgtctctagcaggctcctgtcagccagcacttgttggcatcagcaatagtgtctgagttttgatgtctgcagatgggatggatttccaggtgaggcagtctctggatggcttttccttcagtctctgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggttatataatgagatccttgtttcaacatatatagaacttggaggagtagagggcaggaacccataaaaggatatattatgtgaggaaaaaagatgatatattcaataaaaagaaaaaataaaagaaaaagtgaaaatattatacaggtggacatctaattactaggatatttaaaatataccaaaaaaataggcatggtgatactggagcagccaacaaagtgaatactaagagactgcagttcctgaacccaggaaatgcctggggctgtctagagcagactgaggaagaaagaattatcttgagaagaagtgagctctgctcagatgcttggagccatgacgatcagcctctgcagtgagctcctctcacttaaaccacactgtaatatttgttacagtcttccattgaaactaactctacacatagaacttgtcttagtcagggtttctattcctggacaaaacatcatgaccaagaagcaagtcagggaggaaagggtttattcagcttacacttccatactgctgttcatcaccaaaagaagtcaggactggaactcaagcaggtcagaaagcaggagctgataaagaggccatggagggatgttctttactggcttgcttctcctggcttgttcagcccgctctcttatagaacccaagatggttctataagagacccaagaccccacccacaaggggcctttcccccttgatcactaattgaggaatgccttacagttggatctcatggaggcattttctcaactgaagctcctttctctgtgataactccagctgtgtcaagttgacacaaaactagccagtacagaactcttcctaggtcagctctcaaccttcatcttcttatctctatgccatagagcttctttgctcatttcctacagcattcctttttcctttctgtcttgattctttgacaaagatacagtgtattaattttgttcctcttgtgactgtgttttgagaatttttgtgttctaaaatcctttctttattgcagtttttatttaatatattctttgatgattttatacaggtatataagacctcctgtttactctcatccgcctgttgctgtctccctcacacctgcatttcctacaattctttaaggttttattttcattgttgagtcaactttatagtacgaacatcctgcagggtgtccatcccattcatagacactaggcctcttttttttctgctaatattttttattagctatttatttcatttacatttccaatgctatccccaaagtcccccaaagattcccccacccactcccacttcttggccctggcgttcccctgtactgaggcagataaagaccaatgggcctcttctttccactgatggccgactaggccattttctgatacataagcagctagagacacgagctctggggagtactgggtagttcatattgttgttccacctatagggttgcagaaccctttggctccttggttactttctctagctcctccattgggggccctgtgatccatctgactatgagcatccacttctgtgtttgctaggccccagcatagtctcacaagatacagctatatctgggtcctttcagcaaaatcttgctactgtatgcaatggtgtcagcgtttggaagctgattatgggatggatccccggatatggcagactctagatggtccatcctttcatctcagctccaaactgtgtctctgtaactccttcaatgggtgttttgttcacaattctaagaaggtgcaaagggtccacactttggtctttgttcttcttgagtttcatgtgtttagcaaattgtatcttatatcttgggtattctaagtttctgggctaatatccacttatcagtgagtacatattgtgtgagttcttttgtgattgggttacctcactcaggatgatgccctccaggttcatccatttgcctaggaatttcataaattcattctttttaatagctgagtagtactccattgtataaatgtaccacgttttctgtatccattcctctgttgaggggcatctgggttctttccagcttcgggctattataaataaggctgctatgaacatagtggagcatgtgtccttcttattggttggaacatcttctggatatatgcccaggagaggtattgcgggatcctccggtagtattatgtccaattttctgaggaacacatccttaattatcagggaaatgcaaatcaaaacaaccctgagattccacctcacaccagtcagaatggctaagatcaaaaattcaggtgacagcagatgctatcgaggatgtggagaaagaggaacactcctccattgttggtgggattgcaagcttgtacaaccactctggaaatcagtctgctaatattttatacatttattcttgtctattgcttggtttatccatttttttgtcctatacacttggaagtaagtactttaaagttatatcaagtgcttgttttcttagaattttatttattggtgtttctaattgatagtgaagaaactttgaaagtttagttttggattcccttcaagttttgtttatcttaaatttaaatgtatatttttaagctctggagatgaaaatgttttatttttctaattctagtaaagcttaaatgtttgcttctccagggtgaggctatatgcttatatttctatgtgagtaatgcaggaacttgtttttttaaatatattttttgacaacttcatatgtgaccactgcatctgaatcatttttccctccctctctacacttcaactacaaaggagtctgttttcccaagttcatgatattttctttaattattattgttccatatacattcacacatgcatatacacccatgtgtatattacctgtaaggtccattagctttgttcatgtatatatgtgtgtctagggctgatttcttggaattggcaaacctatgtgggattttttttttctggaggcagttttttctcccccctctcagcagccattgacctacacctcttagtagaggtgggaccatgtgcaatctcttgtgtgcactggtatgtcaactggtgtaactttgctggtcttataaaggcaaccatattattgaaagttcatcaatgcattttctctgacatatgtagcagacatgattcatcagcaggcatctttggtctctgcctctcagaacagttcttccccctctttcatgattttccctgagccttatgtgtagggattaccttgcacatgtatcagtttggatttcttgctccacagtcatgtagttttcatattttgaccaggggatatctctgtcttgagctgttgcaacaagaagcttctttgacaaggggtgagagctacaagtatctatgggaataaagataagtatttagaaaacagaaattatattggtgtagaaactgggcagtagcaggtcctcctcttgggtatgtgatctgaaccatctttctttgcacgatggtatatagaccaaatatctaatcatattcatattcaaatatttttgttttctgtttttctgttacagctagttatgtatcaaatcccatttgcaagggttgtttgtcttgttcgaaggacaatggttgcagccgatgtcaacagaagttgttctttttccttcgaagagaaggaatgcgtcagtatggagagtgcctgcattcctgcccatcagggtattatggacaccgagccccagatatgaacagatgtgcacgtaagtatttgacttttgtccatcctattttacttgatatgaaatttacataatgtgctaaattattatggaaaaacatatatgtaaccgtctgtagatatactttaaagccttcaaaaatgaatatggtaggataagagaacttttatactttgtattttgtgtagatatatcataagctagacacattctttcagtaatttagattaaccatttctcattatgttaatctaaaaatgcttgctagatagaactttataaggagaaattactacttgcaaactaaccagttatcccctccaaatgattttactatgcatggaaaaatcttctttgatataatcttatttttacagttcttttccctgcttttgttagatctacaaataaatatatatattatatttgtaatatatgtgtgtatgtatgtatatatatgtatgtatatatatacacatacatatacatacatatatacacatatacgtatatatgtatatatgcatatacaatatacacatatacatacacacacacacacacacacacacacacacgcgtgtgtgtgtgtgtgtgtgtgtgtgtgtgtatgaatgaaacaccaagcaccattactggtaaaggtgtaattagggtgtttaggttttaggttttggtttatgttttgttttgctttgctttttgttttgcttttgttttgttttgacaaagcattttagtcaagtaacagaataaataatttgtaccagtagtcaagatagaaatagtaggcttagatgaagtttggatttacctttatttcatgaaattggatcatttgagagatgtaacttagaagtatcaataacttggttgaatttccaagaatatcttacatctttaaggcttatgatttgacccatgcataggacagaggtctacctggaaacaattttctgttcttactggctcagatgacctctagtgaaatttgagtatcttattgtcctgtgcaatttttacctgtgtacttttcagtgtacaaaaacataaagatagaagtggatagcttgaaacatttactctaaattcttgagctattgtgatatgaattgtgtgtatgggcaacagtctggctgtacagtaaccaacccaacctgggatattagttagtgaatatatataataatagcaatgatgctattagtaattatttgagggtatgggccacaattcaggatattcttggacaagtttgtttgaacagttatctctgtaggagttcctgttgtaccagcacttgacttcagaactcaaggcaagaattgacatgttccattgaaaccttttcctaagaaatggactgtaatgattgattgggttttggaaaaaaatattacatgtgagaagggacttgctatggttctacttttttaagtgaatgcgatcaggctggagattacttaccaagaagaaatcattacttatgtcgatcaagtgggaagtgcttattagcaaaactataaagtagagtgagagtagagaaataatttgttgttcatgacatcagattattatggttcctccatgctattatcttgttttcagtctttgcctgtattctactgttttatatagcatctagaagatggcaataatttaaattataatactgatagtagagaattggagattatagctacttttcactgagattattacttgaccatagataaataagctttaagcaacaggagtaatgtaaatgaatcctgccttttcatagtgctgttttgtgatatagtgaagatgcaagtataaagtggttatcttccaaaggaacactttgctctatttgttggctgaagttggcttcttgggatgtacattatgagttttgtaaaattcataaatgctcatgaaaatagtcactggattagcctactgaagtatgctgtgagcatactcacagataatataagctcctattgtccctggtagtttaggtgatgtttccatcatactttttcttcctcacttagcaattcatttacctggaagcaccattttaaaattgttgcatactcccctatttagagagcttagaaatgaatcttaataaaatacaaatgcaaggatcaaaagcacatcatttcccaaagacactcaaagttaacatcttgggttcagcctcaagagtgtgtttctctccatggttttgccctccatccttacaagtatgtcataattgtaatgtattttaccttaatgagttatggctctttctatgctattccacatagctgtacatatatttctgcatctgatatgcaacatttagctaatcacccactacaaacttactttcagactttaagaattacaagtgctttgaaggatattcatttataaatgcttctttttttccatttacaaatatactcttgtatatttgtctgattcatcttttaacatgtacttttaattatagtacctattttaatatctttaggtacatattacccaggtcctcttgaaatttatataatgtatacacaagtgtccgttcatatctcaaccaacaggacaacaggagagatttttttccttttccctacctagatgaaaaaaaaatgaaataaatgaaaataagtgaaaagaatgaaaaaaaaatatagagtagtatttttgttttaatggttttttcaaatgaagctatgcttttttttttttttttttaagtatgagtgctggtatttagtatattttccagaaaactcacttctttcttctacctgcaaaattgtcttaaaaattttaaagaaattaaatgaaatatcaattcaaaacaaacttgacgaatagtgaatacagatctgtctcaaagagaaatgacacatgtaaccatgggactcaacaagaatgtcaacaggcacaatcacaggcttcttattcattattctttcttcctaaccaccatcctaatttataagcagcacatagctgtatcaatgttaaaatttctcattttgttaaatccaaagataatcaagttgattgtatgccacagaaacactgcttgttgtttagcttctgtcctgggccaacatctctattatatacatttttctcaattgtctaaaatatagtgcaagcagaatgtctatttacattagctgggtgaagttacctaaactggttaacataccctttccaaaatttaggggttgagtgtagcaatgaaggaactagtatatttgaagattatgggtgtttttttatattgttagaattcagtattataaatagaaaatgaaaatattgagaaattatcttacacgaataaaatgtaagcacttaggtacaggttaactatatagtgagaagttattctgggttgattgtttcaaactacagtatgacaggattgttttagatagggttttcaggtagcccaggatagcctggaactcaatgttgtaggtttttttaattaataattttatttatctacattccagacactgtctgcctcatggtcccttctcccacagttcttcatcacattcccccctctctttgcctctcagagggtactatcacttgagattttgatcttagccattctgactggtataagatggaatctcagagttatttttgtatgcattcccctgatgactaaggacttaaacatttaagtgcttctttcccattcaagattcctctcttgagaattctgtttagctctgtatccccctttaaaattgaattatttgtgtttttggtgtctaacttcttgagttcttcataaattttggataaaaccactctgtcagatggaggggtggtgtagatcctttcccaatctgtagggtgccattttgttctattgctttactgaagcttttcagtttcatgaggccccatttatcaattgttaatattagagcctgagccattggtgttctgcttaggaagttgtctcctgtaccaagtagttcaaggttgttccccactttctcttctatgagatttagtgtatctagttttatgttgaggtctttgacccacttagacttcagttttgtgcaggctgatagatatggttctatttgcattttctacatgcagactgacagaccaacatgatttgttgaatatgcttttttcccccattaaatagttttgccaaaaataaagtgcccatcggtgtgtgtgtgtgtgtgtttatttctgggacttgatcaaccttgatcaacttgtctattccaatgccaataccatgcagttttatcactattacttggtagtatagcgtgtagtcagggatggtgatacctccattttttattgtttattgttcaatattgtttttactgtcatgagctttttttttttttttttccatatgaagtttgagaatttccctgccaaggtctgtaaagaattgtattgaaattttgatagacgttgcattgaatatgtagatggccattttcatcatgttaatcctacctattcatgatcataggagatatttccatcttctgatatctcccgtaatttctttctttagcgagttgaagttattgtcatataggcctttcactttctttgtcagagttaaaccaagatattttatagtatttgggactattttaaagggtggtttttctctactttctttctcggccagtatatcatttgtccaaaggagggctactgatttctttgagttaattttgtatccagccactttgctgaaggtgtttatcagctgtaggagttctctggtagtaatttggggtcacttatgtatactatcatatcatccacaaataatgatactttatgacttcttcctttccaatttgatctccttgatctactttagtttttttattgctctagctagaacttcaagtgctctattgaatagagaggaagaaagtgatcagcctagtcttgttttagtggaattacgttaagtttctctccatttagtttgacggtggctattggcttgctgttacttttaaatgtcagctcaccacaacctagaatcacctgagtaggcagtatcaattggggaattatttatatcacccatgggcatgtctgtggaggacttttccaatcatttattaatctgggaagacctagcccatagaaggtagaaccattccatatatcaggcagaacaaacctagataagagaagaaacaccttagcagacagcattgatgcatttatttctctgttcttgactctgggtgtcatgtgatttttctgcttgaatttcatcttaacttccctgcaggatggacagtaaccttgaattgtaagtcaaataaacccttcccttatatagttactttttgtagcattttttttttgtatataaatccctgtggtgggttcattacccacctcaatgctttacattcccaaatgaaagacaccctcccacacacacacatacacacatagcctttatattttgatataccttaaacagagtaacagccaggccacttcataacctcctaacgtgttttatccacctcccaccaataatcctgagttattacttacaaaattttatattctgtcttggctgccctggacccagagggtccaactgggccgcactcttctgactccttcacatgctggctatgcctgcctgtcctccactattctcaaacatggcatcttttctcaccttctccttctcccagcatggtagatcttcctcctcttcctttgctctcaagcctgggaaaaatctcaagtcatgcctttgtctgcactgcccagtcattggctgctggcatctttatttaccaatcagaaccaacgttgggcaggatccctcaatgttttacatgaggatgtgcaaacaattttagagacccaaatcaacataagaatacaagcagcattaggccaaacccactacaactattgtttgagtattttatcccagctcaaaaagtgaaactggaacatttttttctgttttgagttataattatataatcattgcttaaaataattaaatcatatgaaaaaaaagtttatccttgaaagatcaaagtagtcctcttactaggtatggttgaacagcattagttatgtcattgtgatgggaagcatcatggctaaggcatcaataatttagtgggctgtgtcaggatttgttttagttatttgctcatttgtttggagacagcatctctccacatagccctgactggtctcaagttttgtagttctcttgcgtcagccttctgattgctggcattataacattcattaatatatgtggcatcatcagagtttttcttagctatttctttcaagggccttcacctgtatacctacccttgcagtgtgagtgctgcaactgaacttggcacattttctctgaccacagcaacattccttttaaaaggcttataccaccttgtactctctgcttctttgaaaagtaaagcattggctggacatgtttttgtttttgtttttctttttttctgtttcttcttcttttttttttttttctagagagaatttctctgtagacctggctgtcctagaatttactttgtccaccaggctagcctcaaactcagaagatctgcctgcttctgcctcccaaatgctggaattaaagttatgcaccactatgcctggtcccatgttgtgactacttttgtgttccaatagagttgaatagtttcaacagagaccttatggtctatattctataacatataccctaaagctctgtacacttgctgtaagcctgtgtggagtgtgaaggaattaagagattctttttgtatccagtgggcagaggtcaggtggaggatgagatgtgcaataggagacacttgtattttccttttagcggggcagataaaattgccttttccaacattccaattggacactttccagtggggactcaggtctgaagtttattacactgttctggattcaccttacgatgatggggtgacaagttaccaaactaggaaaagcacaaggagtgaccaagatgatgaaatggctgctggcaagaattgaaaatctgatatgaaatattaatttgccttataattcagattttcttcttgtcgatttgacttcgaggttgttgtgtttctcccatcttccttaaatggaaacacaaatctctttagagcctggcattgcattccccaaggacaagttctttcattccatctgtttggaatgcaatttcaagagaagctgccaatatctttatctgactacttagttttatatcggattggatgtttctttgttttttttttttttttttttttttgtgagtagaaaagataccatatttaaaatagtgtagagatgatgtcagtaatgtaaatcacaaatttgaatttggtgcttacatacacaaaataaagtttaaagacttaaaaatgagtctgtgcaaaaaaaaaaaaaaactgtttgacagcatatgtatttctagtaatcaaaataaagtatgcctagcatgggaaggcatgcctttcactgtacaccaagaggcagaggcaggattatgagtgttagatcaaccttggcaacatagtagagactgtgtcaaagaggagtactatggcagatacaaggtagaactgtatacctatccccaaagcaacctatttctgggctgagttcattcacctaacctgattatactttgacattaaagtttacctaagccagggctttactgtttaagagaaataagtgaggtgtctccttcctctctagtgaagagtgtagggatataaaggtttctccttggccatctttcccttacctataagttgctttgagtccttgtatctaatactcaaagtagatgactttccaccaaaggtgtgtgtgtgtgtgtgtgtgtgtgtgtgtgtgtgtgtgtgtgtttatgtgtatgtgtatgtatatgtatatgtatatgtatatgtatatgtatatgtatatgtatgtatgtatatagtgtgtgtgtgcatgcgtatatgtctctgtgtgtttgtgactgggtgtacatgtagtttcagagagctaaccttctgttaagtcaactttagaggaaaaccatcaggaccctcttaattcttgaagctcaccaagaacaagcaaccatcagtcctcattacctgttcttcttctgctaccttttctttttctgaggttatcgtcgtattaaatgcccctgtgtctcctactacatgctgggatgactgtacttgatgacaactggctgattacttcacatcagcacctcatttgagagtggagaggcactactttctgaaggcatctagtccccaagtcatagctgtatcagtcaaagaccatccagtctccaggaattcctagagatttctctgctcattatagggtaaaagtgaatagaacttaaaggaatgacttattcagaaaacagcaacattagactttcagaaatctttttacttagtaaccattgacaacaacataaactgaagagtctcaaagttgcatatttttagacatctctaataatttcaaatgccactgtgtaacactccttctccaaactggcaaaagattataaatatccctcagtaaaacatttaagttaccaaaaataacatatttctaatatgttagtacattaatttcaccacaatatgaattgataaaaactacaacctaaaagctaaattcactttttttttcttttttcttttttgctatagagtttaggtacacactgctcctcaggagatttagtgcatttcagactaaagaaaataaaaggcagtactcacgttttcatgtttagagctcaactacttgtaggacaatgtagagaaacagcactactaagttaatagacatccctgctgaagtctggggaaaactcagtagaatcagttcaagtcaaaatacccattactagtaagcacattaatatgaatgtggtccaattatcttgagtaaagaacaggtaggacacctggatcagaggcacaactgtgactttgatgagataactggctattccaggtgtactgaggtaagcaagacctgaggatagatcctttagtagtactcttacaggacagtgggcaacttggcaagattaagattctctttgccttaatgcccctaaatcttctcttactgagagaacatatttgtcattccagtactgaaaagattgagacagaaggactgccatgagctcaagaccaagctgggcttcatagaaagattgtatgtcagagtggagggaggggaaggagaaaggggatggaagggttgggggagggaactaagggaggggaaagaggaaggggaaaggtgagtgagggaggggggaagggagagaggggagagggagggggaggagaggagataaagggaataaacaaatgaacttactaactagaacaagataatggaaggaatgtctttcaaaatacttcatatagaaaaataactttcattaatacatagttaatcattaatgcaatgaaaatataagtgaatatgtgacaagcaaaataaatgacaagcatatttaaagacttctctctgtaagaaacattagttttactattgctgctgtcatttgttgcacatatgcgcgcatgcacacacagctttctagtattaagtagtcacattattattcaattgcttgtctaagcgtctttcttgaggttactcatccatcaggtctcctagcctttgagggtttctatctgtctaaatgaggaaacaaagtagccattctattttagccagtttgctcttgtgctcaggtatcagtagatactatacactatgccatttcaagtccctaaccttgaagccaatattaatcttaataactttaattgttagtcaagtatttaaaagccacataaaatgtggacaatttatgttcttaaaccacagcttctgaacaagcatccccagctctgaacttttccccagtaagaccagccttccccaggtctctcacaggccacttgtgtttcctctgttgcttccacaactccacattttcaaggctgttctgtttctaggatagggagtttccagagacctggaaaggggataacatttgaaatgtaaataaagagaatatccaataaaagaaaaaaaagttgtgtggattatcagtaattcacatgttggctgttttgataaaataaatatcaagtgcttcaaaggggggaaaaaagatgtactaagtgaaaccagcccaacatccacagtatatattacccatggtactgtgataccaccctctcaatctcagttgttttcagatattttctagtttttcctgtgtaatttacttctctacagctagagaggatggtttgtttgggtttttttatttcttcatatcaacgttctgtacagagtacatgctaatgatctcctacttagtattcagatagttaagaaattaagcttttaaatggcattcatgattgtttacttggcaagagctaaaattccactcaatatcaagtacagtgctagatatggtgaattcataaatgtaaacaaataaaaacttaaagacagaacagcaatggacccttgatctcagtctgcatagacgccaccatgcacgtttctcctatgtattctgttattgtttgatactgtgttagtgccacgtggctgtggcccatcactttggcattggcatccctgggataggggaatgagtgttaaggaaccatgttcttagggtctggcagcatcgtcggcacataccaggttcttggggaatgctcggtatgaacaagactagagtataatttgaaaactgttactttagagactgtatggtgtggtgttgggaggacaggcgagggggctgcccagcatgcttttctgtttcttggctaggataagcccttgtggcccaatgacagccctgtcagcctgtgtttggccacagtttcacttggacagtaattttacttaaaccaatattggcagtgctcacttggtggattgcatttttgaggaggcactgtaatgaagaagcatggaagttggctaaaggaggttcttacatttctgaacaaggactttaaacacatacttttacagcaaaagcctatgcttagtaaattttgatatacctattatatagtataaatttttcaaaggttaaaccaactactgcatttcccattggcctttaaatggtgtttaacccattacatttatgtgttacaaagaggtttcctgaaacacctacaggaaacagttaacacattgacccttctgatggagtgagcctgggatgtctttaggagagaaagaaaatttctgtatgtttttaaaagtttttttttgtaatgttttaaaattttatttaaaatgaattttgtgaggtctgcaaccctataggtggaacaacgatatgaactaaccagtacccccagagctcgtgtactctagctgcatatgtatcagaagatggcttagttggccatcattgggaagagaggcccattggtgcttgcaaactttatatgccccagtacaggggaatgccagggccaagaagtgggtagtgggtgggtnnnnnnnnnnnnnnnnnnnnctcccactcagaatattgcctcttggagacctggctggattgggagggagcacctggggctgctgaaaaaggttttcatgggctgcaggacatcagggtggagtttgtgggggaaagtggcttgcacattgctagttcacaaggcctttggtttagcgctacatgctaagtttgtgatataaactgaatccatagaatccatgagggccagccaaactctatatatggccattcagcatcagtcatagcattggaagaacgcctcgctgcgtagataatattttcaggtgtgtttttcatataatggaagggttaagtgttatagaacattaggaaacaggacctggcaatgaaagatgaaacgaccatagagttagtttgaaggttaaagcaggtttggtaaaagtaaagctctagctttgtgttcccaaatctagaaagggctgagacatgatctaaaatgttatttgtttttccttgttgatatcgaaagggctatttcatagtgtttaatataaaggctttttttatttttgtaaacccaggtagcttattaaactgtatattttaagtaattgtttctgttattttcattatattagtaaatttcacttacaaaggtttcacttaatttaaggacacatagcgctttttgacacttcataactctactgcccttccctcatattaactcccatatgtacttttcgctcacatatgcatgtgtaccctggtacatatgtctttgttgtctcacgttacatataacttgtagcctgcctttttattccagttcacaataggccattagcacttactcagaatcatttgttcataattcccagtgtgcttttttttaatggttatagtattctactatcaatatatcaaatgtatcaaatttgagagcacataattaagctttctccagcaagatttatgcctgaaatagtcccaagggactgtactgagaatgacaggcatttgagaaattctgcattcgtgaggtggtatcaagcaaggaatgggaaagaggagctttatgaaacaataaagaccagtaaaaagactttgtaaaattaattgcaaatgtttgttgctataactctttggccaaaagccctaatggtgcagaccatatttaaaagcaaaatcagtccttgtagataatggctaattgatgaagtgtggaacccttgcttttaaaacaaggtatatatttacaattatatatgtccatcaccttgttctgttttgtcctctgaaaaaggacattttgaccatgtcttggataataattttaacagtaaagacttcttgtctcttcaaaaactgtagcaagaaacctaacaatttgtggacatactggtcatgtagtttgaccatgactgagaggcctctgaccagctgtaggcctctgtttattaaagttacagcatttgaggctacaagtaaatcttttatagggtagcaagctatacttttatacccactaatttcttcccccagcaaagaggcaatgtcataatttaatggtatacctatagagacttggtgttcctgttcctgatttgctggtgtttaggtgttttgtggtcatttgatgtgcagatatgtatagactcaaaatggaaaggcagatagctgccattttgtctttatggcttagaaattaccattatgtaatctattttattcaacattttagcctttttctaatttctggatttactttttttttcatgtttgaaaatttaaggacactgtgatttatttcagttaaattttctagcccaattacctcttggtatgtaggaaatgtatgacttaagtctttggagaattctgatgcaatgaatatagtgctgggatagtattcttggaaaagaatgggtgtggtgctattgaacttgcttattctttggttactggtgattaccaccagttaaatctgttacaaggaataattgactggagactgtggaaaccgtggcctttcagttaaccagcctgccacccctctcctgttctctccagaaagcacacattgctacctgtgcctgacacctatgtctggcctagaattcactggctctgccagaagatctgattgagaattcaaatctactaattgctttctttaaacacctcattggagcattctgtcttttggttgcaaatgcacagtactaattacccgttacttctatcttcatattatgtgtcatattatgtgtcagtgggtgtatacgttattgcaatctttattataatcttgaaaggtttggtggtctttatatgagatgccaaggtctgtagaggcaaatggctattcaaagttgcagagcttgtgtgacaaacctagtgtttcagacctgttctggtgggaatgcagtctctgtttcacaagctgttactagcagccattcaagaaaggagactcggtttagggaaagcccagtcataaacaaaacttcctgtgtgactgactcttagtgcctgggatcctcatttacaaattgtgggttccactcaatgggaaagagtaagtggaaatatatataacggccttggcacagtgatgtctccacaaaaatgatcttttctttgcccatgtgtcacatcattctctgaacaaaaaggaagagagcattgacatgtgctttaggtaacataccaggcatttaaatatactttgaaatttgatatattcccgactatctgaaaacagaagatactgacaagagtttccattctgttttctactataggactttgaaaggcagagcagataccagtcttagaaatggtgtaacttgtagtcagagtattctatataatcacctgctttaatcccatttgaactcccaaacatttctggagtttcctgctgtctcaagccctttgctagcaccctgacctagcttattaatatggtaagctgttgggagagttaagggtggattagaatgttatgacataaataaatcagagtatgtacatgtatttctctgatcattaacattttgcttgaggtaaccaatgcataactattttttctctttaacattgtttgtaggatgcagaatagaaaactgtgattcttgctttagcaaagacttttgtacgaagtgcaaagtaggcttttatttgcatagaggccgctgctttgatgaatgtccagatggttttgcaccgttagatgagactatggaatgtgtaggtgagtagttcttaattcaactttcaaattcaaaatttcattgcaaatttttatgcctgtttctgcaaatactcatatggatatagtcagcctaaaagtaaatgggttctgttgttcattagaactgaaagggtttttgtttgctgattttgaatattttaggcatcatgatgatggatagctttgtttcaaaatttgatagttatgtatttgccaagttaggctacttaagggctgataaagtttatcatctgtaatatatccatttcttattaagttattagtacagttagagaaaaacattttatttagtagaataataaaacgtccaagcagtgtcatgccagccatcctattatcttagccatgcaagcaaatgaaccatggaccttcttgctaagccatctgtgtaaaaaaactaagttgaaaaaatacctgtgtgctgaaatgtattttcttgatgactgactacattttacaaaatttattgaagtgagtttgctgttaaccgagttttagatctatagatgcatactttaatatacatagtggtgtgaaaaaataatcatacattttacagtcttcatatgaactcacaaaaagtcttgcttttgtaccaagtgcaaagtaggcttttatttgcatagaggctactgatttgatgaatgtttataaaataccgtgtgtgtgtgtgccactgattaacaggtaaatttgacaaatacattgattgattttaaactctaatttcatgtccatctctctcaaattttactaggtacattatatatctgatttgatgtgcaataatcatcaattatacttcccatttctttttttaaagattctatttattattgtatgcaagtatttagacacaccagaagagagtgtcatatctcactatggatcgttgtgggccaccatgtgtttgctggtatttgaacccaggaccttcagaagagcagtcagtgctcttatccgctgagccatcttatcagccccctacttgccatttcttaaagggagagattttaaaatggaatgtgacaatttttcactgtagaaatgttgctgaaatattttgcaaactattgtggaggaaaatttacttaagagtgtggtttggaaagaaatgtgttgtaattgtatttatatgtgttagtacatgcagattatcactcaattaaaaatgagagagccactaaagcatatattctgagtgttgttttagcttttaataagagtcacacccgttacaaattgtgaatgaaaatgtgcataatacttcatgacagaatcctgtgcattggcctatatatcaattttagatgggtttaaaaaattacagaattggccctggtgcctactgagtttgaaaatgccacgtgttaagtgtagactccaggctggggtcctcatgtacacacagggggagctttgcaagtctgttaggaggctcagctctgcatgctctcctcccacctccaccactactccgtaatcttataaaaagggacaataaacattgcccatgcctaggaacttatattatacagcatagatatagaggttatgaaatatatcagcatacttgttaacgaatagatagattatgcagaatcagaaatgcatgcggcacacacacaagcacatacacacacttacacgcgcacgtgcgcacacacacatacacacacacacctcctcgcctacctcctagaacttaaaacaaacacagttatagatttggagtagggcataggaaattagcctgtcatcttctatcttctgtcatggcatgcagagagcctgttctgttttaggttttgtctgtttagagattatcttctagagatgatacagttttgcatctaggccttaccagcagtattcctttgaaaacaggacagatggaaagcacgaggcctttaattacttactaggaatttgtttgtcttagctgtcaatgctctgtgacttaagcaactgtagttccagaaagatgagtgcagatcgtacaggttacataacctgctatttgatatttgtggtggaggtgatggataaagtctaatgaaaagtggacacccaactgctgtctgtgtttgtatcttttaaatctttatcagaaggttgtgaagttggtcattggagcgaatggggaacgtgtagcagaaacaaccgcacgtgtggatttaaatggggtctggaaaccagaacacggcagattgttaaaaagccagcaaaagacacaataccatgtccgaccattgcggagtccaggagatgcaagatggccatgaggcactgtccaggaggtaggtctaaacagttatgctcatgtgctgcctgctttctgaaaatttccttcttccctcctcccagtaaatgctatttattcatgatggaaacctgatactaacattggagatgagataaaaatcctacctttttttttttaaagaaacaaatgcttaagttgttgtgatttatatacagtgaacatttcatttgctgttttaatagtttttacatagcttgaaggagtatctatatgctttcaaaaatgagatttctaaaagtgtgggttgtgtgttgtgtctctctgtgtgtatatgtgtgtgtgtgtctctcgctctctctctctgtgttttcaaatgtgccataataaagggttcttatgaagttgggcctttgcagatggtgctcagaagaaggggccaactttcagttgagaagagtttagattcaaaagtttatagaatctgtaaaattatctgcatcattactagttgaagatgacaactttaaataaacttacccaaacacggggaggaaaaaaccctgccttaatgttaccacaattagccctgtctctttgttttgataataatttgtagcaaacagctactggtatgtgtgtgcttaactctttgtaataattatactgatttgcagtcattattctataatagctggattaggctcatttggaaattaggagaggagtacctagcgaggtgttggacaacacagaaccaggagatcaaaatgcaattcttgtgtgtatgcatataggggttgtgaatacatatgtgtttgtgacatgtatgtgtacatgtgtgtgcatgtggaggccagatggcaacattaggcatctccctttattgttttcaaccttttaaaggcatggccccatactgacctggaactcactaatttggctacactgtttggccagcaaggccctaggaccctctgtctctgtgcactttctgcaaggctagagttacctgacttgtatgtagatgctgggtatacgaactttgctcttcataacggtccagctagcatattactgactgagccatccagcgtattcagatggaattttcacaaagttagtgtgctttgtaaagtagtaatcacttgttgacactttctgtaccactggccaaagccatattgccacagattcaaccgaggtgtgttttgttttgttttgttttgttttgtttttaaatgtacaaattaaaaaaacacacacacaaaacaaaacaaaggaaagttgtttttggaaaagtgcctttaaaatactccaaactttgggttgccctcttcccccgtcacccactgttggtgagtgattctcaaccttttcattcaagcccagaaagaggccaaagagcacatagctgcctgcagtgagtttctagccacactctgctgcctcacagagactgtccatgatccatggagaaagacgagactctgaagcctggacgactccagccgccctccgaggacgattagattcggattcggaagctcccggggaggagccagcttttcctcttgaattagtcttgcttttccttactgggcctttgaaacaaagttttcttgggtctgcttttcactaacaaggatggttttgttcccttaaagtgggtatttttcagtcaaaatataaaaaaatattttcttacaaaactaataagccatgtcttggatagctgagagcatttaacctgcaaccttttgcctaaaagcaaacctgatgtattcaggtatgggaaagaaagactttctttgttgtgtattgtttatataactttcccctccccccccactccttttcaggcaacatggtcctgcaattgtggtttacattaatagcaaaaattaaacttgaaaatattctggtaacaaacatgcttatgtgtaataagagccctgataccactctaccctttgcagccttttatttttctggccttagtcatgattgagctattttctagagagcggataggttgttacccataatgtttattatatttgcattatttgtgccaccaacagttaccatcttaatggaatattggaatatgattgactccactgataaattatgccacaaaaaatggctgaagcctgatttgctgggtttttttttcccccttcaaacaagtgaatcagagatagattctagcttaaactttatttacgttttaaccatatttttcccattaagcactgttctaatctctgtaactatctaattttcagttactaacatgatttttttttgtctcgatgtcaaatagcaaacactcatgtctttataatagggttttcaaagatatgctggaacttgttttattgtttgatttaaaggcaaataagctaaattagtagaaattaagggctctgtaataaaatgacttctaattacaaatgtaggatataagaactaagaaattaattgtggaaagtgagcagcagttgctaaaaagtggcataacctccagtggagagtcccaccttgcctcaggtgagagcgggggaaagtccctttcttcagctggtcatgctgattacaggaagaatggagaagaaaaccgcgttatccccctttccatcttgatttgatttcagtgatcagctttgacaaaccatgcaaaaatggaagtcgtaatcaggttggaaatacaggcatttttcagatcttttcaacatatgtatggatttttctcccgttggagccaatcttaacctgattgcactcaaatgcagcctgagcccccttcacactggagcacaggcatattaaaatcagctgctttcgattatggaaaggccggagttagaggtcagcatcatagaatagctgctgcgtgtctaagatgttacactgaaagctattaaataggagaaaatgaacaactaggaaagaaaaaataacaagaaaaacatctcagtgtaatgatctagcattctagtttttcacccatcacagcctgatctgcctgtgaggggcaaaaggagaaaactatatagaaattttaatagatgtatttgtgctaaagtactcatttcatttctaaacttttggtttcgatcagttgccttttattcaactatgaatgaaacatgtaagatttcttggactttcctatcagtcctcagaggtttggtctatggtctgggtgtctacatcctgtccactcataacttttatgacccccctgacaagtcacttaatacttggctcttatttcctcatttataaactgaaaatactgatgggggagatctctaagatttagacttcttctaaacttaattgcaggcttaattgctaaaaggagcaggtgaggtctgtggtttcctatagaagacaaggaaaagagcccagagtgactgtggagatgactgtgtttctggtggttgttgccctgagcatgtgctgagccatctgcaattggtgggttttcattctcctgctccaaaaatgacttctgtgtattcaaccttcaaaggctaaagaagagttattttaaatgtaggtgtgactgctggcttagctaccaaagagaagggtaagggaggaacaagaagagacgagggagaataaaaaaaccacaggaggaaaaaaaaaagacaagacattgaattgatagtctttgggaaacaagtgtgaggaagagtagacccctaaagagtcaaagttgtacttgctatagatacagccatcccttcccacctccccagtgttagatttcatcccggtgggaagagtatagtttagtaatagctcaaaaactctggatgggagaaatttcatgtctagtttaagttgtatattaggcagcattttaagagaaaaagataaatgggctattatatatttgaatgctaagtgggaaaacaaccacgagatgttaaaggatagtaatggaagagacacagagacaaatacagaggcacaggggcaaggaactttgtggagttctttcctacgctttttgttccagggagcaaaggcaggttccttggctcctatagtaaagtgtgttttcttgtttaagtagctctctggctctaacagcaagttttgttagatgtttgttgattagtgcttattgttctattgcttaaagaattcttgagtttttcttagaaatactaactctgtagaaaagaagtaaatggatgagcctatataatttcattgtaggcataggctgtataggaaagaaaagctgggcaaggagggctttccctgagatgtgctgacccgtgtttgatatttagagaggtgagagttgatgtttggtcaggaatctgtggtcctgtgaagatcaaggatacatgtgttgtagttgttgactcagtgactattttaatatttttggtcctcccacaatatcttggggaaggaggatgatccagtgagtgcctgggaggctctgactggcccttaggaagttgctagtggcagtgtagagtttgaccaaagtcttgctgcataggaaggctgagtttcttgtggcttttccttgttcctatagtgaaggttaaaggaaaagccacgactgtattggatcacgaggaactcaaaacttcatgctacctccattccttcctgacatcttgctatgtagaataacaagtgaggtgaaatccagaggtcatctatcatatttgccaaagcatgggaccactaactgtgcttagactcatactttatgaaaatcctaccctcctataattttagtgttgctggtcttcacttcactggatatgtagcctcaagacagtcctttcatatctagtgcttcagggtcaactttctggatgaggctgcttggtgtgtgtgtgtgtgtgtgtgtgtgtgtgtgtgtgacatttagcatcaattccacatatgatagatctgtacccatcattgcctttctttcttaaacacttcagtaatcagcctcttaggtgatgctctgaccgatgctcagtagctttctgtatttggtgttgtgactgcctgtgctcactgttagtttgtcatagtgtaattctttcagccacacttgttttcttagcaatatgtcaacaaggtaaatatgaagcctgctactatatatactatttcaatttgaaaataattaatccctgattatgggcattacctggttcttgcccactactttattttcagaagtagttcttacgttagtaggaagcaaatgacaaaattatttagcaacttagaatcttaagttctctaaatgtctacttttcaaaggtgacaataataagacctcactaatctctatttgtgtgtgtgtgtgtgtgtgtgtctgacagagagagagagagagagagagagagagagagagagagagagaatataaactgacagtctcatgtagactaagcattaaataatagaactaaagatgcttgcagatggggatggattaaaccaagaacaggaaataagcacaacatcagtaggacagggtcaagaaactatgctttagacatgtgttccttatttctcaacattttgtttacatttgagttgcaatttatgtggtcagttttctacatgccagcctcaaggatactttggaagaaaggattagacgaaaatactttccttctgagacttacacgttgtcaaaggtgtcgttaatgcatgttttcatctgaagcatctaaacagatttggttgttgttgtttgtttgtttgtttgtttgttttgcatttctctgtgttctgctaaatactttgctgtatttcttttagcagtcattggtttgcgtttgtattgattttgaattaagaaaatcatagtgctgctgggtaatttgtatacatgcatagtatttgtagtgattgtaaacctgtaaacctgaagttacccatagctgccactttgtaaatgtttatcatcaccatcatcctcatcatctgaaactgatatacttgctcacaaaaaattctggctgtagaatgtctaaaactcctattttaggagctgaatgttatcttgagaagtgcccttttctgggcctatcatgcccagctttaaaatttttcttttctcttgttcttagaaaatgagcagaggataaacattggtaccctgctgttggtggtagtagaaattttcattgctattgttgtaggtggtggtgtcagtagtagtagtggtgtgtgtgtgtgtgtgtgtgtgtgtgtgtgtgtgtgtgtgagtgtgtgtgtgagtgtgtgtgtgtgtgtgagtgtgtatgtgtgtgtgtgtgtatgtgtgtgtgtgtgtatgtgtgtgtgtgtgtgtgtgtgtgtgtatgtgtgtgtgtgtgtatgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctttcttttatgaattttactcagcagcaagctagtttggtcttaatgtgaatgatgtaaaaccattccttgtgactctccaaaaataaaaacaactttaataggacacaaatggtgttggatgaggactatccactttataggagacatcaccttaccccctaggagacaagaaagacttgtctaaaaatcccctaatatttcttagaaatcatttttccaccactgacgcctgtgatctttctgtggtgttgatggagaatagaagcaggttggtgcactccctcgggtttcccgtgccacctctgcagctcctgggctgaactccagctatacttgtgattatctccagggctagaggcaacaagagaacattttgttggaaagagtggcagattttactacaatcccagtatgactcacattgccaccatacagaaatagctaagatgatacagttattttgcataacaaacgttttcactattaacatgcaactatggaaagttttttgctgaacatatcagcatctctgggatacacagacataatttttcatagatctagtattttcttttatttaaggactttgaagactaggaataagatatataaaattgtctgaccaagagacatttcataattaatacagagttcttatatctagtgatagtataaaaaagtacatcactgcatgataaaacaaagacacccaaatgtaaaaatatgagggtaaatgaaaatctgaagacactgaagtatgtgcatttaattgatgttggaggagaaggatttccattatagaatatagttgaggtaattgctacttctcacaaaatattctggttccatagggatagacacactgaggaggttactgtcagataaaatatatttctcaaatggaagtcacatccagagctgtggatcctgtggtgggaggtgtactgcagactgtgtatgtcacatctgagtttgcagaaggcagattcatatatcccttcttggaaaatagagggtttatgatcatgatgtgactccacaaagttatggtggccacatagataggactctctgaattatcatttttacttgactggtgtcactcagaatattctttcagtgaatattggttttgcagggcaggtgaaagtttggcatctggagtatctctccatatgatacagctctattgtcctaaggatggacagttgcccttgaaacttgtcggtaaatatggtatactcactagatggtaagaaagatctctcaagggacttccctacactaatattttaagaagccctttgtggtttttgtctcttttccaaggctgttcttggatgattttaatctgtatcaaaattattagttatgagtaaaccacatgcagcttgagtagacgcttcctcagttgaacccactttacttgttgtagagcaccatcccagagatgatgctgtgtgagatctgctgctctgtgaagtccatgattttatgattgctctgtctatgtattcttcccatgttctgaagaaatgaacagatggagagaagggagttatttaaacaagaatgataatcaagtcagtgaagaagaaaataagtatcacatgatcgcgaaagaaccatatcataaatgtcaattgcctcataataggatctgatatttagttggagggaagattattagttatcagggctgaggaagatctctggagagtagggatggctggaagccttgtgttaagattgttttttgttgttgttgtttatttatttattttactttattagtgtttgcctgcaagtgtacatggatgtgcaccatgtgtatgattgctactcaggaggcccagagaggctgtcatatcccttggaactgatgttatagatggcttggagctgccatgtgcatgctgggagttgaaccttgttcttttcctggttccggtgctcctaactatcgaactctctctctaggttttgaagtcttgtcttattaattttcatttatcgaaaatacatcgttttcatataatatgttctgattatggtttcttctcccccaacttcttctagtttctcctcactctcttcccatttggctctatttctctgtggtctcatagtagaaaacaaactggcagctaagaaataataaaagatagaacaaaaacaacacgttgaaatgggacaaagcaaatgaacagaaaattaaacgtcaaagaaaaagtatgagaagcatttatattgttgttccacctatagggttgcagttccctttagctccttgggtaatatctttagctcctccataaggggccgtgtgacccatccaatagctgactgtgatcatccacttctgtgtttgctaggccccggcatagtctcacaagagagagctatatctgggtcctttcagcaaaatcttgctagtgtatgcaatggtgtcagcatttggaagctgattatgggatggatccctgcatatggcaatcactagatggtccatcctttcgtcacagctccaaattttgtctctgtaactccttctatgggtgttttgttcccatttctaagaaagggtagagtgtccacactttggtcttcgttcttcttgaatttcctgcgtttggcaagttgtatcttatatcttgggtatcctaagtttctgggctaatatccacttatcagtgagtacatattgtgcgagttcctcacaaacacacacatgtacacataggaatcctaggaaaactctcaatcaaaatccatactacatacacaaaggaagaaggttgggggatggaccattaggatcagatatggaagcagaggtcagaaggggtgagggatagaatatgtggagggacagataaatgaccatttgaggggtcatatggaaacctagtagaaacctcttcaaataatacatacatgcatacaaagttcatctaaataaaaaccatcaaatatcaggagagagcgattctcaaatagatatatcttgccaacaaataaagcttccagtaacaggaatggcatccatatcattgaactgtggccagaaagcccccacaggaacccacaaataactcaagttactgccaactagttgctctccacaaactgatgacaaggtcatatcactgacatctacacaatgaaaatgaaggattcaaactggtagctagtgagagccttcagtagggactgactagtgctcatagtactggaaggtactctgctaccaaagaagaaatgtaaacattaacacagttacaaacccttctttgtaccatacctgctagacaagctggtgtaatagtggcacaatgctgtgagagtaaccaaccatgatcttagcagatttaaggtctactccatgagatgaaacccatctgcaccactgcctgggtgaccaaaaaactgagacttgatagacccagtacctaagggaaaaccaaatacttcagtttcgctaaaagaaagtagccattaaatgtctcctaagaacattgtgatatactcacagagccgtgccttgctcagcccagtaccatgaacactggtcactaggggtgaaggcattggatagttaccagtttaacttctctgtgttcattgagttgtcttcagtgatatgactttgctatcagtgtgtggagaacaaccagaaaccagagcaatagggtgagaagctgtctcagtcctcctgcagcagatgagaacagatacagagacccacagccaatgagcagagcgtaagagaccttagaacactccattcttaattggcatgtctctgtcaaatccctcccatcggttctcagaaaactgtggtagaggtggtggaaagattgtaagagacataagaggaggggggacaccaaggaaacaaggtcccctaaacacagaaagatggagtgtatgcatgaagtcacagtacagggcctgcacaggtgtgcaccagatagggttctggagctgagaagagaagtggacaccaccctccatccttaacccagagggtagctccagctgacaatgaattgcaaaggaaaaactagttttctccaatggcgtctcacttggtattcaaactactcttatttagtgtaggccttatggccagcagtagatagatatccaacacaaaatgaactcaacatcatctttgaagattctcttgtttcataatgctgtgtcagggcattttttcttttttttaaatatggacatgggagaatctcagtgtgagaaagccaaaccctgcagttaatggcagacgctttaagttgctccctgggaagtgtgtctgtggcaaggagaactttggactttgtcttgtatgatggggaaaggccagaagacatttgaaaatgcaggcatgtttgtagatagccaactaaaaatctaagtgtctgaatgttgccttaggaaggtgtcatttggtgagaggataaactgtccattctggacttggggcccagcattaagcagagactggttttaatggtagaattaccagcaaatacttagtcctgatgtttatgcatttttctgtttgcttgcttttctaatgagagtaggattttgtcttggcttccagtctgctgtgacccctctgtctctgtttgccaacttactaagccaggccattccctggttagtatttgtgaaacatttcctcctcggctttttcctttttcttttttaatctaggcacattttgcttttaccccaagtgaactatatctgtttcttactcttttcatttgctatttacccagatccttgaatggattattctctattttctttttactctgtcatattatcatcctaatacattttcctttctagtatattttctttaaaacacataaatattattcaagtcaaggatgaaaatgttctcataaggcccgatttcatctgtataatctaaaatgatcttatctgacatgttagtgcctggctcataggttttaaaggaattctgagtaaagtactgggttcaggagaaaagtatgtagtagctaacttgctacctttgtgacatggggcaggaggaaatgtatagcttacttgtacttcagtttctcttcctataacaacccagtctgctcagggctcttcagctgtcatcctctgatcttccagcacacacttgatcatctttgataactcatgaccttgcttcaattctacaccttcagtaacggcagacataatgagtatcttgaaaagcacagtacaggaaattaatagagttttacatttgattgaataacatcaagtttcttaattttctaacatgtgtagaataaacatttcacagcatggaagcaggttatgtttttgtcacatgttatttgccaatgctacctcctatgacctagtctacccgtggtacttacagttctgctttcggcctatctcacagcttcatgtgatgcgtactagcttctttctgaactctagtctctcagttcattcattggtaggcatctctccctagatgtgctgccagtgtacccagtttaccatagctgatatctagtgtccatctcctttcccctgacttgggcatccttttaacaagcttcccaggattgcaatgctctgagcccttaatacagtccttatacacagacagaccaggacttaaatctttgctcaacactaaaagcaagcaaatttgaaaagcatctttagtgtcaccatctatataatggggataactacatgtgcctgtgacataagattgtcataaggaatacataataccattcttttcatgttttgtatgcagtaaaggataaaatgcatgtttttatttgttatgatgcttgaaatcacattcaggatcgtctatgtgcttggatagcactttaccacagagatacattacatttcccagacctttgtcctctatcctttaacaaactacctacctatctagtcttgattctcaattggtcactcattttttctttctttatttgttcttgaagtctttttatatcattatatttccatgccatctaactgatacatcagtgtgttcaaagctgacttgatttcacttcactgtagggatgggtggtgaatgagacactaagtttcaacattagtagaggcagtcagtgaacatccttattagggcacagtactgagcaagccttacctctattagcctgaccacattacctttagaaatgaacacagaagtcatacatatatactgattcatttatcaactgtgcccactagggatggcagttgcaagatgaatagtagaggctaatgtttgctaagactacacagccgagtgcagaactgcagttgggaaaggcctgtgtcagcaaaaatgaacagagctgagaagggaagatagtatgaaaaatgagacgtgtatagcttagcagacatacatggggataacttgtctaaaccaatgcatgttgcagagagcaaaaggccaatggtttgattgaaaggagtagagaaggaaggatgggggcggggggggaggacagagtcaaatcaccagcaggagttggttaccaaattgggtttcacagttagaatattgcttgaaaaatgtgaagttggctagacaatgatcacatgggaagattaagtatctgccactaatgtatgacacattgatgagctcaagcctacgtatataggacatctactaagcaagacattaaagcctgggtgtgatatatataatataacttacaagcactaccctgaatgcaatgtaaagttagaaataaagttagaaatgtgggtacagttgattactggttctgtaagtatgttatcatttctgtgcctacagctaatggtacatcagctctggggagtcaatcttccagtccattatacattagtgattaaactttgaagacaggcaagaatgtctagagacctgcattcagggctgttcaaattaggctctctgtagtttaccatgctttatgggattcttctccaggctttggggaaggccaagcagtcagggctctggtatttcatcctttccttttcctccatcacactctggagattctgaatacatgggctttggttcagaggaaaatcagaggacaaagagcttggcttcctagcaaagctttcagatgtgttaaatgtgttccttccattataaaactaaggcgcccagaggctgggtgcattattaatgcttcaagacaaagcctgagttttgcgtcgacaccaagcctagcattctttagactatgtagccccctatcattcagtgtatactaatctctgggacatacttatgcaactcacatttttttaattttattttatatattccttctatagaaataagcatttaatggaagaacaacataggctggcctgactacccagttctctcaaagtctagaccaccaaccaagaagtgaacctggagggatctatggttccagatatatatgtagcagaggatggccttgcctgaaagcaacaggaggggtggctcttggtcctggggaggtttaatgccccagagtatggggatgctagaatgatggaatgggagagtgtgggtgggtgggggagcatgctcatacaggcaaaggggaggaggagggcagatgtggatggggtgctggtggagggatatcatgggatgggggtttggttgagggggtaaccggggaagtaggatatcatttgagacgtaaacgaatggaatgattaataataatagaaaagaaaaaagcctttaactcttagagtgcttcattacagagtagtggtgtgcagcttagcctggactgtgttcctatttgtggtagagtttgcaagattataaagtgaacaaataattaaaaaaaaccatttcttatatttacagtcttttattggactatgccaattttatagccaaaccagattgtgatgcttagtggtgttacaggacctagaataacctggcaggcaggcctctagaagtaaacgtcgggaagtgtatgtctgtgtcgtggtggaaagacccactccctgtgggtggtgctgttccctgtcatgattctaaactgtaaaagtggagagagccaagtcggatcatgtgttcattcttcgttgtctccttctgcttcctgcttatgcatgggatgggatgcactgttttaagctcctgacattttgaatgatatcctggaactgtgacaacaatgaactgctgctcccttgacttatttttgtcaccatgtattatcgcagcaccaagaaaagagattaagacaattttagacaacacaacagcacacagtaggcctcaatgaagcttggtgtcattttgcactgcctttggggaatgccagggccaaaaaatgggaataggtgggtagggaagtgtgtgtgtgggagggtatgggggacttttgggatagcattctaaatgtaattgaggaaaatatgtaataataaaaattattttttaaaaaagtattccttttataatgtttttctggccttcttcctaagagacatttctcacaggtcttaatgtcttttctgttcagtgttggtacactcttactttagttattagaatatctagatcatgatagtaactaaaagtagaaatgtgaattagtaatgtatatcgttatcattgaggacttaggtaattgacaacagactggttggtctgaagggtctattttcccaaataccaagtacttatatatcattcttgaatgtctgatgcaatgacatggtaaaagcaatttaataccaacctaggtaagatgtatctcataaaggctcccatccccctcccttctcttcttttcatctcacgtcaaaccctatagaaggaagctgcatgcatctgtcttgcatctatacatgggttttacatgttgagagaggtattgctatcttgagtaatttaacgtaatttctatctcaaatgtcaagtgtctgctgcatttcagcacttcctccatttggtataattgtcaactccatgtgcacagattgacttaatacagtcatcaaatgtgctttgaattaagagctatttggccagcttctgtagcaccgtttgaagcggtgtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtatcatcttatgcagcttcattgtttactaacaaacagctccatggtcagtgtaatgcaataaatccatgcagcggatttgaaaatttgaaatgtatcatcatttattagcctttcacatttgtacacacatgagtgtgtgagagagacttaatggcctgggggttgcttggagggaaatgtttggtgttgctctgcattttggttgacagtagtcacaccattttcagcatctctccccttttgtttattctcttgtgtcttaaacagcctgctgacatctcatcagctaactggaattgaattttgatgcgtgccaagttgctttgatggaatctagtataattatcttaaactcaattttgttcagcttcagtgctggcattttccatattcaggaaattagtgcatttgtccgctactggagatagaagtccagacagaaaaaaaggttactaaaataaaaaagccacacttttagttcattttatacttttgtttcagaaatagcttgtatatgcattcaaacttttaaaagctgtttagcatctgttccttctaacaataaaaaaaaaaataaaaacaaattattcgtcccaaacgcctctctccagaaaaaaggaaactgcatagttttgttgttgttgttttttgttgttcttgttgttgttttgaccaaaacctaacttttgagtccgtttttcttttcttttttctttttgtctttagtcctaagaggaacaaaaatgttattattttaaataaggcaattttatataacactattataaaataagtttcaaaaaaaatctatgtgttggtttagaaagccatattacgaaaagagtcaaaacatcttaaaagtctatctttatttttgatacttacactgtaaggaaattaaattaattggaacttgtgtgccagcatgattgttatctctgagatcactacaatgttttgatgaaagaactctgggtgttagattataacactgcaaatagtgttttcaaaatgttcacacagtataaaaaaaagacattgacctgttcagctggccagtttctactatccccaaggttcctaaatctaatttgaactgaaagagttttagcttgcagttggaatctggaaatagaagagagattataggtttggaagaacagctcagccaactttgggggtcttaagaagaccaggctcttctctagacacagggagactagattaaggctttcttttttaatttattccatgaagttattacagaatatgacatcctcctccaacaacttggggtataacatctccttgcaggtgatggcagtttaatgagaggcagataattgtagtcagttaattgaagacagttctatagccctgggagaaagtgatctatgttgtttttggtcaaaaccatgtgcctctctacaaccttgctcaatcgccctcctcttttcaggcatttctttgataggtttctcagtatctctagtgtgatttattaataattattaatcatttgctagtttaactgcaatgtttatagattgttctgtctagtattacttcaagattacactattagtgagttctgctaaccatcaaactcagcagatttctatgtgaacagaaagggtctgataaaacatgctgactttctattggttctaattatgatatgaataatgctgatagccaagaaaatggatattcagcagagagatgagacactaatttcccattacccatactttgtagtggattttatttgtgattaatggagtatctgttaacagctcttaagtaaagtcaatataggaagcttcccagttctcaaaattgataaaggatctacaattattatataaggtatgctgcatgtaaactctcttcatagaagtaatttcagagtctacttattaaagtttttacatatgcttataagagaattgtcagtgtaatcataacctggaataagattcaaaagatagtgttgagattcatatgtagctaacttttctcaagtagattcttgagtgagtctaactattagatgaagagaaaaactatgacctctagttttggactttaaaatataatattctatgaaattataaaatgaagggaaatttgacattttttttaaagcaagaagatcatagagtgacagctaacatcttgatgctgagccttgagtttggattctgactgaagtctatatcagattctcaaatgaatctcaagttgttagcctagaatctggaaataattgctgtggctttggtataagtgtctcttgattcacagcctagaaggaaataagtaaagtatgtacttttttagtaagatacttgatttttccctaataagcattgtacaaaccacaagctttgctgataagatgacttgagatctgaaaagcaaccaaagctgctatgaggaagggaagcaagaaccaaacaccaatggcaggggacacagacatcttagaaaacaactgacaccgatggcttctggaatctataaaagagatccattaaccatttctaaatgttattaggagagatcaagcttgtatccatggctagagcaggccagtgggatttgatttttgccatattcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccatctgaccttttaaattagaaaactgctcctatccacacctctgtgccatctctcagttctctgaaagtggatttgaaagtagatttactactatttttttttgtttttaaaatatgcaataaaagtgtagaaccatattgaggggagggatgaaaagtaaagagtcatgtctcaagggtctgagaaacaggattaggactttgtagaaataatttgcatttctggcaagtgtcttttataaaatacacatacttaacttggttcaagttagaaagctgagtagtttgcatttcaagttccttctaggcaaaaatttatcttttgtgtgctaaggagctatgattacctacgaaaactagctttcagtaccagaagagactgagcaatgtgagaagcacattgttgatctaaacaaagttcctttgttggtttagtggcaaaaggcacacttctctttaaattgttggtatgtaagattgaaaatagtgtagcaatagcacagccagaaggatctaaggttggccagtcctgtactgttcaagaagacaggttcttttgtgttgactgataggacctgagttgagatctgcattatcagtgacatccttaaataggtatagataagatgatattaaagaattacaaagtttacttaaaataggcattttgatttaaataaccctctaaatattaaagatttattatagcagcagcacatgctgcactgttgttgattctagaaattgatttttaaaaatgagaatagaatatggaacatacattttcagataatttctagtactgtttgccttgtactcttggacagattggcaggatgctttgtgagggtcaacaatgtagaaaagacccaatctgttcacagttttaaatgtcaccactctcaaccatatagcctattttcttttggatgctctactgtttgtgtgactaaactgcaagagcaagagtccaaagcgcgagaggtggtattattgctagtgcaaatgatgtcctgtgtcaaacagtaacctctcctatcactgtagccttttgtttagtaacctttccattcttctcatccctcttctctctgctaaacagtgtgtgatggatcataccaccaaggccatcaaatacactcagtttgggaagcaaacacttcatggttatttaaaactgtgaagtattcacacagggaatgcaggggtggtttcaagtttctgaaacattctgcagaaaatgaagtgataacagttcctgccagtggccatgtgactcagtaactggaaggaaagaatgcttgcttagggcttgacctgagttaatcacaagcaagaattattacccttgttgttgttgttcacaaagatgttttctttctccacaatttctttcttctctcttctatgactttttgatatctgaccctgttcttggagaagttttcagaatgtcttttctgctgacctaaggctttgtttgagctgttgacattcattagaaacacagtaacacagtagaaaggtcttggttctgcagctgcttttctgccataggctgtactgtggttgtgccaccatgttggtttctgtagtctcagaagtctagatttccattcgtttttctttctttttcccataatatcatctttttttttaattggatattttatttatttacatttcaaatgttatcccctttcctggtttcccctccggaatccccctatcctttgccctttccccctgcttttatgagggtgcccacacacacacacacactccctcctccgcaccctggcgttcccctacactggggcatcaagccttcataggaccaagggccacttctcctattgatgccaaacaaggccatcttctcctatatacagctggagccatgggtacatggcttcttggttggtggtttagaccttgggagctctggggtgtctggttggttgatattgttgttcttcttttgggaaaccccatcagctccttcagtcctttctctaactcctccattggggacccagtgctcagtccaatggttggctgcaagtatccatctctgtatttgtcaggctttggcaaagcctctcaggagatagctatatcacgcttctgtcagcaagcacttcttggcatccacaatagtgtctggatttggtgtctgtttatgggatggatccccaggtggagcagtctctggatggcctttccttcattctctgctccacactttgtctccatcttttttcccctgagtattttgttctcccttcggagaaggactgaagactttggtcttccttcttcttgagcttcttgtggtctgtgaattgtatctcaggtatttcaagcctttggactaatacccacttttcagtgagtgaataccatgtttgatctttagtgactgggttaactcactccggatgacattttctagttctgtccatttgcctaagaatttaatgaagtcattgtttttaatagctgagtagtaatccattgtgtaaatgtacctcattttctgtatccatttctctgtctaaggacatctgggttctttccagcttctggctattatcaataaggctgctatgaacatagtggaacatgcgtccttgatatatgttggagcatctttggggaatgtgcccaagagtgctatagttgggtcctcaggtttttctgaggaccctccagactgatttccagagtgtttgtaggagcttgcaatttcaaaaatgggggtgtgatcctctttctccacatcctcgcctgcatcttctgtcatcttctgagtttttgatcttagccattctgactggtgtgaggtggaatctcagtgttgttttgatttgcatttccctgatgactaaggatgttgaacatttctttaggtgcttctcagccatttggtattcctcagttgaaaattttttgcttagctctgtaccccctttttatagggttatttcattctctggagtctaatttcttgaattctttgtatatattggatattagccctctatcagatgtatcagtaaaaatcttttcccaatcagcaggttgctgttttgtcacattgacagtgtcctttgccttacacagaagttttctgtttcaattccaggatattctgcctcagttgctccatactcttgcctccttcagcatgtagagtaaatttaacctcaacatttgctaacatgagcttttgtgtttaaattccgtcttctcttggctggccagctctttattttattttggtccctgggcaaatctgtcacctgtctccttggaagcaatatgcttgagggtgatgaggggaaaggcttgttttgactgaacctgtgttttgtgtttagcttccagatactttccacattccaatagccaccttaggtgaaccacacaatttttaatccagttgattgaaggtctggcaaggtatcgtctgtttcagtgtatttatttattttcactaagtgggtgggatatcatagctttaataaatgaccttttgtgctgataatgttgtgggctgagaaagtgtatattttgaaaagaaaaccttttatttcaacatgctcagcaatttttcaggaatcataaatgagaagtttaagataatgcatttcatgatggttgtctgaagcattggtctaggaaaacggtaggtagtaagaacatttagagacaaaaattaattcttctctatattttaatgcagataggttatgaagactttaagtcaaattaaggtatttgaatgtataaaaatataggaaatcataaatttggcaattactttaacaatttttggataacttttaaaaattttttattagtattcattaagtaggtttcattgtgctacctcatgtaatgtatataatactctttgatcatttacttttactttaaatccctgaaatagacttttaatatcacaaatttatcataatttcaaaaactttatttgatgggtaaattcatatatatgtactgtataatttccccatgtccagcactttctatatccctaatctctcctaatattatgatctctttatctttatttttgttacacacacacacacacacacacacacacacacacagagtagctgtcaatttggtaagattctattatttaacctatttcaacttaaaatgaaaatctgaggacaataagatattgcttaattaagcactactatttttcaatttcatttaaagagtgcttttatatgcaagatcaggatttttagctgataaaaatatctttacatagtccattcatatttctttcaagtatacattgtatatgagttaaatgtatgttgtcttgactggtctgctgaaaattctgagggcagaaatttcccttgtaacctggatcagatttgttcaattgagcacctagttagtaaaaaagtctagttagcctagacttttcaggctgaaagtcattttatcagggccaaaaatgtagaactaactattttgatactcacgggtatttggttatctctcataagaataaagttccttgataaggtttgtgagattttattgagtatttttgcatcgatattcataagggaaattggtctgaagttctcttccttgataatgtaacatctcctgccagtgcataccctacaccacttctctgggcttctctgatggctcactgcatttgttacctgtatttcttctcttaaataataggaggaagaagaacaagttgcaaaagggagtgcattctaatgtggtttccttagagctagtgcttgttaattcttgctctagacacattgctggtaagtctgcttttctgtgaagtggaagcaaatgatggagtatgtttggtagtcttggaggctcaatgagaatgcagggtatgcacattcacaggacgtatatacggctacttagatgtatgtgcttacagcagctcccttgagctgtgggctactcacagagacaccaggaattttagaaagctgtagtgttgtcctgatttcaagctcacctgctagccaggcaaacttcagtgttgcattccttgaagggtactgatttggcattcagtagatcactgtttgtggatctgatggtcattgtcatactttcttctttcttccttcttgattggctttttgtccctactagcttgattagtatcctccagtcattgtgtctggagacctgacaatgttttccttgaaatttggacaatcttcccagggggattagggtcttttacaaatccaggacctggcagggttacatgacactgaaaatttctgagctaaatatttaggttacatcagttttgatccttatttatgatcgatagcattaaacttattaacacatattttctggaataagttaaaattatgagcttaaagattaatggtagcacataatttttaaaacatctttccaaatattttctatgtataagtctgagcactgggtaaaatatatactaaatataatatatacaaccaaattctcttacagagacgagaaaacgctttgcatgtaaaatccacgatttcattttttaaccatgtcttaatgttatgtttgctcactcactatttttctgtatttgggtacgcagtttccttttattaagatttctcaataaaggccaagatggaaagtataagttaaagcaatttaacaatacattaaggctatttttatttcttctttcattgctcttttttttttttgtacactatattttaatcatgtttttcccctttcctaagtcctggcaggtctaacttcatgttctcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgaaatgagtccaagctgcacagcaatgttggatttataacttgttgtattgtccaatgatagttttagcttctgttcttgtctcctcagctttctactaagtctagagtggcgccagctaaggcaaatataattaagagcatgtcagcttctttacaaaatgaattttgaaaaatttctccgaggtgaaacttggcacatattttctctcagaaatgagttcatggattttgtcatttttttaaaggttgttaatgcagcatttcttaaaacattttttatgtatgtgtgttggtatatattattttacatatatgtgtacatatattttaagtggataataaatttaggaccagcatttttatggttattaaaaataaaaggagtggataatttaagtctatgtatagtttatgaggcacatttatgatcctcttggacattttcttttgataatttgagtattttatatgatttttatatttttttaataatagccccaatgcatagtatttacaatactggaaaaataaatttttgtgtttttgtcctaagagttacattgagttacattgttgatggaagttcaccatctgggaactgtgtgatggacaagtgaagacttcgttgggccttcctcatagtaaacacatcataggtctcccgtcctgtgattgtgataggaaggtctcataagaaatggcgtagatgatgcactttgagctgcccacatgacctaatgaaaaactgagtactctttttactgtcctctcagcctctgcctttatctagtacttctaaatctcacaccacccatcctgttgaaagctgaagagctcacaaagtaggtggacaaatgtgacaaattcccagctcatcatcttaggtcagtgcacggatcatattatttagaactctctctctgtctctctctctctctcatattccatatgcttgatattttaacattgaattttcttctcaaaagatggcaccatgttctccttgtaatagataactaagtcaattctctcaactttctttccctcccttggcatatcttcatacactgaacccactcgtaatttcttgtaagagataaccacctttttttgtcctgtcttttgtaatgctggcattaaaactccggtcctgttaagtaaactctctaccatgcgttccaagcatactcttgggtgctgttgagtgcttgctcttcttcttcagaggcaacttaacttcagtggtcctttcgttgttaacctttacatccctttctcttcctgttttataagtacccttgttgccctggtcccaaccaccacatatctacctagtcatcccacataaactccagactcaaaatagataaaactgacctctcattttctcatcaagttggctgatcaatagcacattttgccatatattaccaagtatccccctcgtccttaattgagccactgcccagaaatccaggtgaccgccaatgttgttttgtcttgatttcctctgcacacatagtcaccaactccacttgattctggcctttcaacatcatgtacctggtacctgctgtcccactgtccagtcctcttcctgtttctttctgctcgctattattttagtgagcttttaagtgacctttcctttgccatcttgagacaagctttataagagtgcatgtttattgtacacggtgctagtttttaaattttatttaggtattctgaccttgaaacaaattactacacatctatgttatgttatcaacatttgcaggcctcaacattttaaatgataacaatttgttttggattctgagtatttaatttgtattcaattgctgactaaggatgttaaactttttattttcattttttccttcttattaaaaatatatttttatacaatatagttatatatacaatgaacactttctctgcatcacacaagaaaacaaccaccttttaagagataacaatgaaatataaccaagtaagcaaagaagaggccaaaactatcatatgacattgcacattgcaacagtacaggaggaaaagaatcccaacagcaggcacaagaatcagagacccactcattctcacagtgggaagtccaataaaaataataatctaataactataatacatacacagaggacctggtgcagactatgtaagtcctgtgcttgctgcttcagaaataacaggcattttttaaagcatatgttataatttgtgttatgtggtcactttgttttaatgtttagccaatttttattattttgctagtgagatacacccatgttaatgctgttgctaaggcattatgtggttttttattcttttccctgtccaaattttattttttaaaatactaccttcctcccatatatacataaaagaaatagcttatgtttgtatatgtaactgtctctctttagtacttaggaatgttcgagttgtacttcagacatgatatctggccatgtggagatttctctgctgccctgataaaaagaaaactgggcaaatgccttttccttcatagcactcccttggctttgtctttctctgtggaatgcagctatcatgtgtgcagtggtgtgagttccctgaagcgtatttgagttgcttgtttcatgtttattgttggttcctgtccagagctctgtgattttttttttaacctggctatattttatttttcccctcttatttttatagtattatatttgtttcagtgacaaggtagagatgtatgattcagttagttttatgagcaccaagcattcaaacagaaagtcatgtggagtgataacattcatgcactctgaaggcatgtaaaggaaaataaaagaggcttgtgttaaatgtatactgcagatctcaaattaccaagggcattgctagatgtaggctatcttggagccagaaagactgaaaaatctgtgatttgaggtatatgtaaataataaagacacactttatagtaatcctctttttagaatgtaggaaacagctcaaacaaagtaactcttgtttatttttggtatagtttttagtgcaagtttagtaaattaagtagtttaaatcttaaattttgtcttgtagttagtttaattgtttcatcacaagattctatgggagtaatgtattttttttatgctggcaaaatgctagtatttttccagcctgggtagagaaatgttggattttatgtatgctctgaaacaaattagcagtttggttaaaacatctgcctaaatgatgagaaacaaattggattataaaatcacacttggtagttttagcatgtcaactagttaagtaaggatttgaaacatatcatacagtcatgagatgaaaaatgacacatagtggccaagccaagtgtctggtaatgaggccaacctcagtgtgtgggtctggtcttgatatgtgttggggagttcagggatgcttttgaaaaataatcttatttcttcagtgttagatcatagttgtctatttaataagactttcctgagtatccatcatgagttagatgacttatttagagatgaagtaacgtagtttgaaatcactacaaaaccgagagtgtataatttttgcacagtggtatttgctttccaactttatggttcagaatttatctttgtagcacgagaactctctagttgaattctggtacagtgagggatactcactaggttagatggagagtaaaactttaacgatagttatttagtagctgaagcagcctttttattcactgaagttagagtatagagtttgggcagtagctgctgggatgctcgatttccccttcctttacattcatttctcttgcatagtcacttctacatttcttctcagtgtgtaggcaattgcaacaacaggaaatactgcatattgctaagactaaaagctttagactccatatcccagatacttgctgagtagactggtgacctctagagttaaataatagtttcaaccaaatcttagtctctccgtttgtaaaagagttctcttgcagattggaatgactcctcagtgggtcaatgatataagtatgatgctttctatagtacttgtacatgtgtgtgtacattagtgttaactagaacctgtgttgatgtcagcccacatccaaaataatagataaaaccactcttgatgacatgtttgtcaaaccctgaaaccgtcagaattacctggaatcctgcagatggatgactagtctttctgtgactaccatagctgggttgggcttaaataattctacccagcaacatttttagacattatatcataactttaacagctgagaattagaaatacaggtaattgctttccatccctttcataatgtgacatttagttggggagaggtggaaaaaaataaatgagaaaacaccttttgaatttgtatctgctgtaaatttctcaaaattcttgctccaaagatagtttgaaaatacagtcggagaagaggggctggcattgtgagttaaagggtccttcagtgattctgaaggcttaattgaatacttacacttcagaagacattgaagttatttatctgtgtaatctcctcaagcttgtagttatagaactctgcccccaccccccttgctgcttagctgagagcagcgggcacgttatttgccttcttgggtgcagttctgggagtgcatgtatttaaggcttgtgagggagccaagccgcaggatctggctggctttcagctgctaaacagggggcatgtaacttgccattggtccccagctgagagaattgtggatgtaatttctttttggtaaacatccattatgaagtgaatttatctcctctacacatttgttttcctttggccgtgtgatcctcattttgttggacacgagttacttctgtagcattacttaacctctcaaaacaatgaagttactttggcaaatgtgtgtaagtcagaggatacataggatatacagtaaatcttatccttaccagtggatacccatcaagagccacaggaagaagcctttctgatatcagttaacagccaaatatccatggtgtgactgagtcagaacatgatattgaacttcatgttttcagggtacatggtacaacttttcctgtgatttctccctgcttcagattacctaatgtggttggtttaagtaaagttaaaacttacatgctccattgagctctttgacattctttattgcttttattagcaatgacaggcaagatcaggactaggtgtttgtagtgctcatatcaggccatgagcagggctcaactttctacttaatctgagcagccactttacctaacaggttactattgtttctcacatattcatgtgttacagagaaatagccatggcttatagcaaataccaattgtgaggctttgggtcaacttagaataggaggttaaagtaaactaaggcttgctctctaaccttcaggccacactgctctcccaaagtaagatgatgcaagaaagcatctactctgagaattcactacttctaaatgtttcacatgtaaagaatcggaatggcattgagcccagttgtgttactttcatttcctctacgtacgtttagtaaactaacccaacagttaagctagaagaacagcattgcagaaagatttgcagtctagtttggaagactttggcaagaataaattctgagtctctaaaataaacatggcatttcaaaagatgaatgagcatggtgtctgtttatataagctaattaattttgcaaactttgtgagctaagtagtatatctgttaactatatgctttcagcaagggtaaaaggtctaaagagcttgcagattgtatggaacctggtggccaattatttttctcacttttagaaatcatacttgagtaaccacaaaaggaggtttggagttcaaagagtcaacagctcgttggtacttaaaagttattaagaatacttaagtattctcttgggtctttaaatggtctttctgggataaattgatgctaatgcattttagtgcagataggtggagaagatgggccttgaggtccttgtcatgttgttcaggtagaattgttagaatttcattttgtgtttatgtaaaaaaaaaacatggacttggacttgtgagttgttctccggcatagaaagtttagtcgtatgttttctttgtaatgaatatttgaatgagcttagtattaatgacctctggctcctgattaaaatggtatttgaatggacttgccctggcccacactcctctaaatgtcttcctaaaacacttaagagtgatgggatggataacactgtaagttaaaacctactggcagatcttagaaggatgctccaacaactggaaagactgggatggaaaaagtatgttgcctctcagctactgacagtgcctgagtcagagtccccaggcaacctctgacctgggtcctgtcctcactcagtgaagccctgattaattagttagaaagtcctttagttctatgccctttctgctaatttatttaattgctgtagtagtcttacagtatggctctaattattagtgttgtttttgagacaaagtgtcactgtgtattccagggtgtcctggctttctccatcttcctctcagttctatggggatagtgacattacaatccactactacccttgatggtctgaggagcttctgtagagtatagggaccttgacacaggccaaatagggatttgtgactttgatgttgaaaaacatttcagaatttcaggatgagggaggcagttttctgaagcagagttggatattttggtaaagaaaggaggccatgaatttggaaggagagaaaggagggctatagatgggagaggcttggaagaagcaaagagaggggagaaatattgtaactatcatctcaaaaattcaaaaacaatatgttaagtatgagggttagaaggaagagaggttatcaaaagaaatttaagacatacctgaatagagtgtgtgggtatgggcatctcaaagagggagggtagcccatgtgtgtgcctgagtctgtgtgtatgtgggtacatgtgcctatggaggtatgagtatgtatttatgtatgagtttctgtctttccatatgtgtgtttgcatgtctgtctgtttttttcaatattcatatttagtcatattgttggattttgttggagtttggtgttattgtcttgaaagaatggaagatcactcactgggtggctctggaggggcactagcaagattacaataaaagtcttgtctgcaaggagagaagaagatggcatatttctactgtaaacaaacctaaattttgtttttatttactgatttatttttaggttatgttggagcaaaggaagaggtcctgggtcttggccaccgtaacatatagtgtaaactattggaaacatttactgtcttccagcaaacacatacgatctaggaaacacattgcatcctggacagtgcagtttctttgtatactgtaatcaggagtataatgagcctggagaggagaggagagctggcagttatatatgagcttatttttgtctggtgtactggagatgggacaactaggcggcttgcttctcagtcacacacagaaaaccacttgcttgaagagttaggttggataaaggattaatgaactgctagtttcctcttgggaaatggaatttaatccttacctgattgatgagtcagggcaatctcaattcattctctaaatatgagctaacttttggtcgtgagggggtaaggaaccaattgcaaacttatataatatnnnnnnnnnnnnnnnnnnnnnnnnnnnnnnnnnnnnnnnnnnnnnnnnnnnnnnnnnnnnnnnnnnnnnnnnnaatttaaatatgggcttgtcaggtatgaagtgaccacttgggtgtaatgattaaaaaggagaaactagggaacatgaaagtttagaggtcaaagacaaactctagaaggttatggtgggagaaaggatgggtaataataaaaagaatgcaagtcaagaaatgtcctgggtttcctgggtgaagaactcacacaggagaaaatggaaccaacgtgtctgcatgctaaaggttgagaagagttacataaacctctctaagaagcaaaataatcaatcaatcaaccatcagttaatcataaatcaatcaatgccggtcaatcaaaagacagtgcagtagcacgtaagcatgtaggaatctggcatgcagctacctggccattactgatgttctcttatacctgaattcttcctattccagtatttgctataaaacttgcaaaaaactgggcatgataaaaaaaaaaaacacacacatgcttaccaacagaaacttaaaatagaataggaacctaaaaaaattatctcaacaatcttttaagcaatgagttttacattgctgggcaacgatcctctcacacacagtagctagaattcaactttatctttatcagcatcttgtgtaagtcactctggagtttggtgggcattttacccaccatgccagttgagtacacaaagctgctttgccttatttctatctcctgagcaggtatgtctggaccaggtttggtgtggtttagctgttgagacatgggttgactatattattattaccattctggcttaaaagttcactaagtgttgtgtatttcaaatgcacgcttatagtttgtgtcttgttgttggaggggtggattacatatacatatacatacacatacacatatacatatacatatacatgtgtatatgtatgtatacacacattgctattttgtggaaattcaagatatttctttacttatacagtctgctaaatatttttaatgtagatatgatttccatttttcttttaggtttttctttttgaggttataatataaccacttcttcctttgtttcctcttccaaaacctcacaagtatctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaccttaccacctcttagcttttcttacttgtctagtagttatttgataagattgaaatctcatgggacttttctgcatccaccttggtatgtctcttgctgttacctttgttcatcttatatttaggcagtcctgttagttaaatcttataagtatacttatgctattcctaggagacacagtctcatagcaagctccgtgatcctgatttttatagtaagagattttagggttttttttttttgccatttacatttaaagttgtattgtaattaggaattgaattttgtgttatgtatgaaatgggaaaactgtttttgaataaactatcatctagcatgactgacctaacagtcctgcatatatgtcatgactattagcttaatgtttttgtggaacccctagcagtgggagcagatgtgtctctgactcttttgcccactcttcggactctttcccttttattgggctgccttgtccagccttgatatatggacttgcacttttaccttgtcttgttgtttcttgtgtcatgtttggttgttgtctcttggtggcttgctctctgaagggaaatggagatggagtggtcctagggagatgggtaatggtagaagtaatggagtgtggggaaactattgtctgagagaagaatccactttcagttaaaagggaccaattctttgttcactgtttgccatctcaggtcttgaaatgtacatggtatccttactctctagtctgtttaaattggtatgttcaacaatccctttggggcacaatatcttgattgttactgaaagaaagcccagtatgatgctttgtctaagctaataaatgctcagtgctaatctttgcattcatatacacacctacttttactgttcaggtgtggacttttgaaaaaatctattttaatttgttgggctttgttctatgttctctctctctctctctctctctctctctctctatatatatatatatatatatatatatatatatatgtatgtatgtatatatatagataatatgtattaaatatacattacatattataagtaatacaagattacatctggataattaacatatttacaatctcacatttttcttgctgcaatcacacataaaactattttaactgaactgtgtgcagcatagtgataaaagtttatctggcatgaacaaggtcttgggtttgatcctcagcactgcaaggaaattttgctttttgaaatgttgaaataattatctttgattatgatcacttgcaatgaagttaatcatttgtaaaacaaatatttcttatcaacatcttctcttcctctacttttccttttcttttctacctttatattctgtttccatgacagcaagttttgtaagttttatataagtaaaaccacacagtattatttatctttttgtaatggcttgctttgctgactgtaattttgaccagttctgtctatactgtgactaataacaggcttttctatttgaaggccatggagttttctactgcgcatcatatttattttatttatgaatctactgatgggccctcaggttgctcccacatcttagctatggtggataatgtagaaatgtatgaggatggcatcagacacccttagcataagctatttcagttcctgtgggtagatacccaacactgggactgcggaagcaatgcagtaattctgtgtttagaagaaactccatgctgatagttgtagtgacttacatttctgccagctctggacagctgctgcctacctatgacttcctatcatggtatgctgttcttcctttgggaagtgtctcttccagtcctttgcccattttagaaattaggttatttgttttcttgtcagagaattgcttcagttccatgaccttagtttgtatttccaactcaggtccctaagacagcatgctaagatcaaaacaacttgctcttgtataatagctcattgttatttttatatactttttcttgacggcaaattatatcttttatttattttataggatctttaacttggaatctctccttggaaattactgattcagtggcatttttttattgtaaataatttgttatatacttaaaatgttagtgtcatttgaaaccttttagttttgtgtggcttccattaacaacatactagattgataacataaaaacataacaatcttgatgccactttcagacttgatgtaaaattgccaagtgagtctaaccatgttctgacacttctgtttattttgagtaaattgacactgtgttgctacacaatgtttttggcaacatgatttgagtacttatctgtcccgcaatgttcaattaaataggaatatttagaaagcacttaaaatatgtggtaattttacgatctatagtctctaactgtattgaggaaactgtatggactgaatagctacaaaaggtaaagaataaacaacgattcagagtgaatttacagaaacctcacaaaacaagtaacaaaataatattttcatggctgtgctgcagtgacaattgtcagagaactcactaaggggaatattagttgtctacaaatgctttttgtcttcactgaaagaaaaatgacttagcaattgcatctgcctataatgacttctcaaggttgtaagcctgtgtaaggaccagtgaaatcaaagcccttcttgcaaccagccctgctactaattaggtagaggaagggggctaggtcattcagacattgggtgcctcgcttattcagcatgcaacctacctccgagagctgaacttgagcagcatgtctgaaatgtcacttgctgcctcttgactggcacccggaagctaactatccatggtggtggtggggaggccaacctgcctagagtattctgccaggagtcatcataaatggtcagcttttattcttgagattaagcctgtattccctgtggaagagaagctgctgaagaccgtggttagttttaggtgttcttgtaaactagaggcaaaagcaagaagagtgatccttagctgtagctgtagctgtagcatgtattcgttgccccataagaaaatgtctactgaagcttggcatcagtagtgactttcctgctcaatggctggagagtagggtcatcttctagcttttctcttgtccacagacatctttttgacaggacggcaattatatttttccttgagctgcatttgggtcttgttactgtttaatcctctacagaacttatctctggaaaaaaataagccttaaagtgaggtttaaattaattaaagaaatgagaactgtaaaatttccccgaacaattaaaacaaaaaaccaaatgtaccaccagtagtcctacagtaaaagtgaattactgcccccttgtggtggacatatatattgtattacccccacaacataaacagaactacatttattttaggtttcccccacccagaaattttgtcctttacaatgaacataaagttcttatgggatgaatttttgtccatttctacctgcttattctttcctattattaagtgaacagagtcacatctgtgaaagtttttcccctctgtgtgagctatgtctatggacttaagctacccggggtgacaaatgttataaggaaccaagccaaatttcatccctatcactttgctgtcaaccccattgcatcaggtgcgttgataaaggcactatctaaactgtcctataaaagtcatatcacacagacaaaggatggctttttgtggctgtaaaacatcagggacatttgaaataccatataaagaaaactttagtggtagtataatagttcatgtaggtacaggtgcttcttgaatttggctgctttctctttctacaattttgaatatgaaacaggatctttaaggcaagctaaatgggtaatgaaccatatatgtactataaggaccaaagaggccattttatattttctttattctggtaaaaactggcagcacagaccacagacatgagcacagccatttgtggtaaaaggacagacagacaggcaggcagtgacacaccctcaacagcatccccttcaggcccaatggcttaatgaattcacttgacctacatagggagtaaaaattttcgattctgatattctgagtaacttttcatgtttgtatgcttaaagaactccatgtcatctattatgtttggtttggggtcactgccttactctaccagttacagtgcaagaagaactactggaaagttatatgagctctatgtgcagagtttttaattaatatttttatttatttaaaactggatgttttcctatctttattctgacaatttcatgtgcatatacagtgaattttagtcattttactcatatttccttttattaattttttactttgagactagaatataattacattatattatattacattataaactttgaggctagaatatattacattatattattcttcttccctttccttcctctatacccacccatatacctccctctctctctccctctctttctctctctctctctctctctcctctctcctctctctctccctccctcccttcctccccgctatatataacttactcagtccatatgatgtatttttttttaatttttaaatttttaatcagggctgaccctttggtattatataaccatttgatgggcttttctctggggaagactgtttctcccactactgtgtgaacccttagtgttatgccacactagttatcgttgtggtttataggtgtcatggatgggtagggctgttgcttgcttctcctttggaagcgttagtggtgctttctgctaacatacaatgtggtcctccgggaggaggctttcagatctgttccaactcagtagcctctgagccatgtctttgaagtcccagcagtaggaaattaccttccccctttcatggggtgaccaagggcaatagcaacagtttggaatgttttgagtctcttggacaactctgcacaacaactggaatgagggtctcccatgcctgatgttggaatttggatagttgtttactcttggagggagggagttattgatatttctgtagatacttaatactacaattctttatggccttttcacacccttacttttatctcccttctgtgttcctctttttcattctccctaactgaagtcccctcccccatttttctcatttcccagatcagatcacccacacccagctgttctctctgtttctcccttactctggaggtggttgcttttgttttcctgttttctggtatatgtactcacatctggatatttggagctaagagcctgagatgagagagaacagaaaacatttgtctttctgagtctgaattacctcagtcaagattatctttcctagttcaattcattaacgtgtagatttcatggtatcattttctttccagccaaagagtatttcctaatgtatatgtgctacatttcctttgtctcttcattggttgtagcacatttaggatgtttgcatttcctagttattgtgaatgagcaacaatgacctgcctgagcagtaggattttgagatctttgagcatctcgtgaaggtatcgctgagtcacatgatggattcacttttagcattttgagaattctgcacactaatttccagagtggatagaccagtttgcaatctgaccaactggataaggctttccttctccccacatcccttcgagtatgtgttgttggctgttttgttatctttgccatgctcactggagtacttattattttgacatgcatttccctaattattgaggactatgaatatttttgaactacttattagtcaccatcgtttcttcttctttagagattgctttgctaaggttccaggctaatttttttaatgggttatggtgattcttgttgtttttttctttgatttgacttttatagagttctggatattgggcctctgccaaatgtatagctgacaaagattctttcccattccacggtcaccctcttcacctggctgattgtattgttggacttgcagaagcttttacttttatgaagtcagtttgtcaattgttggctttaactctctgcaactggagttctactcagagttctatttttcctccacttatctgtttccaggtttctggtttcacagttaagtctttgatccatctgagactagtttggtggaggtaaaaggtattcatcggcatgtgggcatccagttttccagcactgttgaagatctcttttctctagagtgtggtttagcatccttgtcaaatattaaatggctaaagttgtatcctcacgtttggacctttggttctgttccatcggtctacaagtctacgtgtccatttttgttcctacactacattgtttttcattattatggctctgcagtatatcttgagttctgggatggtaatcctgatagcattattctttctgctcatattattttggctatccaggatgttttgtgtgtccatataaattttaggatagttgtttctatttcggggtagaatgagatgaggatttttttttattggtatcgctttgaatctggcaaacacttttaataaaatggtcaatttcacagtacaaatttgaccaacctaagagcacagggtatctttttcatcttctaatgtcttctactatctctttcttcagagatttgatattttcattgtaaagtcctttctctgccttagttaggtttattcttaggtattttgttttctttgaggctattgtgtatagaaatatagccatgatctctttatgtttgtggttggtttgtgttattgatttgtgtgatttgactccattatcctgctatatattttagtttgttgacagtgtctagaagtttactactaaaatttctgagatctccaagtgtatagtattattgtcatctgcaaagaggaatagtttaacttcttttcctattccgttcttttcttctcttgccttattggtccaggtagtactgcaagcatgaggttgaaaagtagtggagatcatggactgtttcattcccgactcttgtaagattgcttctagttttgctattgttggtagcatttttttccctattgagggtgctcttaactgtggatttcccagatgcagcctttattatgttgtggtatatttcttctaattctatactctctgagacttttattatgatttttgcaaaggcttatttttcaactatggatttgatcttgtgtcttttgtatttaaatccatgtgggtaatttattacatttattgatttgagtatatgaaacacttcaagagtaaatctaacttggttatagtgggtaatctattttgttgtatatctgcattttgttaaaattatttgattgagtggtttttaaatctatgttcagcagtgaaatttgcttgtagtttgttttctttctcccttccttccttccttccttccttccttccttccttccttccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttcttttctctctctctttctctctctccttccttccttccttccttccttccttccttccttccttccttccttccttccttccttccttccttcctcccttccttccttccttccttccatccatccatctttacctgtctttcacattagagtgagactggcttcatattaggcatttggaagtgttcctcctgttcctgttctttgaataatttagggagaatgtgctgtgtattctcttgaaagtgtagtagaattctgctgggaatccatctggccttggacttaattcataggaaaatttgtattactatttcaatctcctcatttgttataggtctgtttaggatgttgttcttttcttgatttaattttggtggtttgactgcatctatacatttatccatgtcctttccaacttaatgaaatacaggtttttaaagaattctcttataatattctgaatttctttgggtttgttgtgaagcttccctattcatttatgattttgttagagtcctctctttcctttagttagttgaattaagtgtccatcaatattgatcataatttttcaaagaagcagctttaagatttgttgagttttatatttttctttctatttaattggtttcttctttgatttttattatttcttgctgccagctgattttagatttggtttgttcttatttttccaaattgtaagttgctttattaagttgtttttatgtgttctttctgattttaaatatagatacttcgaactatatacatttgtattgacttcagtaggattattattattattattattattattattattattattccttctcctcctcctcctcgtcctcctcctcctcatcttcctcctcctcctcgtcctcctcctcctcctcgccctcctcctccaggctcgtagtatcatagttttgttgcatattaatttagattggtcacgatgacattttaggacttgaaatgaatttttctaggttcttctggcttctaaaattcctattgagaaaccagctcttattctgataggttttcctttgtatgtgataatctgttttttccttctcttgcagctatctgtatgctttttgttttgtatacttagtgtttaaccatgttatgctgtagacattttcttttgtaatcttgtcgttttggtgcttcataattaagatataattgtatctctttgtccttttcccttcctccaatcttcttataaccagtcctgtgacacccttcacttcctctcatgttgttattgttacatgcacaagtttttattattattattattttatttatttccaatccagttgttgctcccctcttggtacccctcctacagtttctcaccccattcctcctccccttgcttccaagagggtgctcccatcccccactatacctcccccttccctgaagcctcaagtctctcaaggattaagtgcatcttctctcactgaggcctgaccaggaagacctctgctatattggtgcgggggacctcagacctgcccctttatgctccttgttagtggctcagtttcttggcacttcctggggtctgggtatgttgagactgctatgagtcctctctacccttcagcatcttcagtgtttctcctaattcaaccataggggcccccgacttcaattcaatggctaggtttaagtatctgcttgtgcctcagttagctaatggtagagcctctcagaggacagccatgctaggctcccatctgtaagcactacatagcatcagtaatagtgtcacaccttggtgccctcccatgagatggatcccaagttaggccaggtattggaccaccattccttcagtttcttctccatttttgtccctgcagttcttttagacaggaacagttctgggtcagaaattttgactgtggattagtaatgctgtccctgcatttgaggccctgtctatctcctggatgtggactcttcaagttccctctccccagtgtttggcattttggctaaggtcacccccttgagtccatagagtctcatttcctgggtctctgttactttctagagggtcctcccatacccacctcagatgctgtttatctcctttctcttggccctctgggcttctttcctgcccccacaactgatcctgttcctctcccctcgtccacccaggtccctctctccctcagtctcctgtgattatttccttcccccatgccaatgagtttgaggcactttcctactttctcttagattagagtcagagtatctgggtttatgttaaggtctttgattcacttgaacttgatctttatgcagggtgataaaaatatggatcaattttcattctcctacacacagaccactaggtagaccagcaccatttattgaagatgctttcttttttccaatatatgttgcacaagttttaaaagcgtttgttcttttgtaaatttcgaagtaactaagtgattacttggaagtttttggtctacacttttaaattgagatggcaaataaactcttaataggtggcttgttagtttttaatgtgttgataatcttgaaaaaacaatgaatgttagcattcatattaattagaccttccctctacctctgactcccaagctcatgtaaataagaatatgtatgatggaatgttccagaaagactttaatgtttcctctattgataagtatgtcaggtaatagatatgttaattaatttgatttagtcattttacaatgtgaaaatatgttagaacagtatatgcatacaataaagacaatcttcatttgccatctaaagtggttacaatgaactctttatacaggctgaggtaggctcaagcttgatcattttatttgcctacttaacatgtctttctagacaaaacaatgaccaaactagcacctttttaattaagagtcattttcaatgtctgaagaggttagggcaattattcctaagcgtatataccttatatccaaatatgtgtgatcactatgaatgaattgtcttatgatcataataagaacatttctatggtaaagaatttttcttagacccattaatgataaatattagggacatgtagtagtaatcttagaaatggatttaattgctagagccttacaatacaaagtacattagttctgttgcaaggatattttattgcttcagaagtcattaaaaataagaaaaattatactaggacacaggtaattcactgttctgtagttttgtccacgtttatattattctcctaggatagatttttaggcctcagtcaaaagttatgaatctctaccaaatggcttcagagaatgggtgtatcagccttatggttgttgttgttgttgttgttgttgttgttgttgttgcatccgatgcctgctgcttcatattcttaatacattcagtgatgtttattcataggagagtccttcatcaacacttagttttattggcatttttagttgttacatatatttactaaccatttttaatattttcttaattgtatttaggtcctttgtatatttttgtatgaactcctgaaatatttttaaaaggaactggcattttttttcacagaatcattcttcactctttaaaaaataaattttctttccctaatcattcttctgtaaactcagtgtgtccatattaaaaacaaaacaaaaagaaatcaccaattagccattcattatctgcaacctagactttgaatgttgaatcaacctttcttattctgcacccagattgccttgtgagagatggtagaatttgataggacagttgttaaagtgaccctacatcctttagtgttagctgcttgaaagattttatgaattcacagaattctggtatagcacaaactgaaaaatttgcatcttggacataggtgattatttttgttatagttgtggctacaacagtaattatacttgattctccagttttatacttgtcctgtgtgactctttctcatttccatctatatgtttaggagtatatgtggcaaagaagcttttctatttataatcacagccactgttttgttggttcagcttgcttctattacctttcctcttgcaaagtctttcttaggacaaacaataggcagtgtggagaccctagatagcctctgtgccatactgatggaagtatacagaccattactgcaatgatgcaaagactctgaagtcaaatgaaaagaaaattgtaggatttgagagtttgtaaaagaaatcaaagagtgaattcaacagattcattgttttcaaagcctgcctgctattttgtttcaaaataacataccgtattgtgaatgtaatagtagcaatctacagcagagtcttaggaatatttccacagtatttccccacctttcactgtagaagaatggataagatacccttttgtaccatttccatatgtgtgtaagtcaacaagattatgttgctttaccatgtggctttgataaagcctttctagttttgtcattttgataattttatcttccttaaatcttagcaacatgactttctcatgtaatatgtcatataaccttttggttaacaaggaccatagttgtagaagaagactcacaatgtcttgccacatatgtcgatcacaatatctacccttttaaactaaagagtaagaaagcaaaatctgttagatttctcttagggtaacatatatgcatgcctttgaatatgcataatatgttgagaatgtacaaaaatacaaagtccagaagtcattctcaaacttttaatttcttcaatccccacatagatatatcaatatatctagatatagtttaagaaatttaggaataaaaactagcatatataaatattatccaatatgtccaataaagtttaccaaacagataagagcaaggtcagatatatttctcagttttaaccttattttctaatgtctgaaatttggaagaaaatgtatgtagaattctttctataatttcttttttaatattgttttattattttaagttgagcattaagtcagtacaatctactgtgaaccacaaagtatttttacttaattcactcctgtttgtggtcagattttggcttactatcttaattctttggtatttgcaatatatttaatatcagaaatggtactggccccaatcaaaaccaaccaaccaagagttttcggaggaaaaccattatggttatcattgggtccccaaattattgttagttagaccttgtcaccaaaaactaaccattcaatttgaaagaatatctcatagttttaagaagtatcactgaataagcccacaatatgaagtgtttcaagtaaatgtcacagtcatattacaaagccaaagactctctgatgtgggtgatttcattggaataattattagataactgacaaaaatttagctgccttaaaagtatgagtcactgtgcacagatcggggcttagtgaaaatagtatgtgtttcccatagaggctcacagcattcataacacaagctcagatctcttggaaatcaagtcatagatggttgtaagccacgatgggactgaacccaggtcctctgcatgagcagcaagtctccttaaccactgagccaactctccatccccatctagtttattttatattagtgacctttttccacatgaagattttgaaattgtgaatgccaggagctctttttgacattttcagtctagaaaaataagtttttcagtctagtaaaataagttttagcttaattttccattcacttaatttcaatttacttttttttcaagagaaatgccaagatttcgataaaggaatgataaacctaataaatattttatgtattcagtacattctgtacattcttaccaatgctcctttctcttctctactcctaactccacaccatccacacgtcctccatttctcttcagaaaagggaagcccccaatgaatagcaaataagaatgacatatcaaattgcaataagactaggcacttctcctcatattaaggctggatgagacaacacagtaggaggaaaagagtcccaaaagcaggcaaagagtaagagacaaccatcattcccacggttaggagtcctgtaagaagaccaagctacacaactgtaacatatatacaaagcacctaggtcaggcccgcacaggctccctggttgctgattcagactgtgtgagcctgtaatgggctcaggtaacttgaatctgtaggatttcttgcggtgtgcttgacctctctggctcctacaattcttcctttcccacttctgcaggattcctgagctatgcctaatgtttgactgtgggtctctgcatctgtttccaccagctgctagatgaagcctctctgatggtagttttgttaggctcctatctatgagtataaacagaatattattaggaattgttttactctctctctctctctgtctctctctgtctctctgtctgcctgtctctgtctctctctgtctctctctctttctctctctctctctctctcttgtaatgtttggttctattctagatctctggtttctcgtcttccaagcaatgtcatgggtaggctccttttcatggtatgggtctcaatctagacaagtcatttgttggctgctctaatggtttctgtgccatctttaccccagaatatcttgttgacaggacaaattatagtttgaaagttttgtttctgagttggtgtcccagtcctggaagctttgcctgattacagaatagccagtgaaggctttatatcctctattgcttggggtgttagctagggtcatccatgtagattctagggagtttccattatactaggaatgcgcaggctgctcccagttccagttgtttctctcagtatactgtccttctctccttctgtcttccccatcctgatctctcttgttcccatcccccaccctcacctctggccagggttaatgtctattctgtttcccccttcccagggaaattcatgggtctccctcttgagttctccttgtaaactgaatgattttaaacctatagtcagcaatggttgttgcaagcttaggatatgtgtttagttagagaatgtgtagaactgagaaatctttgtaaaactttgtaactgacacttctctttaaacatgctgttttctcttaagtacttctttgtgctcatcaggcgtgtcatcattagagataatggacctacatagttataacttcacagctgtttggattaatgaaggcttggactacggtttcattgggtaggattaagtatgtttaaagatggcagaatgccattataacatttaatgccaaaatttaatgagaaccagaagttaacttcaaggacctttataatttaatatgggggtatgatcatgttctcattattttaatgtagagtctattaaaataagtttatcatcttctttgtgatgtttgtttttactcaggcactatttgttgaatgttgactgtattcctgtcactttgctggggcattgaggcgtaagactatttcccttcctcaacactaacagtgaccatctcatcagaaagtgaacgaataggaaatacttcctttaacttaggaaactgaagtctttgctttggatttataagagatatacctccttcatctcctgcttattttaatttttaaagatttattttatgggcatcagtgttttcttgtttgtatacctatcatgtggttacatggagcctgtgaaggtcagaaaatatgcagatcccttggaaattgattatgttcaggttgttttgaaccaccattggaactgaactgagggcttcttcaagtgtgggaagttctcttaaccaccgagctatctttgtgtgtgtgtgtgtgtgtgtgtgtgtgtgttctccatttcaaggttgtattgtaaagggctagagaactgaatttcttatgtatagggagattgaagtgcatcaattggatagtaagtgccatgttgttgtcacttccatgcaggttgctttggtaactgatggctgaaccctacaggggtagaccatgtgtgctgtataacgttgggagcacagaaggtagagaagggtagttgataaccagaatattttctagagtggttttactgcgctaagggtatgttgtaatgactttctgtaaaatgggacatttatgaagccccctttcttttaatcttgtcatgtgtaatataaaatatgattgtaatataaaataaccaaacccaagtgcctcctgtttcttgttccctttttccataatcttgtatatacacgtatgtaaagaaatgttaattccttctgaagtgaaatacagatcacaaacaggagatagaagaaataaaagatggcagaggcagaggagaaattgtatgcaatagtctatgatggaggaaaaccccaagtatttatttgtggtccagtcattttagtgactaaagaaaagaatggaaatagaagaatatcaccataggtcttttaaaaatatctatagttgaatgcaccctgaccttaactctgtgtatgtacccttgttattctgcatgttaaagctggaattattgggtgtgtatggcagactaccctgctacatccccagtatgtgaatattagtgcataaactcaagtctttttttctcaaatgtttttgagagatcatcttataaaaataattcaggaaatctgtggggaaagtaattatgttttacgagagcagtttcaaagtcttcctaaaacttggatgatagaacttaatggttattttgtgtctaatcgagacatttcaatttaattaaatattaccaccatatgttttattaatccaaattatatcacatgtgactctttggactttcagggtttcttgaaaaaagtgaatcattttgttgtatgtactgtatggtcagaagaaatcagttgtatactcaatatagttttactgtgccttacctgaagagaaactctacacagaatgtatgacacggggtagggaacagagcgtctactgcactgttaggtgatagcacacagcatggcctggagcatttatgtgcttaattacccatccaaagagatctaaagtctgtatgttgtactgtaatgggagctatgcctggataatttaagtgttttatttttttctgaaatgatgtgaacttattttcctaaacactgtgctaaataaagtttatatttatacataaagaagaagactatcactcatttgttagaacaaccaagccttcttctcagtgttaacaggaatgatgagtctaggcaattagatgagaaccaatgaaacacatgatgcatgatccctcatgagtttccgtttttatagaaaaatgaaaaaaaaaatgagcgcacacagctaattgtttcattcattagtctatagagaacctggtgggaatggtgttaaaagcaagagcccattcccctgaagaagggagtttgaaacttctggcatatttactatagagagaggcttactttcatttgaccagcagacatgtggaacagcagagagatgcaaagatggctggtaaaaggtagcattgttaaaagtaagagagtataaatgaattttttgtgccaggattatatttgaaagactaatctggcctctgggaagtttttaaatatgccagttccctgtaaaaagaagatctgtctctgttttagacaacatatccaatttaggaaattattattatttcatcaaaattaatgtgaacaattttccctttgaggctgccttttccataggtgatgttttccagatgggctttgtacaaaattcttaatttttttctttttaagaaaagaaacttttctgacatcctctattttccctctttctccatccatcctaggaaagagaacaccaaaggcaaaagagaagagaaacaagaagaagaggcggaagctgattgagagagcccaagagcagcacagcgtcttcctcgctacagacagagtgaaccaataaaatacaagaaatagctggggcattttgaggttttctgttttgtttatgttgttgttttgcaaaagtgcacaaagctactctccagtccacactggtggacagcattcctgatcctctgaccagtatccattttcagtaatgctgcagagggaggtgcccaagcatggactcagcgttatttatgctttgattggaatctggggcctgtgatggcaggagcttgttgagctgagtcagcgggagctgatgcatctgtactcttgtgatgagcacagtgtgtcataagaacctgtccctggcacggtggacccacaggaggcacaaggctgtagatcaccaccagagaatgcacctgtgcctattttgatggatggcaatgctaagcaagcaagcactgttcacttgtgactttcatttctcacactgtgcactgtcaaagacaaatgtgcatggaaaaatgtttagtgtcacctcatggcgttctcagcatcagtgaccttcaaacggtcctacaatgagactgtgttctagctaggggtatgctgtggaaattcctgctacatttcatcttagtgctaacatgtacagattctgctgcgctacattcaaagctcattactgtatatttatgctttctctgtgtaacaagttatacctgataagatgtcactttgtttctagtgattcttaaccatggtctggtacatggctattctagttttggaaattaacaagtgttttgttgcctcttgttttcttttgttcctatcatttttggcgggggttgggtgggcttgattctaaccgtaagtataggataagctagttttgtatatagagtcaaatgactgatgtcagaggatcagtgctgatagaacttccccagttcatgtcacgatacacacagagagaaagcagcatgaggcatcttgccatcagaagccaaatttcttttgagtcccaaaattgatgacttatgaaatatagctgaaaacaagatttgggtgtagttacttgtatttattatacaatttccaattacattttttttcaaactcaaaataacccatgactttgagtgataggtcacttggcaatgttcttgaattactggggaagctgttgtcactaagataatgagagagaaaatagaatggcttcgcccaagtgagagccacatcttacatttctctgttgaatcggaatcaactatattagaacagaagcctgatagaagctttctagttaacacacacaaggccatggtttcaaaaacatctttgtccccttaggtcagtttgtccttagattatgaattggcaggttctaattgcattatttccctggctgatccaggaaaaagttagaacaaaataagttgcatagttttgaggaaacatccaaagcaaggcgaagcctttccttgccttgcattggcaaaactacctctttagcatttatgttgattcagaaacatcttgctgatatgtgtagatgttttaagcttcattgtgaaaatattgatgcaagataagccatatatgaatgttgtattcaactttagggcttgaaattaatcctaaagtgttcacctctctccatgtctatttacactctgttcctatttactaagagggtaggggtctccttaatatcatacttcattgttaataagtcaatgcttgttatgtttcttggctgttgtttttgtgcattaaaaactcaaaaattgttttttagactgtttttattttgctttaacagagtacacttaagggaaagtgcatagcattccttaccaacactgcttcctgctagtgagtgatcaaaaatatgagagattttgttgatattagtgtttatcatattcatttatgtaaaatattattgcaaagtagttgaaagtgggattttcataactaggcttcataagttccaatctaggttaagaaacctgggacaaattgcttaatctctctgtgttgctatccaccagtagggctgtgttttaggggctatagtaagacatatactacagttctccatacccacaggttgtaatggactccactgtgtatcacagatgtttgcaaaacattacatccattcttactgaacatatatttttcgttattctgtacacttaatgtattcagaaacacttaaacataacatttagacatattatgtattttttataatttttagtgtatgaggaagtttgtacacataattttgagaaaatataacaccagtttttatgagagcatctttgggttgtggtatctgcaggatcttatggaagcaatgccctgaggaaaccaagacatcctagtacagactttgagttaagaggtgggtgtttaatatataaagtgttgtcactatagaagtttgccaaatactacactattacttattccattggctatttatattttccccaaacactctattaacaaaatagaatctaaaattgtttagtggtagagaattttgctggcatccataatcctaggacccatctttcatactgcaaataaatgaataaacatttatggaaatatcagatacctccaatctattgattgacttctagtcattaacttcattctaatgggaatttattcccacttatttttgaggttctgtgttaaaactgcacacatatagatttaaaagtgaattcatggctgtatttctcagttggggtacactcaaggaaattaaaccaggcatttcaaatgcactctaatatcaagaatatagtaattacacaggtagtcaatgagccatgaagtcaaatgtgttaccaaaataagccagagtggagctatagcagcaagccactatcatgctttagggagaattataaaaatgtaattatcaagctattcccttaaagcttcaagctatcgttgaactataaccaggggactttgggaccaaggacaaaactcaagtctaggaggagttgaaatctcagacataacctggtacctctgagaaatgttgcaaactcagaaatgtccaggcttcttcttcctcaactgcttctaagaggaccctacaatcacccagatgtgttcctgagcttgggagcaagggattctgggtaacacctcttgctatgatacagaagtttaatttaagtacaaactggccagaataaccaccaaggcctgctgtagaattatggtaccatcagcctttccctgttaaagaggataatcttggtcaagtaaggttcttcatgattctcatttactcctgtcggtctccacaattgtaagtaattaaattctagtaagcctgtcttgaggatgagtgtttatattctctcttctgtgtctttctcttgttcccctcctccttttttcctcctttttttttctttttttctgagagctgggtcctttttgacttcattcaggactacactattatttctaaatactgctgttcactcaccacaaatatctccttattatctcaccacttatccacttatttctctattaacatacatagtctactactctcttgttaaatattctcctgttccttataggctcttaacagtatgtccttttatcatccactcaacccgagtttcttatatggctgagtgagctgaggttagggtcaatgtccagtctttaggaactgtgtttaacttgtttagtgttttaattgatacttttttggaatgtaaaacaaacatgaattcaaaaatagataattcccacattaatacaaaataatgggttggctagtcaggaaagtgtatacggaataaatatttaagcagattgtcatatggatacaaaggaccatgctagcaaactaccacattccatctcctccagcttcagcaaatgttgtccatcaaatatgatcaaaataccttgaatcccatagtggagttgcagggcaatacctctaagattttgaagctgacagaggattcataacttctagctttcctggtacatgttaatgccctgaagagaaactatcatcttctcccaggaaatgtttattaaaaatggctgcttaagtgttcccccatccttatgcttctggggttcagaacttcttaaacaggcctctctgtacatggtagtatgtttttgtttgatattttggtgtctacttatgtcttatcatgacaagaagttgagtatggactgtgtttctttgaagagtaaagtcttatggacaatgattgcagcatacttgctctctgggtggcttacttgtaccctgtgtttcagattgaagttcgatatcctgcattcctctctggtggagacagtagaccatataccaatggccggaaagaatatgacagatatattttgacataaagcctcagtgacaaacatttgaaatcttggaaagatccaaggcactagaaagcaccagtacttaggtcctgaagcaaaactaggattagaatgaagaaagacatccaggaaacaaatgctaaaatgttgtctggggaaggtagaactgagaggaatcaggtaggaatgaagaccctcgaaggctatagagaaaagtcagattttgttctatatgctgggaggaaaaaaaatcactggatatttgccctgcttaaggagaagagaggtgctctaacttctgaacaccgttctttaagtcatctgtgtagaaggtagattttaagaggaaaagcaaagagatgaagtaggttattgcactaacctagtgagaatccatatgtcattgagaggggctggatctaggacatttgggagatagatatgaaataaaggaacaaatggggcctaagatgttatctatgtctcttgttctgagtaagaatatttaggggacagaactggcaaatgagtatagttttcatatgctaagcttgaagtggtattaggcagctaagtaaaagcaagcagcaagaaggcagttggttataattatggactttagggaaaaggtctaggccaaaatataatttgggaatatattggaatattgctttttctttgaatcctagaccttcatgtgatggcctagaaataatgcaggtgggagaacaaagactttggacattcaaacctacattgtcaaccagagggcgggtagaagtaaggagaaataaaaggtgtccctagaggagcaccagaagcaggtaataatagtgacctaagaagagttgcattgggagttgcaacacacacttataatcccagcattcacaaatttaggtgcttgagggaggaggctcaggagttcaatgatagcctcagatgaggcctgtcggggctacaaggatatacctttaaaacaggagagagttctaggctttatgtagctccctcccttctgttatatagtaaaaataatgagagaagtaaggacaattagaaaaattgtaataaataaaagttggtgtctcctcaattttatttctaaactgtatactctgaataatctcttgaaagtggttttgatatagaaaaaaaaggtatgtcaatgcttaacagacttggaaactatgcttcacataaatgtgataatgatacttaatttcaggttaccatatcatctaccaattttatttacatttatgatgaaataattatctcaatggccctacaaggatttttcttttattgctttcaaaatcaataaaatgtatcaattgggctacagaacaagcattctggaaattataggtccttgagtttgtaattttcagcaatgaggatttttcaaacttgtaattattgagttactttggaagcaactttctgatgtgagcgcatacatgtctgaacagaattaggcaatcacatgctcacaatcatagtatttaactaaaaagcaagattgtggtagaagcactttgttttttccatgctttcttcgtaaaatggaacaaatgagagagctttaattacttacatttcaaatttaaattaaatgggtgatgatagtttgcccattacatatgcctgtcctgggtatattctctcttatacgtcatacctggataataagtgtggtaaagcctggtagaaatggccctctcttttttgagcaacaagtagcattccattccccagtcctcttgcaggtagatggtgcttgtgcctaacttaaatccacagggtttcagagaaatggtatacaaccactaatagttaataggaggtacaccttttgcatgatgtttgtgccttgtgtacaaatacaagtccatgaagtaaaagaagtctatgtctttcagttactatataaaagactgttggcttaagtagttcccccagctatacaaggaaatataaagattcattgtgttgaaccttaatggccctgtattactcttgaccttgagtcaacaccttcatcatggaagtcagaatggtgagaaattcaaatatgttttttaagccacacaatcttgtgtcttctttcatgacaatctaagaaattaacctatgcagtttcatagggatcctgagagctgtgagtccttaaagtagtcttatagccctgatttactgagttggtacagtgaacataggttaaaacaaagttttagagaagatgtttcagcttttctttacaaccaagcaattatctttttattctaacaactcggctgtagttccttgaaatgagtgtccaccagttatcatgcaaactgttggtttaacttaaaggataagcttaatggtccagtattttctcagcctagaatcatgggaataaaacttttcatttattctctgtctgtctgtctttctgtccatccatctgtctgtcagttcatctctctctctctctctctctctctctctctttctctctttctctctctctctctctctctctctctctctctctctctctctctctctctctctctctctctctctctctctctctctctgtgtgtgtgttatggcatgcttgtggaggtcacacaacaacttgtagcagtcagttttcttcttccaacatatagatctggaaaccaaactcagctcattaggtttgatgtcaagtactttttcacacactgagattttgtgacagcccaagaagaaaatttttatgagtgacaaggtgaacattgctattgtttataagattctcagttactacattacatttctttaaaagatgggattattgcgttatgaatttgcttcctattcttttatgtaatgataattgtgctgctatgatatttgcccagtgtttaaaaggggcaggaaaaagtgccaggggtatctgtgttaactatctctgtaaattttcagatgagttctccactctatgtggtgtacaaactgatataaagtcaaagtttaaccaatgtgaaacatctgctttaggtgacatcttaattttgtgatgagctaagtgacttgagagggattgctgtaggttttataaccatgtggagataacactatgcttgatcatcttcactcaaaggccacacatagagatgtatggaagtgttaagctccatcatgtgcacatcacaggcaagcccaggctcctgtgtatcctgccttgctcttctctcttgcttaatgctctgcctcttttgtgtttcccatgtattcctgtctctgacaacatacatgactttatcttggatttgttggcatatactcctggaagttctctgtgttctttagtttgttctgaagttacattattagaatcatactgagaaattctgagcattgatccaatggaaaaagaaaacaccaggcttcagctccaagcaaaagcactttatgagtgtgtggctggggcacatgttaataacaccagcacccaggtggccaaattcatgtccaccctcttgatctgataacacagagcaggaggatgaattggtaacgacccaggctgaaaacagatggtgactccctgtgtgtatgttgttgaaaacctacaaagagaaaacagcataactatatgtctttacatttaaattagtgtatttcaaaaacacaggcttctgagctttgagaacagggtagctgaatgtgtttcatcttataggtttgaactttggtgtgctgtggggaagagcaacagtcaaaatggatggtatgttcattaccctttcgttaatttcttagtatcagtggtgcaccactgtaattaggagttctgtgcagttctttgtcattaaatttgctacaccctaattatggatgttttgaacattcaaaagaccaccttctcgaagttggcctccagtattaagtatgcttgcagattagacagcgtctcccttgctccataatgctgattgacttttgtgctaagcgatttgtcttaaagcatgttgttgataattaacacaaagagtattttatcaaaatgtactcaaatacataatatcatactgaatgtgttcttgagatgtgaggaggtacatgagtttgattctttccagagatgattattcagtttacactcagagacaaataaaacagctgctcaaagccaatttaaatgtatctcagaatgatttggggaaacgttatcacaaactcaccttttgatttttgtgagagtctgggatgatttaatataaaagtacattaaaaacaagtatagttgaaggctgggcagagttacaaggccacttcagaatctggtgtggacttcctcaatagagtcatagataagcaggctgggagaggctttctgtcagcccatgttccacacttgtgcaagtctctagtctatcctgagaaatcatatgtgttcttccaagtgaaattaatatggtccaatttcaaagctgcttcagatatatctgggatacgtttttccaaagtgccaagaattcttactcgggcctgttccacactactccatggacagacccctaaaccacaggtctagtcttcctgcttctcatgattcatgcatcctttctcatttcttctgagtttcaaaactaaatggaagagaatgtttctattatcattttagatattttcacatgtatatgcagctctatgtaatttcattgcttcagaagcattaataagacattaaataatatccaatgctgagctatgtaacctaaattaggagaaataattggatttcaaacagtttttactattttctaaattcatggtgtccaatgattctccaaaatttgtactgtgcattgggagaagacataggatataatgttacttggacattcaggaagcatggtattaattttcccaacaggtctggggcacttgcagtacacagtgataaaaatcaaagctatgaagatgatatacttcaataaatcagaaagattgtactaccatttccaatgagaccagtcttcattaaaaactatcatttaataccctccttaaggggagggcatatgacgctcctctacacaaagatagttactaatgagactgggctgaatggatggcctttctccatgatgctgaatcctcagtaatatcttttgtgaggctgatacaaagaagtatgcactatgtttaacatcacaaccgctatagttcattgctttttataatttctcttggaaatttcacatataactgaagatctttcatgatctaaaaataatttttaatataaataaaatttcagataatagcttcaataaagttaggttataaaactgacattttgatactattttatattaatgctcccatggtgttacagtattattcataccaaccgagacatgcagccatcttaattgtttattgactgaagaataggtaaagaaaatgtgttatatttacacagtggaatactactcagtcataaaaatgtatgaaatccagtcacctgtgacagacaacacagatggatctaacagtcattgtgttaagtgacatatggcagacacagaaggacaaatacctgtgctcactcatatgtggaaacaaacaaaggagagaagaaaggtatgtatgagaagcta

SEQ ID NO: 872 - DNA, 740 bp, Mus musculus
cagcttctcttttcctcctctcccaggttcaccgtggagggagagatgctcatcgagccaaattgatcattgcagccccagggcagtgacatctgtctctgagtcctccctaggagcgcgacccgcactgtctccttccaggagcccgtcatttcctcgacttttgagaggtgtctctccccagcccgaccgtccagatgcgtttttgcctcttctcatttgccctcatcattctgaactgtatggattacagccagtgccaaggcaaccgatggagacgcaataagcgagctagttatgtatcaaatcccatttgcaagggttgtttgtcttgttcgaaggacaatggttgcagccgatgtcaacagaagttgttctttttccttcgaagagaaggaatgcgtcagtatggagagtgcctgcattcctgcccatcagggtattatggacaccgagccccagatatgaacagatgtgcacgatgcagaatagaaaactgtgattcttgctttagcaaagacttttgtacgaagtgcaaagtaggcttttatttgcatagaggccgctgctttgatgaatgtccagatggttttgcaccgttagatgagactatggaatgtgtaggaaagagaacaccaaaggcaaaagagaagagaaacaagaagaagaggcggaagctgattgagagagcccaagagcagcacagcgtcttcctcgctacagacagagtgaaccaataa

SEQ ID NO: 873 - protein, 190 aa, Mus musculus
EVSLPSPTVQMRFCLFSFALIILNCMDYSQCQGNRWRRNKRASYVSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLDETMECVGKRTPKAKEKRNKKKRRKLIERAQEQHSVFLATDRVNQ

SEQ ID NO: 874 - DNA, 201986 bp, Homo sapiens
  misc_feature (1)...(201986): n = A,T,C or G
gaagccaagcatgcccagccaccatagtgtggtggcgacagagaaatttttggagaggtctttggaaagatattgactctataactagatggtggtgggcctgggctctctctgagggtccccagggccattagtcaggaggaagagctagacatcatgcagagaatgagttacaagctgctactggctgtagacctctgctgtgtccctcattatcttactgtgaaaagactttctgaaagtcttaacaaattttatttttgcatctctaccccaccaaacttcatataattcctcttctatccaactctaacacaaaatcgttatacagcagaggctttgggaaatacagttcccaactgaccccagggaacacactgtaaatcacaacagtccatcccttgacagtctggcacccaacccatgcctcttttaaccacatttaattcccaaatttgtgcttccacataacatgtcacacttatgcacacaaaaacatactgactttcttcccaaaaggaaatatacaaagtcccacatgcccatttattcatcctggggtaatattcattcttttatctgagtcacacttgctatttcatattctatagtctaaatactgagatataaggttaactacagttaacacatcttatgttagataatagaggaatatgagataaaaatattgatatttgatattcattttaaatcaaggaggaaatacttataactgctatagtctgtgttttgcaactagtcatatgattgtagctggtatttatttatttattttgaggcagagtcttgctttgtcgcccaggctggagtgcagtggcgcgatcttggctcactgcaacctccgcctcccgggttcaagcaattctccagcctcagccttccaagtatctgggactacaggcacataccaccacacctggctaatttttgtatttttagtagagactggatttcactatgttggccaggctggtctcaaactcctggcctcaggtgatccacccgcctcagcctccgaaagtgctgggattacaggcatgagccactgcactcagcctgtagctggtatttataacttattttttctctaggactgaaataggtgagcagcttactaatgcctttcttgatttgtatagcagaagtatttcctttctgactaacagaggtaccactcgagtcactgcaacagagagccacagctccttaaccagttccggacttgagccagttcatagccccagagctcattgaatgaagaggtcaaatctctggaaccagcatcctcactgtaaatctttttcctggtcttccacaataggacctcagtccatttactcagatgactgtgtttctgggaacaggaactaattggacctttggggatgactggacattaattctaaactgaccttagtttcttgatgcccaaaatgtcattgtgattcaccacattagagaggcttatgaagactggatgatttctggggtattggcttgagcctatgccctagtgggcttagttgatccccaaacctaccccatgtttatttcttcacttctggagtgaatagttagaatagacatgtttagcaactagaagaattcccacatttgttctctgacctgtgtatatattttttattttatatctgtaacaaaatttttccatactgttccaaggttaaaagggcttctacagatgcacgtgatactgcaaagtagcaaagtaaaatacattgcaaatagctgaggaaaatgtgggaaagggaaaataaggctagaaacttaaaatggagcaagaaataaaactagtacataaaatgtgtgacataaacttttgtacatttgctgagggtggctgacaaatttgttcttgagcagtaacacaattcattacaactataagttaaagacaaatggaatgattaggggaggtgtatctattttggataccagtacagaaaaaagttcagaggaggatatttcctgcctttaggaattacctgttctattgtttacttctattatagcaagctgagtgtccacaaataaagtaaaaccagaccttctattcatttaatgaaaacaacctaatttttaagaaaactgagaatctcttgttacttgtgtggagtaatagttccttctagcaacaacattcacaccacaaggaatggaaatgacacatattactttagttcaaaagagttcagggcacacaaaattaaataagggaaattatttgaaaactttgggtcagatcttgagttttctcttttgagctggtctgtgttggacttcctttgaagtcaacaaagctgcctcctggatttcttccatggggatgaagcacaaaatgagaaataggcttcatcacatcagtccacagatgagtactcaagtggcagaaggcagtattaacattcggaggagtcaaatatttacacagtttttaaacattaaataagtgattgtgatgtggctttttaaaacaacaaatcagcctagataaggactggtcagtgaccttgttgaagacctttcatattaatataattacttcacacaaaatataataaatgaacatgggctatcacatgcaactggcaaaacagacattgtgcttatatttaacaggaaaaaactatcaatagtagcacaatggcaaaaatgctataatttgttccaaagcaattaaaggataaattctacactggaagagtgcatacaatcaatatcaacaatgattaaaaagattgtgagaaattttaaatctgagaatgaataacagataacataaaagataactctaaatcaattagctaatgaaaacaagaatcagtgccaaagtcaaccaaatctataagcataaatgcttatgaaagattcagaaaactttaaatctattctactgtagcccacactgtacagtcataaaatcactagcatcctatgggtgttaacattgaaaaaatatattggaaaattcctaaatgaaaatctaaaaataatggcacaaggaagagctttttctttctctttttaaaaagtatactttaagttctgggatacatatgcagaatgtgcaggtttgttacataggtatacatgtgccatggtggtttgctgcacccatcaacccatcatctacattaggtatttctcctaatgctatctctcccctagcccccaaccccctgacaggccctggtgtgtgatgttcccctccctgtgtccatgccttctcattgttcaactcccacttataagtgagaacatgcagtgtttggttttggttttctgttcttgtgttagtttgctgagaatgatggtttccagcttcaaccatgtccctgcaaaggacatgaactcttccttttttatggctgcatagtattccatggtgtatatgtgccacattttctttatccagtctatcactgatgggcatttgggttggttccaagtctttcctgttgtgaatagtgccacaataaacatatgtgtgcatgtgtctgtatagtggaatgatttataattctttgggtatatacccagtaatgagattggtgagtcaaatggtatttctggttctagacccttgaggaattgccacattgtcttccacaatggttgaactaatttacactcacaccaacaacgtaaaagtgttcttatttctccacatcctctccagcatctgttgtttcctgtctttttaatgaacaccattctaactggcatgagatggtatctcattgtggttttgatttgcatttctctaatgaccagtgataatgagctttttttcatatgtttgttggctgcataaatgtcttctcttgagaagggtctgttcatatcctttgcccactttttgatggggttgtttttttcttgtaaatttgtttaagttctttgtagattctggatatttgcccttagttagatggatagattgcaaaaattttctctcattctgtaggttgcctgttcactctgatgatagtttcttttgttgtgcagaagctttttagtttaattggatcccatttgtcaattttggcttttgttgccattgcttttggtgttttagtcatgaattctttgcccatgcctatgtcctgaatggtattgcctaggttttcttctagggtttttatagttttaggtcttacgtttaagtctttaattcatgttgagttaatttttgtataaggtgtaagaaaggggtccagtttcagttttctgcctatggctacccagttttccaacacaatttattaaatagggaatcctttccccactgcttttgtcaggtttgtcaaagatcatatggttgtagatgtgtggccttatttctgaggcctctgttctgttccattggtctatatatctgttttgataccagtaccatgctgttttggttactgtagccttgtagtatagtctgaagtcaggtagcatgatgcctccaactttgttctttttgcttaggattgtcttggccatatgggctcttttttttggttccatatgaaatttaaagtagttttttctaattctgtgaagaaagtcaatggtagcttgatggggatagcattgaatctataaattactttgggcactatggccattatcatggtattgattcttcctatccatcagcatggaatgttttttccatttctttgtgtcctctctgatttccttgagcagtgatttgtagttctccttgaagaggtccttcacatcccttgtaagttgtattcctaggtattttattctctttgtagcaattgtgaatgggagttctctcatgatttggctctctgtttgcctattgttgtataggaatgcttgtgatttttgcacatttattttgtatcctgagattttgctgaagttgcttatcagcttaaggagattttgggctgagacaatgggattttctaaatataggatcatgtcatctggaaagagagacaatttgacttcctctcttcctatttgaataccctttatttattgcctgattgccctggccagaatttccaatactatgttgaataggagtggtgagagagggcatccttgtcttgtgctggttttcaaaggcaatgcttccagcttttgcccattcagtatggtattggttgtgggtttgtcataaatagcgaggaagagctttttcaagtatgacacagagaagctataaaagataagactggcaaactgcactatgtaaaagtatttaaaatttttttacatattaatatacatcaaaaacaaagtcaaaaggtaaataagaaacttggaaaaatatgcaactcaaatcacaaaagacattatatcaatacatgcaaattctacaaacaaaaacaaatgaccaagaacacaatagaaaaataggcaaattatatcttcagagagttcatggaaaagaaaatacaaatggatggagcatactaaagacacacaaaatttcatttaaaagaaaataaatacaaattaacactttactgagatacgactttttgcctacaagtgtcaaaagtcaaaaagtgttggtcagcatctagagataggcattttcacacggtgtaatatgaaagaacctttgtgaaaggcaatttgcagaacacacacacatatatccaactgtttgattcaacttttctacttttaagaatttataatggaaaggtaaaatgacacatgaaaaagttaattgaagcattgcttaagatacaaaaagtatgaaaacaatctaaatgtatattgatagggaggctggctaaatacagccatacgatgaaataatatgtgactatataaaaagaacaggacagttctctatgaactgatgccatggtggctcacgcctgtaatctcagcactttgggaggccgaggcaggcggatcacgaagtccggagatcaagaccatcctggctaaaacggtgaaaccctgtctctgctaaaaatacaaaaagtagctgggtgtggtcgcatgtgcctgtaatcccagctattcgtgaggctgaggcaggagaatcgcttgaaccagggagtcggaggttccagtgagcccggatcgtaccactgcactccagcctggcgacagaacaagactccatctcaaaaaaaaaaaaaaaaaacaacccctcaaggtacagattagtgaatacagtattctactaattgcataaaagagaggaagaatatattataaaacagagaaggaagaatgtattatatatatgtatacgcacatattatatgtatgcctatatatgtgcatgtacatatatataatacattcttccttctttccttgcttgataagcaaaaagattatcaagttacttgtttgataagcaccaaacatcttctgaagtataccaaaaaccgtgaacacttgtaaaagaataactgattgactctaaggagaactggatgcctgagagaaggaggtaggagagactttgccctgttatggtgttttgtaaggattgaattttgagctgtatgaacgaattacaagtcaaaaaataaaatacagaagttatctcctctctataacatcatcccccacttctgccctcagttaactttccctatcaccaatgagtggtatagagtcaacctcctcagtatatcagtatacttctctgtaaacagaacccaggcacaagtctatttacaaagccagtttaatgaaaccactatataaactcagtttgaagaaaaagtccattgagtctccaagatggagaaactgtgagctgtgagcctcaacaacaccacattctgagtttagaaatgaaaggaagcagagatatgggattaaagttaatgatagtctaggatccattagggttgtattttttagtagcaagaacattcctgggattttgaagtcaggaaaaatattcagtgaatgtaaaaaaaaaaaattctgcattatcaacaaattagccccaaagtgattaagtgtgagactccaagtaccccaagaactaagtctgacagagttttaaggttcactggtgtcttttaagaggcagagatagaccaggagggagcaaaagaaggaattaagaattttcctttcttccagagcctattcttttcttactaaacacattaaccaattttctacagaagtggtactgtcaaaattcttcctcatgaactgaatctgggggttcactaaactgaaaagcatctctggctaaaaatgcaccaactgtacaacacaaaagattaaaattaaaattatggaaagttgtctttgaagggataagggtgaagtggtctgtaaatttaactaaggaaggcagtggctaaccctcttctttctacacaaagaacccatcactgatgagtttgcccttacactggttagataccatagcaaacttcctagtacaaatagaaaattgattgtaaaccagaacatgtagaagtgaaagagaccttggacagacttcctaaaaatactgccaaggaaactgagaccaagaaaattgcccaaagtgacgcaggtgattaatggtagcgctacctctgcttggtcttgtgtttacttttgcctttaaatattttaaaagacactgatgaccactgatcttgaatggatctcaaagctttgcaaggaggcaggggggcttacttagggaagacttcctttctcccatagatttaactcctttataagtataattcatttgttgtgtgcatatatgactatatttggaaagaagtagtatttatggtgctgaagagatattcagcatcatatcaagatgatcaagaaatatcaagttatgccaaacactggggccactccctacactgaaatgtttccaaattctgtgataaaaatcaaaggctcaaaagtcaagaaacagatccactgtttctgcaatgtgttttgtgaactctatttgtgccctgtgggccagtctcagtgatggattttcttatctatgaaatgggaccaatgacctcaactcagatttacttgggtgttctcaggcatgcatcaaaggcatactgctgaaattcttagcacataaataccactatgtaatagtgagtctgtaaaatagttatgaataggcaataatggaatagttaataaatatgagtattgcaatattctttttatatgattgtcttttaagtcatcaaatttctgaacatcttctgaaactgaaggaatagaaaagggaatttaaatagtataaaatgctatcataataatatggtaactgcgggcatatctatagacattcatactgccacggttagtggcataaattcttatcttttgcttaaggaataaatacattttttcctacagtagtgaatgcaggacagatttcaccagaatgaaattggatggcatcaagtctatttaatgtaacactttgttaaacagaatattttccccaaacccaaagcacctaaaagtttaattcaggagactttggaaatgagaggaggattaagaatgaaaaatactttagtgggaagtgaactttttaaaattatttttaaagaatcaaggccccaacttcttcagcacttcaggcaacggatcacaggtttttgttttattggagaagaaacaaagtaaataacagttctgaggatgaacaaaagctgttgggaatacccatttcactcctcaaagtgggggcgcgttttatgaataatttcagccggctaacataccttcctgcaaaacacagacaagatgtaaattaaaaagtggcagagttgtggcatattgcaaaagtttaaagggagtcatcagtccttcagtcagatctccctgcagaaaggttggcgctgaggttggaactgaccctagagggctggagaggaccccttgggggtgagcagccgggttctgggacccagcaaggtcagggggcgtctccccagctactctttatctatcccccgcactttggaaagcccgaagaggattcgctccaagttaggcgcgctgttggctgtcaacgttctttaggacctcagggaaaccgggacgtttctggctttaggacccaggaactccgaggcagcctagacttagatgccttggaccacagcaccacctacttatagaagcatcccaagcctcagccggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttagggaggcagagagtgtgagcgggcgcaccccttgcctggggaccgcgctcgcgggcggggacggagcatcccagtggctgcacccgccgctccgcgctcctgcctggcgtcgccaaccccgcggcggccgctggaattccagagctgccaggcgctcccagccggtctcggcaaacttttccccagcccacgtgctaaccaagcggctcgcttcccgagcccgggatggagcaccgcgcctagggaggccgcgccgcccgagacgtgcgcacggtaggcaacccacaccaaggcagccgcagctgcggcgcttgggtacaccgccgtggactccaaatggcctaagagcgttcttttagccctgcgctctcagtgcctttagagttctttcctttccccggagcgccggcacaacgcattatgccgctgggtcggagcttagggctcggcagaggttgctaattcactgattataatcaccttcctctccaactcgtccgcagctgcccgctctggattaagccgctccgcggctcgtgctaggcagtgggttcgcttcctccttccctctcttctttaaattgggacgtgcgaaggcgcagctgcctccccggggctctctccatcccccacacaccctgttttcgcttcttgtctctcaggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgaggtgggtccctctctgccaaaggtgcgtggtgggcttcaggggtggcgtgtggaggcgctcactcacgccctggctccgggggctcagatggtcagggctgtgctctccaccccagcttttgcgggtccccagtccccacctttaggaccctggagctctacaaaacactctgttttctgtaccctggaggcgcggggagccggagcgagacgcgctgggagctcggcgagccgggcgccaatcgggcgctcagggctaagtcgtgcggtccgcactcatgttcgccgccccacctcctcatctaaacttgtctctttaggacgtatttcttatctgacatgcattttttttttgtcgtcgttgttcttctctctgtcctcctaaccatcttccctgtagctcatttgttttatcttccccatccacgtgcgccccaaacccggcctcagatctcttcggacttgacctagcatagtgtgtgtgtggtgtgtgggtgtacccaagcgtgtgtctgtattccggagcttgggaggggtaccaagtcgagggggaggacctccctttccagaaaaaggccaacatagatctcttttttctggaaactgcgacgagatgggaactttctgaattaagcagcaattcccgcgctggttttctggggagtcctcgcctccagaggtttgtttttaaaacaggccccactttgctctctccatttgctttgcaaaagcagccacaccggtggaggcttctgttctcaatgaaattcacttgcggctttttaactgctccctccctctccatcacttgtgcgtagcggagaaggcgggtggaagcctccagaaaggtttcggggaactcgctttcctgcagatttagtgcgtatttctgtctcggagtccgctggagatgcaactaatccaactgcattttagaagaagggcggctagacacgattcaattttctgggtggatttaaacataaaccactcaccacacgcacatcgaattacccgcgcaggaagggcgcgcagcagccccttcccagggacctggtgagagctgtctatttcattcggcactttggacttttgcgcaattagaatttgtcgccgggttcatgaatgttgactttttctccaagatgtaaacatctcactcgatctgtgatgtgatttgtttataactcattgtatgtaatctccgctcctgcatccagattttgaggaggactttccgaaccttatttttttgatggctttttaggacattgttaagctgttctcacctaggggcagagctagagattggcccacctgagcgcagagctccaaataactgatggtgtgcgacttctgtagtccctgcgcttcaattgtctctgtatctgcggcttgtaagaataaaccttctccaacttctctccctccctctcccccgatttctgacttttggaaattgtttattttcagaaattattttacttaaaaatactagagagaaatttcttcccaaaggccatgagagtttgatattgatacttgtcttgaaaaagtccctttttatctcctctctcctcccctcctgattcctttctcaatcccagtactttctttcgagtattcggcagagccagcaatttttgattacattatggtcaaaagtgtttggagaggcttttcctctttttataagtcaaagctgcagtctacttagaaaaactaaagtgcttgaagtctgcaaaatatagaaatgtctaaaatcctttgccagatccttattagatgacttgctaattcagtgatggctttctgatccaccctgcctgtcccattgtggttgagtggggaagaaccaagcatattgttttagtagaacttaatgcagagatgctgtttggtggaaaaggacattacagcactcctgcggccagaagggatactgcatgccttctctgcagtgccatctctaagaatctgcctatgccttcttaggtatctgaagcagaacctatttatttcaaagcttacttttagcaaaatctcttgtaacgattaccatccacatcccaaagcactgacagtctaactctaaattgtgcaatagtaacttatgccaaatcaacctttcgatttaataaaattcaaatgctttcaagaacgtgtaaattggtaagggtgtaaaaaaaaaatcaaactttttttcttcttctcaacagatatccctttacaaatcccaagtttctggctaaaataactgtcgtccttaaaagtgaccacactatctgtaccaacaaagggtgtactgtgtttttaattaaaagtggaactacttaaagggctggccagacagtgtagggtgatagtagcttttctactttgcagggaagcttaaggattgcattgtgagagtattgaaatgaatagagatctaactcaagttgtgtgaattgtccctcttcacaaacttaagctggttttaattgatctcatgtccactgattgatcctacaccaattgttgtgcataccaaacaattggctttccccaaaaagattgatttcaattagttcctcagtgaatgcttgactactggccaaatcatgtcagcagtgacagttgacatgttagggcctatgtgataccaacatttccctttttcccctttgttttggatagtgtcagttaaatattattttccaagaagaaaagtaattggtattttttataaaaggtgttgtagtttggaagattagttattttcttggctttgtgctacaagtaggtggcagtggtaccaggattggttaggcttacccctgggacctgattcttttttttttttttccatattccatctgcgaataatcaaaccttcactgtggagcattctccgaactcctttggcattatgtttagtctgctctatgatctcacatgctccataatatcattttcttaatgaaataaaattcttggcagagattagataatttagtcagttaaaatcaattgcatccagtttggaatggagagcaaatatatcatttaacggtatattttatttcaaaatatagccagacgattgagaaaatagtattttgaccgtctctacttttggacaaaacttcaaatgggggagatcatcacgaacaataagactacctacctaccatattttcttccccttattttgaaaaattataaaaatgcatttgatagtcactaatggggcctggttgcaataattttaaaaaattaattaggcacaaacacaatacaatactgacaatgaatatcttttagaggggagacacatgccaacattttgaaaagctgattaataactcttatttttctctccatgtagcatattaagatttgtctccctgactcccccttcaaaatagtcatgattggctattgttaacccctactatctgtcttggtcttgaaaccacttatgattgatttatatgttaagtggagttctttgattactttcattttttggaatggttgtaagccacatttcagactggattactgaaaggtggatagacaaatcataactttattgtggtctcctggaatttctggagcatggcatgtaatgacttaatcttatatctccctcattctatttttataccttgtggtattttaaccagggatttatgaaaacttcttgatataattctcaatgcagcaaggtttccaaatgtataattcatgtttctggtggtccgatggcagggggcgtgctatgactagtgtttctttccgtagccttttccgtactgaatcctcagcttctccttcctctaataactccttgtttcacaaaattagatatagtttcttccataaaaaggaagggtttgtcacaaatattgtggcatgtttctggtaactgaggccagagaaagcaaacattttctcttaaaccttatagagataaattaatttgtgtttgtgttcttaaaaatttaatgaaaagattcgaattttttttttacaaatactttctaaatagtttacttctcctgatattctttcaaaatacaaaatgacacatggaacatactaacctacagttaaatgaaaaagtttcaaaacacattttgtacacttgcttactttaagttccaaagtatttcagaaaagctgatgtgatgtttaactttgcaacataaacatgttctgttcttttctcttttttgattggctgctttctcttccaacataacggcataattttttaaggcagggtcttaccagtacagagaggtcagaaagttgctgtgctcaaactaacatcttattttgccacagaaatttggaagtgattcagaataggtgacattcccctaggccctgggctttctttatttgcttttaaaatccagcttggctagaatccaatattcacagaaatcacaagttggaaatgacacttctagttccctaatgcaaaaccacctcttatttagagacaaactggccagtttgtggaatatccagggtacttctttccttccaactgactgcctttaaactatttcttttggaaatacgtatccttatccatcccaagtccaggaagtaggggacagacagattttatttgatataagcttgataactactctgctaaaaggaggtgataaactctgggatgacaaagttttaaaatttctgtatttaagatgacatgaagcttattttttctccattaactgcagcaatcaagggctgatcaggtgaagacagtgttgcgtatctatatttatacattttcatatgttcatccagaataaatagaaaacatgctaattaatactaaagtgtatacataatgtatatttatatatattagggaaggtatatatgcatacgtgtatacatgggtgtgtgtgtagggaaagcgatgagtatagtataattatggaggatcgggatttcagaactaaaagattttcactcatttttttctagtccttttcatctttctcttcgacaagatgaaaagatgggagtgggtgggaaagggggtggcagggagagaatgagaataagattgggtagggatagtgtttttactctttccaaagcccaccttccacctgttcttctctcctctaggacccttctggatcagtcacccttatttcaagcatgctgctgttcctctaatcccaaaattgctgattccctccttcttcacactgctttccaatctcttctgctttccttcacttcttcccttccctcctctggcttgataatcctgtttcattcactcttcaatctgttactatttggcttctaccttcacccttttaataaaaagattttcttttctttaaagaaattaacaaacaagaaaaatattaaaagtttataaatgttagacttattttttagagcgcttttaggttcacagcaaaattgagtggaaggtacagagatttttagaaaggggtttcttaatggccagtcatactcccctcattgccaagtccagcatcggtacagttctctgggacttgttcctatggtgatatcttatcacctctttcctttggctagtgacactgcactggttttacctcctattttctgtccattctcttctttggttccctcactgagaatgtagactagtgtttcttcacctttattcatttccttggggaattttacccgtccctgtttctcgaactgtcatttctacataaagtcctttaattctaggctcaatttttcttttcttctttttttttctttcagcttcagattatcctacactcagatctcccaattactgccaatatggatagatattccatgcatactcaaacctgacaattcgctttcttttctgtgccccctcccaaatgtgttcctctgcttatattctttttttatccatggagttctgggtgccaaggctgggagcctcgctatagtctttgacttttctgttgcctcgtatcagtttgttcttgcctaaactatatcggattagtgagtttatatccatctcattctttccattcccaaagatatttcctagctcaggctctcatagactcctcatcctccagcatctacttcaatccacttatgatgctccatcccttacagtgctgccacattccatttttctccaccacagatctgatcatattacttctctgctaataaaccctaaacctcccaggcctccatattgactgccgaataaacaccagccttttctatagcagtcagcgttccccaccatctgaccacagcctgctttcaaccttctaccaccttgaaagcacacttggcttaagctatcccagataacttcatttctgggcatgccatgtgttttcaagctcttgcgctgttgagcatgtgtgtggtgcccacctaaaatgccactgcttctgtgaagccttcctggaattttctgccttcctttctaaagccaaaatcaattattccctcatagtttcttagatttctgggctattcttaaaggactcttatttttcctttttttctggttatcttgccttatgtatcatcatattttaagcttctcttaggcagaactacggtacatttatctttgtactcctcaaactagaccttttagagtgctttctccacaaaatgtagtggaacaaaaagtcattgtatataacatttttgttgttttcccttaaaattattttggtgacttaatgagaaatgctgtttttttaaaaattgaagttctttgcacatagttgatgtttgaatgattaaatattatgggtattctcattatttataattctttatagtttaaagaaaaattaaaaaaaaaaacaggtataaaagcattcccagcccagtactcattctgaagtctcttctgattatttcagaatttctccgagtacactagtgtctgtgtatctgtatacttgtttgttatttgaatgattgagtattccaagtgacaggtgatttgtgggtatggtagggaaaactggtggtagtggggtaacccttttttttttttttgagatggaatttcgctcttgttgcccagcctggagtgcaatggtgtgatcttgactcactgaacctccacctcctgggtccaagtgattcttctgcctcagcttcccaagtagctgggattatagatgcccaataccatgcccagctaatttttgtatttttagtagagatggggttttgccatgttggccaggctggtcttgaactcctgacctcaggtgatcctcccgccttggcctcccaaaatgctgggattacaggcgtgagccaccgtgcccggctggtaacccatattttaaaaaatacttattttatagaaaagggcaataaaggatttttatccccaaacactttgaccatatgaatgaataataatttaggataaaataaaagaaagtggtatttgccttctatatactcatattaataatataagtacaggaaaaaatttaatcctagttattatatttatgattttagtataataaatgtagctatgtggacatacccatgagagatacagatgtgtgtgtattttagaacaagttctgtaagtatgaagagaccacacagttctgtgtagtgccttccaggagaacactgacatttcactgtcctttgaatgaagtgggacctgtttgacgtatacagaaggtgagctgcttatagaaacgtgtggttttaaaactaacagttaagaggaagagaacagagctaggatccaactttcctgaattcactaggttttcctgtacacggtatgtttcaacataaacattaattcaaagaaaagaaattccctttgaccccattcaaaattcttcagaccacagacccttattgatccccagaacttcctacaactcataattatgctaataaagtaatgaatattaaataactgaaggctgaggggtggagtaattgaggggcaggaccataagtatgttttagtaaaaatttgcatacttgcattggtaatttttaaaattatttttgaatatgaattatagaaacatttctagtatagccagaacaaatgtgtgtgtgcatgtgtgtacttgcctgtacatgtgttcatgtatgtgtgtatgggtgtctatgtgtattttgtgtttaacacatgttagaataataagggtcagagcaaaggtattaaatatctcttattttttactctaaaatgtagagaaagtgattataggtagcttttctcatctagtcatttggagaaaaccttttacaatttacttaaaactttttcaattttcatctcttgctgaaagatactaagagcacttataaaatagaagttacccagtttagcacatttgttttcagaagggtttcttaacttggggtccagaggtagggctagggtttttgtaagcttcctgaaattagaagcaaaaacattttctgttgctttttgtggtgtagagggacgatatagagctttcactaaagtctcaaagaggtccaagtttcatctctttccttcaataggttaaggagcattggcttaaaaaataggaggtggaccttccaaattagcatgatgccaaatgactgcttcaaagtgatacacataattgttttctaaaagtttattttccttgtgtgagttttcagccatttgctatgtttatatttaacaatatgaagccacactggaagcactgtctcaagatttatttcagtaaataattacttggcaagtaattccttactcaaagacaatagttgttaaattctctcaatcccactaaagagtttataaaagtacaacacaaatatacagtataggggttttgttaaaacttctcatgtgatctaacttttatctcattaagaaaacagttaatatatagttttagaaatagctgttgtagctttccagctggtgacatgtggtgctggcattgatctgacttgaggcatcatgctgccagttcacagaatggccagaactggggcttagcactcttcaattctggccaagtgggctcctgctagatctttgtttctgtgtcagcacattttagaatttttgtaacatgaaggccttagtccctcccctgttgctggatacaattgccaactaatcacctcagcaatgaaaacacatggaccaatagagggcacactttgcattcttttccctgtgctttgttctctgaaattttgtgggatttgtgcttcctttgctttgccctattggttcaggggcgaaacctgctctgctccccccatggacactgtggtcatcttgatgtcatcacagagagaacaaaggaacaaataaaaagaactttcagtcttactgagcatttcttgttttgatcgctaatctccttttgacaagacctcaccaagaggcaaactgaaccaacctcactgttttagtatctgtgagacacagatgtgaaagctacagatttaattaacatgcaggtagattccagcttctacagccactttgaaaaacatcagtgggttttattttattttttaaattcagatgttttacataagatgaatgccctaaaatgtaagcaactggtgaaatttggagttgcccaaatgactgcaaattaatacttcccaattaattgtttttcgaattctttaatctttatagagagacctatttatttcgatgcttctctcatactttggccctttgagaattgtaaaaattgtctaatattctgaaaatccaaagttgttgttgttatttttttgagactgagtctcgctctgtcccagccaaagtatttttaagttcttattccccctcgtgtaataaagtatgacttggggctgaaaaattctctggcatcggccgggcgcggtggcttatgcctgtaatcccagcactttgggaggccgaggcgggcggatcacgaggtcaggagatcgagactatcctggctaacatggtgaaaccccgtctctactaaaaatacaaaaaaaaaaaaaaaaaaattagccgggcttggtggcgggtgcctgtagttccagctactcaggaggctgaggcaggagaatggcgtgaacccgggaggcggagtttgcagtgggccgagatcgcaccactgcactccagcctgggtgacagagcgagactctgtctcaaaaaaaaaaaaaaaaaaaaaaaagttctctgccatctcattgtttttcacctcacatgctatgttctcatgcctcttcctggtagtcaaaagcaggcttttaatgttgaatgatctgcgctgtgtcatcattaaacttcatgtttagttattcactctttttctcctccaagattttgaagacttactttaccctgttgattcagctggcagacctcctctgcaatccccatgaagtttaaccgaatcataggagattaatatcctatgaccaaatgacatatcatctgctcacccccaaaaatataactctttgggggtaactatggtatctgtcattccctgctcttttactgtcatagatggtctttaaaaactctgccctggatgagacaccttgctggtctagtgtattgggaagagttgttcctgcagctcccatgttaccatacctaaacagacattaaaagaagggaatcctggtctttgacttgtcatgtcttctgggtagttctagtaggtggaagaacgtctacaagaacttatgtttattttgatacttgcttcttgatgacgttctagaggttcactttcttcagatgtgtgtgtgtttaagggaattttgagaaactcttgcttgttagttctgggctcttctaaggagatatgaggaagtgggggagaatagctgtaggttgggtaactggaatgaagaaactagcttaatattttttacttatccaaggacttcagaaaaatcagagctgtcctatccatagcattccttccactgatgaaagatatcttgtggccgccctccttcacccagcatagtgcaattgagaaactttgttagggtcaagaaactacgtaatttgaaaaaccactggtgtctgataaatgtacagcagtcgttcccagaagcactattagtgggttgaggttagtttgttgtggtgatagagaagccatttgcaccactcctggtggtcagtaagttacatcagcagtggctgatatgattcttgactgaatcctgtcaattatgaaagttcttttttcccctcatttaaataatattaccctgaaaattgatctagagctttggaaactaccccttgaaaactgattccccaaatcataagtttagtgtaatttaattgttctctatgcagaggggaattagttctttgcagctactatgggtgatctcaacatgatttttatttgaaagtgactcagatgaataactgttcaggaggcttggcaagcttctgcatatcaagcagtcgttttttgttgttgttgaattcagagagaaaagtttaagaaatgtgacaggctggacctagggaaaggaaagagcaggaacaagaccatttcctcaaacttgaggtcgatcatgtgaaaaacgaatgtgatttatttttggaattaaagaaaaaagtattttatgaagaggaagattaaagtttatatttagaaaattatccactaatggaagagacccttctttggaattttgactttggaagctgcctctttccaacagcagagagcatctcgtgagagtgttttaaagctggtgacttgacaacactctcaagagtgaactctaaggacctttcacactgtaagagccaccccacagccatctgtaatgcatgtggtatctaataggtagttaaatataaagtcttgttgacagctgcttgaactcaaaatacaagactcttgccttcctgaagagaggacactaaacaaaactactttaagagatggggtcttctttgggaggccgaggcgggtggatcatgaggtcaggagatcgagaccatcctggctaacaaggtgaaaccccgtctctactaaaaatacaaaaaattagccgggcgcggtggcgggcacctgtagtcccagctacttgggaggctgaggcaggagaatggcgtgaacccgggaagcggagcttgcagtgagccgagattgcgccactgcagtccgcagtccggcctgggcgacagagcgagactctgtctcaaaaaaaaaaaaaaaaaaaaaaaaagagatggggtcttgctgtgttgcccaggctgggctcaagcgatcctcccaccttagcttcctgagtagctgagatgacaggcatgtgccacgactctcagctaaaattgcttcttgagattccgcaccatatgcttctgcatcattgttgtaaacttcagtaatatgctagatattgacattcaatatgaatttctaaaagaaggtgtatacctcaattcttacatgaccatgatgctaatttgtaggatgtttcattataagaaactttgagatttcaatatgactataatcagcatgggttataccatacagatattttgctttctttaatgggttgctagactggaagacaagtattagacaaaattttattaatactatctggcacacctatgaaggcataataggcttaaaaacccgttcagacaaggtagagaaatgcaagtatatcatcttaagttactttcgtgagttacatttggtagagagtggtgagtaatggattgatgtctactctgtgggaatcctgggtatacagaaggaacctgtcttcagccttgtctgaaacaatattttcttaatgatttcattgaagacaggtggtaggctaaccacacttttgcataatatgaagttgaacaggacatttaggatgtgggatgactggttacaaaaagatctcaatggctaggaatgacaggatgaatttacaaatgaaatcttaatcagaaacatgtagagtttactctttaaaatgaaagaacttgccgggcgtagtggctcacacctgtaatcccagcactgtgggaggccgaggcgggcagatcacaaagtcaagagattgcgaccatcctggccaacatggtgaaaccctgtctctgctaaaaatacaaaaattagctgggtggggtggtgcatgcctgtagtcctagctactcgggaggctgaggcaggagaatcacttgaacccgggaggcggaggatgaagcaagctgagattgtgccactgcactccagtctgggcaacagagcgagactctgtgagtgtgtgtgtgtgtgtgtgtgtgtgtgttcacacatacatgcaccaacaatggaagaataggatgtcggacacaaggttttctcattgatttttgacttactctgaggttataatgtaatgtaattgcaaaaagaattggttgcattaagagaaatatttacctagattcaagaataaaccagatgaaggctcttagcctatcttatattcttttctagagtcattactttaagaaatgcattggcagcacacattattatacagtattaatttcctaggactgctgtgacaaagtactacaaactggatggtgtgaaacagcagaaatatcttttctcaccatctggaggctaaaagtccaaaatcaagatgcaaggaggttcatgctctctctgagactctaggggaggagacttccttgtttcttccagcctctggtagcctcaggtgttccttgacttgtaacagtagaattccaatctctgcttctatgttcacatggctgtcttacctctgggtttatttcttttgtcagaaaaccagttctattagattagggctcaccttaataacctaatgttaacttgattacatctgcaaaaaccctatttgcaaataaggccacattcacaggcactgagaattaggacttcaacatatcttctttgagtacacaatgcaacccataacaaataccctttgcatcatacccggtagtcttttaaatccttattttcataacaaccctgtggaatattgttaattataccataatattattagtataacaagtagtggttatagaagtggaatacttagtagaggtaggatcactgcatatagctacagagtgtatattggacataaagcaagaatattaatggcaccccctggacttgtgcataccatggccctgagggtgggaatgctttagacatggtttataagtgtacggtgtttggagtatgtaacctcaagttcctttctgcctctaaagttgtgtgaaactacacaaactcagagtcacctctttattacttattacaacatctttattactttttcaaacaaatctgtacatcaacttggcttcttgctgttcatctctatcagctgaagctgaacattcagtttagctgttttttttttgtttgtttttgagacggagtctcactctgtcacccaggctgcagtgcaatggcgtggtctcagctcactgcaacctctgcctcccaggttcaagtgattctcccgcctcagcctcctgagtagctgggactacaggtatgtgccaccacacctggctaatttttgtatttttagtagagacagggctggtctcaaactcctgacctttgtgatctgcctgcctcggcctcccaaaatgctgggattacaggtgtgagccaccgtgcctggccttagctgtttttattgaagaagttagctgtcctctaagagctgctagtgctctttatggagcattagtgaaatctcaatattgcctactatacatggcttctggtggtagagtgtcttaaactagtcttctctgattttgaatagtgtcaaatgctggcactgccaaggggcttgatctattcatgcttgtgtgttgcatataaagggctagtaagaacattcttttaaagctattgtgaaatttttgaaacataaaaaagtaatgtgatgaatccctacatatgcctcacccagactgaacaaatattgacattttgccacactgactttatttattctttattttctgttttactttgtattggctgaaatgttgtaaagaaaatcgcagatattacatcatttcaccctacatatttctgagtgtatttcttacaaatagagattttctttccaaaattcaatgtcattaatctacctgacaaaattcgttatttcttgatagcacctcttaataatcggtatgtaatggatttccccaattgcctcaaaaatgtctttatacagtggctatgcttgaatcagcattgaaataacacccactcattgcacttggtgggtatgtacctaaagtttctttgattctagggtattacttccttcccactcagttttcaatgccattgacttattgaaaaagaaaagtcaattttctgcagaatatctcacatctttccatgtgttctcctcttggggttgtttaacttgttcctcaatcttccacaatttctgtgaactagaagttctccttgaaggttggattagattcaggttcaacttttttggctggaacactgtgtaggtgatactgagtgcttcatattacatcacaccaggaggcacacaatgtctcgttgtgccattcttagtcatgctgagattaaccagtgggttcatgtggtaccagcccaatcaccctccattttaatatttgtctgaattaacagtttcattaggggttgcaaaatagtgatttttttttctaattcttaccacatttattagctgaaaattttctattaaaaactgttcctttttcagctatagatatttttgtactatgaaacacaattcttccaggtaaagcagatgataagcttattttcttccattttaattgcaggttcttagaaaagagagttgatacgtgtttagctgggacagtgggtgagcttcatgtaagtgaataaagtgctttgatttgtgtcaagccattccttgtcagatggaggagaagtcttccaacagtttctgcttactgcaacagcagtagtaaaatgacattaaaaaaaaagacttgttggtttttgctaacaggaatgaaatgcaaaccttctggaaacctgaattcaattagacatcttctgataatgttttctgttaatagctttcagagaagctactgagttgaacatacagtagcttcagtatggtgtaatctgaggctcattggatggaaaaacagtactttctgctactttaaacactctctggaaggcttagagaggagaggaaggaaaatatttgaggagatcaactggatgttgtagaatacaagtaatgtcacctgagaaggattaagttttctcaaagcttgtcttgaatggcagctagccacttagatttggcccttgtaacccatcaggcttgtctgtttctgtgcactcttgtcttttctttttctttttctttttttcttttttttgagatggagttttgctctttgtagcccaggctgaagtgcaatggcacgatctctgctcactgtaacctctgcctcctgggttcaagtgattctcctgcctcagcctcccaagaagctgggattacaggcacccaccaccatgcccagctaatttttgtatttttagtagagatggggtttcaccatgttggccaggctggtctggaactactgatctcaggtgatccgcccaccttggcctcccaaagtgctgggattacagatgtgagctaccacgcccagcctgctgtgcagtctttaacttaacatataaagaaggggcctagagattacatgtcttctgtgggcaggggacagtaaagttttttttttttttttattccttctgcttattaggtgcagctggctctttctaattacagaaacctttcctttattcatttaaaaacttagctcattgctttgaatcattactattggcatagtttttgtatgacctgttgaaagatacccataatatgtacatttaacagttttactatccagtgaagtcaaaaatttaattcacacgaatgcctattgagaggattaaagggctcattatacattttggccataagtattatgaatatacaatatttaatacgtggctcgtaaaactcttgctggagtaagacaacactggaggtgtgtgcttttcttactagtaaagtgccttcgtagtactcttctttttttttttttttttcaatttctgagatacatgtgcagaatgtacaggtttgttacataggtatacatgtgccacgtggtttgctgcacctattaacacgtcatctaggtattgtagtactcttttttttttaacttatactttaaattctagggtacatgtgcacaatgcgcaggttcgttacatatgtatacataggccatgttggtgtgctgcacccattaactcatcatttacattaggtatatatcctaatgctatccctcccccttctccccaccccacaacaggccccggtgtgtgatgttccccatcctgtgtccaagtgttctaattgttcagttcccaactatgagtgagaacatggggtgttcggctttgtccctgtgatagtttgttgagaatgatggtttccagcttcatccatgtccctacaaaggacatgtactcatccttgtttatggctgcatagtattccatggtgtatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttctggcttgtagaggttcttttgagagatccgctgttagtctgatgggcttccctttgagggtaacccgacctttctctctggctgcccttaacattttttccttcatttcaactttggtgaatctgacaattacgtgtcttggagttgctctcctcaaggggtatctttgtggcgttctctgtatttcctgaatttgaatgttggcctgccttgctagattggggaagttctcctggataatatcctgcagagtgttttccaacttggttccattctccccatcactttcaggtacaccaatcggacgtagatttggtcttttcacatagtcccatatttcttggaggctttgtttgtttcttttcactctttttttctctaaacttctcttctcgcttcatttcattcatttcatcttcaatcactgataccctttttccagttgatcgaattggctactgaagcttttgcattcatcatgtagttctcctgccatgtttttcagctccatcaggtcatttaaggacttctctatgttgattattctagttttccattcgtctaatcttttttcaaggtttttagcttctttgtgatgggttcgaacttcctcctttagcttggagaagtttgatcgtctgaagccttcttctctcaactcgtcaaagtcattctccatccagctttgttccattgctggggaggagctgtgttcctcagttggaaatgcagaaatcacccatcttctgctccgaccatgctgggagctgtagactggagctgttcctatttggccatcttggaaccaccccctggtattgtagtactctttttttttaattttattttattagtattatactttaagttttagggtacatgtgcacaatgtgcaggtttgttacatatgtatacatgtgccatgctggtgtgctgcacccattaacttgtcattgagcattaggtatatctcctaaacctatccctcccccctccccccaccccacaacaatcgccagagtgtgatgttccccttcctgtgtccatgtgttctcattgttcaattcccacctatgagtgagaacatgcagtgtttggttttttgttcttgtgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatatgtgtgcatgtgtctttatagcagcgtgatttatagtcctttgcgtatatacccagtaatgggatggctgggtcaaatggtatttctagttctagatccctgaggaatcgccacactgacttccacaatggttgaactagtttacagtcccaccaacagtgtaaaattgtccctatttctccacatcctctccagcacctgttgtttcctgactttttaatgattgccattctaaatggtatgagatggtatctcattgtggttttgatttgcatttctctgatggccagtgatggtgagcatttttttcatgtttttttttggctgcataaatgtcttcttttgagaagtgtctgttcatgtcctttgcccactttttgatggggttgtttatttttttcttgtaaatttgtttgagttcattgtagattctggatattagccctttgtcagatgagtaggttgcaaaaattttctcccattttgtaggttgcctgtttcactctgatggtaatttcttttgctgtgcagaagctcttgagtttaattagatcccatttgtcaattttgtcttttgttgccattggttttggtgttttagacatgaagtccttgcccatgcctatgtcctgaatggtaatgcctaggttttcttctagggtttttatggttttaggtctaatgtttaagtacttaatccatcttgaattaatttttatataaggtgtaaggaagggatccggtttcagctttctacatatagctagccagttttcccagcaccatttattaaatagggaatcctttccccattgcttgtttttctcaggtttgtgaaagatcagatagttgtaaatatgtggcattatttctgagggctctgttctgttccattgatctatatctctgttttggtaccagtaccatgctgttttggttactgtagccttgtagtatggtttgaagtcaggtagtgtgatgcctccagctttgttcttttggcttaggattgacttggcgatgcaggctcttttttggttccatatgaactttaaagtagttttttccaattctgtgaagaaagtcattggtagcttgatgggatagcattgaatctataaattaccttgggcagtatggccattttcatgatattgattcttcctacccatgagtatggaatgttcttccatttgtttgtatcctcttttatttcattgagcagtggtttgtagttctccttgaagaggtccttcatgtcccttgtaaattggattcctaggtattttattttctttgaagcaattgtgaatgggagttcactcatgatttggctctgtttgtctgttattggtgtataagaatgcttgtgatttttgctaaaagctctcaatatattaggtattgatgggatgtatctcaataagagctatctatgacacacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggttttcaattaggaaaagaggaagtcaaattgtccctgtttgcagatgacatgattgtatatctagaaaaccccattgtctcagtccaaaatctccttaagctgataagcaacttcagcaaaactcaggatacaaaatcaatgtagtactcttaaaagaacaaacagtattgcaaactgaagaaactggttatattgcaagtcagggaatagaactaggaatacacatagcttttacaaatgaaaagattcttgggattttttttctcttctacctgtttagtgtttttaagtaagaaaataaatgatctgtatccactatttggggtcagccattgatgtcatttatatgcctcctgctttttaaaatttgaattttgaatgttattttggtaataaccccctgcatagttgagacatttaggtgtttgtcttggaagcaggtagtaaagactttacactgtccttgtataaatagttgattttttttatagccacttactgtagttctttaaaaatgaatataagcccaaaatctattcattgttggcaatttgaaaaatagagaacaacactatgaagaaaatacaactaccaataacctttctactcagtggctgctgttaacattttgcattttatccttccagatgtttttcccttctacataaatataaagttttgaaagtgcctgtgtcataagtatatattcttactgattttgatgacatttagaatgtctgcatcataattgttcaacatcaaattttaaaatcagtttccttattgttgggcagttaaccatttcagtattaaaaagttttcaagattattaatatgctatcaataaccttatattttatacatcttttttttttttttttttttttttgagacagagtctcactctgttgccaggctggagtgcagtggtgtgatctcgactcactgaaacctccacctcccaggttcaagagattctcctgcctcagcctcctgagtagctgggattacgggcatgtgccaccatgcccggctaatttttgtattttttggtagagatggggtttcaccatgttggccaggttggtctcaaactcctgacctcaagtgatccaccccccttggcctcccaaagtgctaggattacaggcttgagccaccatgcctggcccacatcttttttatcttaggaatcatttatggaactagaaataccagttaatacactataatcacttattgagcatttactatgtgccaggcatagtgttggttttcttttttctttttcttttcttttcttttttttttttttttttttgagacgggtctggctctgtgtcacccaggctggagtgcagtggtgccatcttggttcactgcagccttgacctcttgggctcaagtgatcctctcacctcagcctcccaagtagccgggaccacagatgtgtaccaccaggcctgcctatttttttttgtatatttttatagagatggggttttgccatgttgcccaggctggtgtcaaactcctgagctcaagcgatctgcctgctttggcctcccaaagtgctgggattacaggtgtgagtcactatgcttacaagattgggcccaagcgtaggttttgttgttgttgttgttgcctttttaaagaacacacatacttattagcttacagcatctgtggagcataagactccgggcatagcctaaggtaacttctctgctgcaggatctcatttgattataaatgtccaataatacaaatttcatgtttcagtggtgagactgtagtcaagaaaaaaccaattcccctataatacataatctctgcaggcaagcatagtttttaaggttacatattatttaatcctcaaatgaccttgtgaggtagacctatttttctctccatcttaaagatgaatctgagggaccagagggtgaatggtttgtctaagttcagagctaataagtgatggaactagaattctatctaggcattctgacccagccatgctcttaaccacgagatggaaatgtgaagctgtcaatctcactgccagttgttctccaggatattgtactaattataattctgtaggtgggagatgttgggcatattgccttgagccattgataattttttttttaacgtcttgttggcctgttcctgttgtggataaaaataaacatctcccttatccccaagaaatttagtatttaaatagggaaacaatgcattctttcccacatttcctggctccaaataacattaatatctacttagttgcttaaatagtccttgttttctcctcaacacccattatttttacaccctcttttcagtatgttttgaactccttttcttctaagtcggctgccattttgtaggccaggatgtcaccatcttccgaacctgtccatggccttcccactgatctttctgtgatccattctccttaggacagccaagaattgcttataaaatgaaaatcagcaattctcccccccatttaaatgcttcagtggatttctattacacctcaaataaaacaaactcctcgcctagcctggaagcctctctgtgacctgtctgcctctgcctcctccaactctcctttcattatctcagtcctattgggcttctttctgtctctcatacactcttgacttcctcctgtctcattacctttgcatttgctgttcactctgtctagaaagctctttactcgtgtttttcacaactagcttgatcctttcacagtaactgtatctaaagcagcacatttttattttctgttttcttttctttttcttttgatacaaggtcttgctctgtcacccaggctggagtgcagtggtgcgatctcagctcactgtagcctcgacctcctgggctcaagcgatcctcccacctcagccccctgagtagctgggactacaggcacgcaccaccacacccggctaatcgttgttttgttttgttttgttagagacagggttttgctttgttgcccaggcttgtcttgaactcctgagctcaagcgatctgcccaccccagccttccaaagtgctgggattagaggcacgagccaccctgcccagcccttttccgttttctgtagtaaactatgaggaccaggactagggtgcggcaagagggggccttagggcacaaaatggaaggcgtatgcttgccagcctgagaaccagtgcctccttgcattttacatgctaggcgcctcacttattgtgccctacatctagctctgctctgttgtatccactgcttatttcttaaacactctagaattttctttgttcctgtggcagagaacactgtctatcaaaatccttttcttttgcctcttggggctgtcgctagactatgtttcccaacccctcgtggagttaggggtggctgtgggcctgagttttgactcatggaatgtgggtggaagtgatatatttactacttccaggcctggccccagtaaacctcctgtagaagagtctctcactctttgtgtgtctgccaccttggtgcaggggatctagccctttctctgagcctctgtaggatgatggggccaccagtgaaaagagcttgggtacctaaatgagtttgtcaaagtcttcctgctgcaaatctccactggaccctgcttgagcaagaaaggaagttttgtgtcaagtcactgagacattgaggtttgtccctctaagaagctagcactgtgtgccctcaccagtacaggctctcttatctccaccagagtttctgaacataagatccaaaagggtgagagccttgtttacattgtatcaccagtgcccaggagagtgtctgttgcaggtatccaataaataattttttcaacaaatgcatcatataaatactaacataaaaacaactcgagagagtgctgaaataatgatatacataggaaatacattcggggttcaaaggggaaggagcactgtggatttcaagaaaatggggacttgagttagcttattttaaattttctttggtagagacaggatctcgctctgctgcccaggctggggtgctaactcttaagtatatggtattcactgtatataaagtggttcttacgtttcttagccagtaatgttttgaaaacatattccaaaggcatagggcagtgatttcacaccaaaagtatagaattgtaataacttgtagattttttaggcttttaataggattttaatcacatattaagtcatgtcaaatcatttttatagttacatgcctataactagaaaatattaaatttcttccctttatttcttactatgtccagtatatttgaactcttattttaaaaatgtcttaattgatgtaacagagaagtaatgtctgcttttattatatagtgtaaatcattggctttttcaagattcactagattgctttgcttgcctagttatagaaacgttagatggggcttggttgcattccttctaggaatatctgtgggctctaaggagagggcattgtttgacattgaactgttgatgggaaggatttttggtcaagaggaaggatttccaactcttttaagaagagaatctgtttttaatttcttggaagccttgagattctaggtatggaggaagacaggccagaggagatgaacacttctgctgatgaagtttctgggtggatgggaatatggagtgcatcactgctaactgtgggtgccttttccccaagaagctctcctgcaagccatgtgaggacagattgtggagtggcagcaggtaaccgaggttgtactatctagcagatcaagatacactcagtcccccagttgagacctagaatacgtaaaatccaagacctttattcctactcatatcctgaagtcactggtaaaataataccctacctaggttagcactaacaactcttgactagctctgccacaaactgtatatatatatgtgtaagagagataacttaaaggcacctttttaccatgtttcctgcctatttaaaataaaagtttggactatatgatcccaagagccgttctaccaataaaattcatatttctattagtcatttggtccagatgttcacactgatttaaaaatcttccatctcttaattgttgtgtaatgttgatccgattatttcatatctctatacctcagttttcctgcttttaaaatgggagtaatagtagttatctagtttataattttgtcgtgagaattaattggatggtgtgtgccgagcccttggaacatggcaagtgtgcggtgaccattagctgctgctagttgaatttcccagttgcttactctgtggacattttcttgctcatatttgcttcccataacaggttattaataaattctccatgctttggaaagattccctgaaacactttaaaattcattctaattccagtgaattactaaagtaatacttctaaaatatataggaatttgagaaaaggtacaattttatcaacattgataaacaatatattaagtattaataaagcatatattgatcatgattctggggaatacatccctgttggaagtctgtgtcaaaatcataggtaagtttgagtttctcacaagaacgagcttttacttttaaactggctgcttctggtgaagaatagaaaatgtgcgtgtacacagaggccaaattttgctagctaaggtacaaaatatacttataaaaagtaatcagttcatagaaacatgcaaatctagatctctaagtctgcatatatttaatttcctggctttctatatgatccagtttctgtatgatctagcttgatataagtaggtttgtttcactgggagaatgagtcattttagagatactccaccagctgaaaaagctaaatgttttcatagttattatcatagcattttcactacttaaatatacatacaaaccaatataacacgtgcattgctcagtttggtgcaagttaccaatgaactaggatggaaatgcccctgcctccaccaccctccaacccatgccaaaccccttaagaaacaaatttacttaaccctggttgtgcatgtgatttgagttctttggtgatagtttaattgaaagtgcagacttcagagaccagtcttgagctggagtcccagatgggagtcagctctcatcatgactatagtcttggaatatttctgggcctcatgttgaaggaatggatctgagtattggatttatactacctctcctgtttctgaatattcactgtctgtgtttatttactggaatggtattcagtaccatttagatgctccacttgtcctttcacaatgtgttatatcccagttctgataagaccctgagtcttctgccctgctctcaaaccattcacgcattgctatttttattgcttaggcctttaggtaattggtagtgttcttaacatttcttttagatgatttgacttccagtctacacatcttctgacactgcagaaagcagccagttccaaagaaaacattttttgtagccgttttttccccctgctggtggaactgcaaaacctcaaaccttcactatgccaaatttggagtcttggttgctaccccttcctctcccctccagctacctttgtcatgttcagtctcaacttggtgactgccagtggcacacattctagattattttatagtaataagcatcctatattaacatttagatgaacttttaaaaagtcaactacttttattccctcccttacaatttcaattagtttttctctttcttcaccaaatttattaattttgaagttaaagggtacagtggggctagagaagattttgctcattgcttaaagccctgcagtgttcttcagctcttgcatacatccttacacatggttttgattttatggtataagagggtttttcacttcttgactcatttgtggcatgttgctgtagccatcactgtaattaatctcctaggaagaaatctgaaggttcaagtcaattaaaaaaagtgaacccaggaacaagtagcttagcaacatttccccccaacccagaggattcttttgtccttggagttggaggtagtctttctctctgatcttgaagagcatattcggccacttctttccctgcctcaccctccccactaccaacgtggagggtggtgagagggagccagagttcaggtcctgttcaacatttgctagatagtggcagccgttttccctgcagactgtttcagttatccatgcttgcaacttatttctttgctttgttcattccaaatgggattttattaatgccaccttgcctccttttgttacttcaaaattaaaagtgaggttttcttttttttaaactggaaataaccaggaacatagaatagtaaaataaaaatctacatacttatggtctagaataaaaaaattaatatatttccatatttactttatcaatctatatatacatacctttattacttatttttaacaggtaaactatagatatttagaatgatcctatgaaagaaacaggagattattcaaaatcataaatctcactcttgcacaaactcttctaaaattaagcattgttataattaaccgatccatacctcaaatccaaaatcttatgaaaaccaatattccagcaacttactttcattgggaggctttttctaggactgtggaaaatctgaaaatgcaataggtataaaacaaatagatcttagaaacaaaagtggtttgaaggatactgaaggtttcctaatgttgacttaattatagtagaaaaagtacaacagtgagtgatctgtgattccccccaacccctcctgcatgagattatggaattatatacataatagagagaatttaagttttataattccaagcttagggtacaaaagaaacaggatggaaatagttttggggggttctttctaaatgttaggattttaaaggtacagtaaagcctaagatatatgtaactctatagaatgtgtcatttgcccaaaggattataaatcattctgtaaagacacatgcagttgtatgtttattgcagcactgtttacaatagcaaagacttggaaccaacccacatgcccattaatgacagactggataaagaaaatgtggcacatatacaccatggaatactatgtagccataaaaaagaatgagttcatgtcctttgcagggacatggatgaacctggaaaccatcattctcagcaaattaacacaggaacagaaaaccaaacaccgcatgttctcacccataagtgggagttgaataatgagaacacatggacacaggaaggggggaacatcacatactggggcctgtcagtgtgggggcaaggggagggagagcatgaggacaaatacctaatgcctgcggggcttaaaacctagataatgggttaataggtgcagcaaaccaccatggcacatgtagacctatgtaacaaacctgcatgttctgcacatgtatcccagaatctaaagtaatttttttttaaaaaagatgcatgtattctttaaaaaaagaaaaaaaagtcccagccaaaaaacaagggtcattttggaaagctaagattccaggtagatgaaaatgaatatatcgtgtggttgggctgatgttattttatttattttattcttttattatactttaagttctagggtacatgtgcagaacgtgcaggtttgatacataggtatacgtgtgccatgttggtttgctgcacccatcaactcatcatttacattaggtatttctcctaatgctatccgtcccccagttccccaccctccgacaggcctcagaagtaaagtacttctcagcaaatgtaaaagaacagaaatcacaacaaactgtctctcagaccacagtgcaatcaaattagaactcaggattaagaaattcactcaaaaccacacaactacacggaaactgaacaacttgctcctgaatgactactggctaaacaacgaaatgaaggcagaaataaagatgttctttgaaaccaatgggaacaaagacacaatgtaccagaatctctgggacacatttaaagcagtgagtagagggaaatttgtagcactaaatacccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaacccttcaaaaaatcagtgaatccaggagcgggttttttgaaaagatcaacaaaattgatagaccgctaacaagactaaaaagaaaagagagaagaatcaaatagacacaataaaaaatgataaaggagatatcgccaccaatcccacagaaaatgaatattttaagtgttggaactttaagaaacacatcaattttcttaacattactaaagtgctatggttttaatacatgagggtaagaatcacgagattactttgtgactttgttctatctagttgcagctataatgctattgtgcaacttagtgagggatgcaaagggcagtagaggttgacagcttagctccactcccccttgtcagtgttctggagttggctttcttaaaagtcccccatgactttcttataagctgatgtgaaacacataatgagaggcaaggtgcttattggatagcatcctaggtcacagctgtgtgtctttaggaagttgctcaacctctcttggccttaattttccaacctgctaaatgaaggcgagtagtatctacctccttaggataattgtgaggattcaatagcaatacctaagaagcacacggcatagtacttagcacataataaaggcaaaaagttctgttaattatcttctgcaggattatttaacataatttgttctctaaagaatagagaaaaattatttgtgtcaatctcttaacctgccccattacctcgaatgaatattatagacacagtaggatcacaggctgctgctgctgcttttttttttttttctccctgagccggagtcttgctctctcacccatgctggagtgcagtggcatgatcttggttcactgcaacctctgcctcccgggttcaagcaattctcctgcctcagcctcccaaatagctgggactacaggtatgtgccaccatgtctggctaatgtttttgatatttttaatagagacggggtttcactatgttggtcagggtggtctcgaactcctgacctcaaatggtccacctgccttggcctccaaaagtgctgggattacaggcatgagccaccatgcctgaccacaggcttccaaaaggcatccacttcaattgaatgaatagaagcactgctcagcagcctttcaagaattttcctgagcatctctttctacaactttaattttgttaaaaaataattttcctaaggtattttgaagagcatatatggtcaagtgtgccaattcttcatcattatcacaagatagcacttctttcaagacatgaagtcacaaaatccccagagtttccttgcatatactaggcatggcctctgacatatgaaggattaagaattgcttaaatatgtgtaacaggattgaaagctttgagtaatgtcttctgttacatgattaaatgttgcattcactaataatacttcatatcctggataatactgataacaagtattataatgaagagcaggaaggtgataaaaatattaccaattgctcgtcctgcatctttggagtgaccactggcaaggaaatggctttctggcagctcagccctgcttaccactcatgcctctacgtgctactttctgcttctgactcatggagcttctaggctcatttttatgattttctcctttctctctctttaacctttcttgactttttcccacttcagatacttggaatcaactattgtccttgggaatgattactatatatatttattttttcagttatatcttctgactgggtaaaaggtgttttgcctgcacaactgaatggtttattttatttgtagaaaacctgtactgtgaattgcccttaacaattgtgttgggagggggaattaatagggtgaatatttaaattcttgtttatttcatgtgtaacttggcaaaattgcataccctgatatgacttgaattatagacttgaagcatgcactgtttcaaaccacgggtgtgcctgtgtagttaatagagcagttttttttgtttgtttgtttgcaaatgatgcttttgtttcaaggtgcccaatttcagcccaagaaaaaagtttgcatagcctgatatgttacaagattattctttccctaaacgaatggtttaagaaaatggtcagtgaccattttctttgctagtcttagttctctttatttttcccctttatatcatatcatattcacatcttaatggtttagtctaccactgaatacataattttctttctaatcttttgaatagtctaaaagaagtacttgttaaatgtttcatggtgtatgtggtgtgagaaaaatctataattgttcttgatttggacatttcacaaggcaatcaaaccccagatattataagccaagataaatgacagcacattttatctttgcatttgtgaaatcttattacactgttctgcaaatgtataaacgttttcttttcataaagccgtaggcctaaattatagctgctcattaacaaatggtttccatactcggaaatgtgtgcgggcaagccttattcaagcagcagcagctatcatttgcattgtctggagtagtactgggtcatttagcatttaacaatacctgtcttggctttttggctctctaagaggtgtctcatgttttattgaatatttacttatgtatgcctgagatgtagagattctccaattcagtgaataaagttgacaaggtaaaaaggaaaagacctaaaaagtagctatgttttatattacacagtttaattccaaccatataggtggttggagatatattccggagtgtcgactctgtggcaggctgaatgcagtaaacagttagcaaattgttcacatgttttcccctgcaacacactaatgtaagtcttttcagatgtatgtatcagtataacatatacagacaagatggctatcttttaatgtccagaaaaggtgaacattactcagttaaccttgtgttgcagctacatatggctcagacatatctgccctcccaacaaaaatgttgtaatatttgtgagtttcagtatttgtggatagtgaatgaaacatacttctttatactcctgaatgtatcatattatataataaacagagaaaggaactaatgttctccgaatgtttgaattttgagcccaagtgtctaatacatggactaatgtattttaataaaaatggtctaataaaaacattaatgttatttcttgacctatacaggaattttgacttttgggtcatagccattctgactgatgtgagatggtatctctttgtggttttaatttatatttctctgatgatgagtgatagggagcattttttcatgttggccgcttatgtcttcttttgagaagtgtctgttcatatcctttgcccattttttaatggagttatttgttttttcttgttaaattgtttaagttcctcatagattctagatattaggcctttgtcagatatgttgtttgtgagtattttctcccattctgtaggctgtgtgtttactctgttgatagtgtctttttctctgcagaggctgtttagtttaattaggtcctactggtcaatttttgtttttattacaattgcttttgaggccttagtcataaattctttgccaaggctgatgtccagaacagtatttcctaggttcttcgaggattcttacagtttaaggtcttacatttaaagctttaatctatcttgagttaacttttgtatacggtgaaaggtagggggtccagtttcatccttctgcatatagctaaccagctatccagcatcatttatttagtagggaacgcttctacactgatgggagtgtaaattagtttagccactgtggaaagcagtttggagatttctcaaatagcttaaaacagaactatcatttgacccaacaatatcattaccacgtatatacccaaagaaaaataactacaaaaaagacacatgcacatgtatgttcattgcagcactgctcacaatagcaaagacatggaatcaatctagatgcccatcaatggtgaattgaataaagaaaatatggtacatatataccaggtaatactacacagccataaaaaggaataaaataatgtcctttgcaggaatatggacgcagctttaggctgttatcctatgcgagttaatgcagagacagaaaaccaaatactgcatgttcttacttaaaagtgagaatattgggtacacatggaaatgaagatgggactctgagagtgcacagagaggggggtaattgaaaaattacctgttgggtactatgctcactacctgtgtgatgggattatttgtaccccaaacatcagcatcatacaatatatgcatataacaaacctgcgtgtgtatcccctgaacataaaataattacaaaaaaacacaaaacctctccccagaaaagacttcttcccatcctgatcacttcctaaataaatgcacttagcttttcttttttttttttcagacaacagaatcagtgatattttgactgtaaacccactttaggtaggatagtggcataaccattgggacctaataagcttttcatggagcttggattcatagaacaaaaaatctattaagaccctactgggtatcaggcattgtgctagaagtgattagtattactattattatttataagccagtaaaaacattgcttttgtattgactttttttttaaaagtagaaaactgaggtttttaaaaacttatttctaaagctgagtttgataataattcctggtcattaagacaatgttttgcacaagtaactctttcatttcactgttcttgcctcccagagacttctttcctttcctcatccctgctcggacagccagaaccagcctgcagaacttttacattcctttgcttcttgcctggctatcacagttgtaaagttcagccaagttgccatgggtatctctttaattttctttcaaattaaacatggaatgagagaatgttggcatgcctcaggacgagaggtgctaagactatcttttttttttttccaagatacttttttcccccaaagtatatgagtaaaaaaatagaaccaaattaaccattctgtagcaacttagcaaaagagtagacacaattttaaaaataatttctcttttgttccttagtatgaaccaagtatgacttctttgacactgttagagaaataaaacagatgaaatgtaatcctttaccttgccagacccagaaagaccacaatggaggtctctatatgggcagaccagtgcctctcactgagttgttgttcctgcttttatctctctgaggcttgtactaaaaaacatgcaggattttaaagtgacaaaacattaacattctatgtaaacagagcaagtattttaatcaaaacaaacttcccgctacaaattgagtacacttacccttaaggtttaaaagccccatttatcaaggcacttgctgttccataattgctcttatcttccactcttcctcactcacaaactgcctgaggctgtttgcagtttcacagcctttatctgaggctatttaatgcctcttccccatccaatagtaatacaactgtttatttttgttgttttttttgtatactcaggatgttttagccgtgtcctttataagtgtttatttcatttgctccttgcaacagcagtatgtggttgatatggagtatgaagctcataggcaaggggttaaaggagcaaagatgtgaggtgagaagctcttacagctatcatgtgaaggaaggagggtctaaagctgggcctgactccaaacaaagcctttgattcccagtttcccagttttgtgctgcttgctcatctgccagtttcatgcatccttcatctgtgacccttcattgttgggccattgttgccccagccgtaaagccatactgcacttaccattagtgaatcctcctgaagcactcattggctccttacttctccaagctccccactttgtcatttgggttccctagctgtcagctatgttaatcacaaagttgcttcaattcttttttttacagctagttcatccatcttattgccattctaattaacttggcagttaatgagcacggcacgggtattgagctgtaatgagacttgggttgcaggtaatcatgactcttttctggaatcttcctcttgtgaagactgctcgtctcatatctccggatttccttgaagggaagggctgcttctcattactctgtagccctgcttagttgttatttcctactgtcattattggacagtctcctttgtagtctactgcattcattcatgctgtcttcccccacgttatcaccagtccacagacctttggggtcttccttcatgatcctcctttaacttcctcacccttagctcaatagggtttctttaaactcagcaccagtaggtaccatgtgggtgactcaggagagcttgtccttgattttcttttcttctcaattacctgacgaagtgaccttgagacccttcaatctctcaattctgaaatttgtgtctcctcttgaatacaatttacattgctgaactgttccttaccatcacttagatgcacttgttctttggccttgttgtaactacaggtccttgaatttcattctggttatttattatttttactatttttttaaacactgttagatattggtagacccaggattctaaatggacccatggtcatcttccaggctgccatctttattatcctactcccttcccctttgacctgttgtgatgccaaccccctgctgcctagggaggtttaatgtgctttttggtctcagttgggatttactctcctaggagcctctttttccatcattggttttggactctttattgcatttccccaatagtgactcttccaaatggttttctgtagtattgatctttattctatggtgtcttttatcactctgataacaaccctgtcacttaatttactaataagattaaagatgttcactgaaagcccactaatcttttctctcattcccaccacacttgcaatttgctgttggcataacccactgtcttcttaaaagctgctttattcatcaattcttctaaatttatttttttcttcctatttcagatgaaggtggggcctgttgcttttgctgttggtctcaatttctcttctaaaccttgttcttggatatgatctcttccatgtgtatcttctctcattccccagcaccatctgcttttttgttttcaaagagttttaggtattcttaatgtcatacattaaataaaaatgtcctttgactctacagcccttaaaacgcagcatatttgctcttaccattcttttctttgtccaattacttaagggagaaattattatcatcatagggctcttcttttttttttttttttttttgccactttttgttttagctctttctaaaatgttgtgaggagaaaaaacctgatttttgttcacatttcagggatctccttctcaattgcttaactttcaaatctctctagacaagccccgcattttcctttgatgctggaaagctcaatgtacttggccaactagtcctaaattgatttcttttctgtacaccctgccccagacaaaactaaacaaatgtaaaaacccatgtctccaaattactgttttgctcaacatttgaatttgctgttgatttgagtgatacctcagttcttttctacaggttggcaatttgacatcttcaaatattctgttttagacctccacaccccatctgttaccaacacctgctatgttttggttcatgaggaatcaaatccaccctttgccaaatttcacattatcagcactcctgcccagatcaatattttagccatgattattgcaaaagtctcgtaactaattttcctctgtatttgtcagcccccttcctccattagttttacacctcaaaccacattagtcatcatctgattactctttggtcatgttgttctcttgctcagattttggatcttttcagtgcctggaagatagttctcattttcagtgtgatatttcatgttctgcctggtctggacccaatctacaactttttttctgagaccatcggggatttactctgggcattggctgaacagcagcacttactattccgaagcctgccttgggttttttccccctgtaccttttgcgttcatgttttttttcttgtctaaagtgtctttctttctcttcatctcccttctgattttgaagtctagcctgtaagacccagtctagatgccttcagtggagaagttcatggattaaaaaagggattttcaatatttataacacactgtctgttaatgtagctattttaatgcctgtttatacaaccttctggttggttgcttttcgaggacttcaaccttatctattttcctatttctcagagccttctagaaatgggtgtttagtattatttttcttgattaaccccttgattatactatttattatttgacagtgagaaaggatgtctttattcaggctactataacaaagtaccatagactaggtggcttgtaagcagcagaaacttatttcttacaattctggaggcacaggagtccaaaattggggtgccagcatggtcattctctggtgagggacatcttggtttgtagactgccaacttctcattgtatcctcacatggcagaaagaccactaactaactctctggcctcttcttctaagggcactaatcccattcatgagagatctaccttcatgacctgatttacctaccttcagataccatcacattcggggttaggtcttaagaatgtgaacttaggggacacaagcatctggtctataacaaagcatacatgtgcttgacagctcagttgtcactgggatgctcctaaggttgatgggaagagacagagttgaggccagcctagagtggaggctggatgggtgggggcctgttcattatctggctttgttttcccttttgaaaggtaccttaagacaaaccacctttcaaatattgttttccttttttaaattcatatatatatttatgaaaatacactttaagcattcttttattctaagcactaaagccagattgcctgggttggaatcctggatttactacttagtagctgggtgacgttgggtaagatatggaattctctgtgcttcattttcaccccctgtataattgaactcataagatggttatgaatactaaatgagttaatacctctaaaacaagcattttaaacagtatggcatgtagtatattctcaattactgggaattaatattactattaagtagtgaggaattgctgcaagtaaaagggggaggtattagaacttgtaatttctaattagttttccagattattaaagtgttgtggtaatatatgaagatgagaatcactgatctaggaacctgtaaaatacagagcatagtgaaagagagaataaatggaaatgtcaggaaaaattattcaatctagccttgtgtttgttttgttgtcatatacactagaagactgatctactgatttaattatttaagccgttcaaaatgtggatactaatttgtgatgtctactagacacttagcaaagcatttatcaaataacttcctaggtactgataatataaatacaggcatacttcagagataatgtgggttgtgtttcagaccaccacagtaaagtgagtcacacaaatttttggtttcttcgtgcatatgtttacactgtgctgtagtctattaagtagccaatagccttatgtcgaaataaacaatgtacattctttaattaaaaagtactttattgctaaaaaaaaaaacccactaacaatcatctgagccttcactgaatcataatctgtttgctggtagagggtcttgctttgatgttgatggcagctgactgatcagtgtggtggttgctgaaggttggggtgctggtggcagtttttttaaaagaagacaacaatgtttgccacattgatggactcttcctttaatgaaatgtttatctgtagcattgtgttgctgtttgataatgtcttatccatagtagcatttcttttagaatcggagtcaatcctgtcaaaccttgccactgctttaattaatcaactacatttatgtaatattctaaatcatctgttgttgtttccgtgatgtttatagcattctcaccaggagtagattccatctcaagaaacactttctttgcttatccataagaagcaactcctcatccattcaagttttatcatgaaattgtagcaattcagtcacatcttcaggcttcacttctccatctagttctcttgccatttctaccatgtctgcaattactcactccactgaagttttgaacccctgaagttatacatgagggctggaatctacttaactcctgataatgttgatattttgaccttctcccatgaatcactaatgtttttaatggcgtctagaagggtgaaccctttcctggaggttttcaatttacttttcccagattcattagaggaatcactatatatggcagctgtagccttatgaaatatttattaaataataagacttgaaagttgaaattactccttgatccactggctacataatggatcttgtgttagcaggcatgaaaacattaatctccttgtacatctccatcagagctcttggttgacccaggtgcattgtcaatgagtagtaggtctcaacagcgggcttaaaaccttcagtaaaccatgctgtaaacaggtgtgctgtcatggaggttttgttattccacttatagagcacaggcagagtagagctagtataatttttaagggccataagattttcaaggtgtaaatgagcattggcctccacttcaaatcactggctgcattagcccctaacaagagagtcagcctgttctttgaagttagacattcacatctctctagctatgaaaatcctgggtggcatcttctcccagtagcaggctttttaatctacatttaaaaatctgttttttagtgtagccaccttcatttcttcattaaatcttctagacaacttgctgtagcttctacatcaatacttactgtttcactttgcactttcatgttatggagatgacttctttccttaaacctcatgaaccaacctctgctagcttcaaatttaacttctgcagcttcctcatctctctcagtctttgtagagttaaagagagttaggatcttgctctggattaggctttggcttaaaggaatgttctggctggtttattcttctatccagacttctaaaactttctccacatcggtaatatggctgtttcacctatctgtgttttcactagaatagcacttttaatgttcttcaagaacttttcctttgcattcacaacttgaggggcctagcttttgacctatcttggcttttaacatgccctgctcactaagcttaatcacgtctagttttttatttaaagtgagagatataggactcctcctcttgaatacttagaggccactgtagggttactaattgtcttaatttcaatattgttgtaccacagggcatagggaggcctgaggagagagtgagagagatggcaacagttagtggagcagtcagaacacacaacattgattggtcaagtttgccatcttatgtgggtgcagtttttggtgccccaaaacaattacaaaagtaacatcaaagatcactgaacacagatcaccataacagattaataataatgaaaaattttaaatattgcaagcattaccaaaatgtgacagaagaagggagctcatgctgttggaagaatggtgccaatagacttgacgtaaggttgccagaaaccttcaatatataaaacaacaaccttcctcccacctcacccccagcaagaatcctgcaatatctgtgaagcacaataaagtgaaatgcaagaaaatgagatatttttgtaacacgtggtctttgttttgggaatgttcaaacttgtgggacaaatgggtaaaggtatagctacagcctaacattgaaaagcgccatggccacaggcatcacacaggtctttatgatgtgccacaggcttccttgcctgaatgacagttcaggtcttgacagaaatggttgtcataggtgcagaaacttgaaagatggtcagttttgcagagggggcagagaggatcttttgctatatatgttagcatattttcagtaaaccatgctgtaaacagatgtgctgttatccaggctttgctgctccatttatagcacacaggcggaatagatttagcataattcttaagggatctaggatttttggaatggtaaataagcattggtttcatttaaagtcaccagctgcattcctaatgagggtcagcctgaagtggggtgttttttaggttttgggttttatttgcttaatatctctaaggatagcaaatcacctgtattagtttacctggcatgaaggaaatgcccattgctaattctaccaaattttcaaaaaaatactttggattttagaacaaactgaaaagttgctgtctaatacttggaggacagtatgcctagattcataagatgcctctgggtctctatctttgtaatatatttaccaaaatcatgaaaaatgtttttattagccagcatatagatagacttggtggttcccaaacctgaaaatggtgaaagtaacccagggagcatttggtgactcaagagcccagttcccaatccagcgaaactgaaacagtctcttctggggcaatctcagattctatgtctaggaatcaaaaatttaagaactggtgaggaattgcctgtaatcccagcactttgggaggccgaggcaggcagatcatgaggtcaggagatcgaaaccatcctggctaacacggtgaaaccccatctctactaaaaatacaaaaaaattagccgggcatggtggcgggtgcctgtagtcccagctactcgggaggctgaggcaggagaatggtgtgaacccaggaggtggagcttgcagtgagccaagatcgcgccactgcactccagcctgcgcaacagagcgagactccgtctcaaaacaaaaacaaaaacaaaaacaaacaaacaaaacaaaaaaacaaaacaaaaaaaagaactggtgaggaatcaacagtcactataaatttgtgctaccgatgtggtaactactaattgtgtctgtgttactatgaattcatacccaaaggtgagactaaacacagtaagaaaaccccccaaaaaaagagttgacgcacagtaggaagtctcaccaaattgttgacttgttcttacctggtggcttacttatactaagaaggagttttaagagacagtaattcaaagataatagtacaattcagaaaagcattctaaagctctattgctacttctagatactcaggtaatcttttggtctttctgttatattgtttccttggaaaaggattcaatctctctgttccccagctcttttttctcttcctactaaataagcaaaggtcaaaacttggaagatgtattttcctggaaagaacattcaatcgattttattagttaatataaaacatttatgtgttatgataggatggaaagcaaaacagtatttagggaaaacagttggtaatattgctcaaatcatgaagataataaagcttagcttctgtgtaggagtgcgactggtcacaggttatcacaagattaagtgttctgtgcgtgcacacccatcttttcttgatatttagtgcacttcacagactggccatttcacaatttgattatcacgtagctttgaccataaccagggcacagcaaaatctcctattttgatgctactgtggactcacaacttcttggctgggcctctgtaattgttattctgagtcttaaatagaagggccaaaacaggaattgagaattttattatgaaatatttcagtcaaaccacaaataggagatacctcctacacccataactcagattcaatgttttaaaatgtttttctgtatatgcttcatctgtcctctcccttttgtctcaggcaaagcattttaaagcaaatctctgatatcatgtactttatcctaacatacttccttctttatgtataaaatcttcttttacaaccacgatgccatcataacacttactataaaaattaacagtaattcctcagggtcactgaatacccaccgtaaccaaatttctcagactattccaaatatgtgtgtgtgtgtttaaaatagtttatttgaatcagaatcttaggtggggaaaaggatattttaaagacatatttaaagaacactttattccttatgtaattagaacaagtaaggaggggaaaaaaaacccccagaacctcatgggatttcttaaatattttgtagaaggaactaatactttctttcaattttctgtccttaggagcattatgatctatcccctgagaatgagcgatccgatgcactttttaaacaatgtaaaccacagtttctggtttaatgagagattacttttcacattgcattccatgtcagcacagatgccatgatttcatgttctaaagttagtcctgcaattactgttttgattgctcttagaaaaatgcacacaaagaatacagtgactcagcgaagggtgttgccagtgggttgtagtttttagttttcagatatgatggaattgcacaaagaatgtacaacttggtgttgcattttttctactccccatgcctttctttccacacatggccaccagcaccaagcatgcccagcctcctttccaagacattgaaaagagtctggaaaacacagtatacaagtaaattgtaaaaactccatagcaagagctgctttttaataagaagctctcagttctcttgtcatcacaaagacttgtaaggctatacttaaaaaatataattcagtgactccaaagaggtctacttttgaaaataaattgatgcccatatggcacctcagtctctggggtaattgaatatttttattcaaaatatgtgagaggacactctgacttgaaaaagacatggcacctgcctctcaggcatgcttatcttacacggagggatgaacacaggttatggagaagatcagtggcttagaggggaggaaggtagaatctgagaggccagctagatattcttacagtgattcaggcacaagttaattagcagctggactggggtcatggcattgggcaccaagaagagatgctagaaagctttagaaatatccgctcacattgatgacatactggaccttggagatgaaagaaggtggtggtgatcaataattttttgctgcagtatacaataagaaatgctagactgggcacggtggcttacacttgtaatatccacactttgagtggctgaggtgggtgaattgcttgaggccagaagttcgagaccagcttgggtaacatagcgagaccccgtatctacaaattttttttttttttttttttttttttctgagacagagtcttgctctgtcacccaggctagagtgcagtggtgcgatcttggctcactgcaagcttcgcctcccgggttcatgccattctcctgccttagcctcccaagtagctgggactacaggtgcctgccaccacacccggctaatttttagtagagatggggtttcaccatgttagccaggatggtctcgatctcctgaccttgtgatccgcctgcctcggcctcccaaagtaaaaaatttttaaaattagctagacatagtggtataatcctgtagacgtagctactcaggaggctgaggcaggaggactgcttgagcccaggagtttgaggctgcagtgagctatgatgacactactgtacttcagcctgggtgacagagtgaggccctacctcttaaaaaaggaaaaagaaaaaacaaaaaccctgcttattatgcttctgaaaagagacagtaggttggtagggggaggttgattttcatttattttaatatcttaattttgaagtaatagacaaggggaaataatatgtatctagggtatgtgactaggacacaaaatagaaactggaattattgatttggaagataagtaaagccatttatccatttattcatttatataactacattaatgtaccagaaactgtattaaggtgacagaaaaatttaagagtgtttgctatcaaggagttcatcatttagtgagaacaaagacaaatgaatggatccttggatagacaatctgggaactatatgtgttattaaatgtttatgtatagtgatttgtaaatttggtagactcaatagatgttttttctgaaacttcctttcctcttctctgctttccttttctattcttgttttcctattatttttcttttttaaaaatcttaactttatagtagaacaagtgtgcaagatgttatactgaagttgttgaatttaagaggcaggatagggtcagagcttgtatttggtctatatgcctgtggtccagccatagctgtagctgtagctacaatctgtaccaactgtgtgatgatgtattgggtgactaccttcctttccctctgccccctactgttctctgccaatctaagtcaccattgtagctggtgggacaactaattgtgttacaggtaaggtgtggggcatcaatcctattctattccttttctttttttttttcctcttcttttctgcttgtgctagaaatggagaaagctagtcactatatccaaaagattgcaaataacctctgcagattgatgcatctcctgttcaaggtcattttttccctccttcacttacagagagaaacaaatcagaaacaaagttcactaaccaaaatttcaaactttaacattcccagtgtcagtaaacattgtttttaatctattcatttttggttgatattaaatgttcagtgtatgaagttacggccttttaccgttttgttttttatgtaatctcacccaggtgatacttaatgcttacgtttatcttatcttgaaagagcttttgcaaacgtaaagttttagtcttttaaaaaatgaattgacagtctactttgtgagtttttcaaagtgcatgggatgtatagtatttttaatgattggtaataaccattacaattttttaaaaagttggtagcataataaggccatttagttacactacaagaaaggaaaactcataatggactccatgtgtttactcttacaacttcctgagtcacgttttctgcaccgtgtaatggtgatccattagagatgcaaaatctttgcaatcttttaagtacgctctttatagccactatttgaaggaagattaatctggtggtaggttcaagcctataacaccatgatttataaatagactggttcaaattatgcttgttccagtttagaaatgtaacttagatgcatatcctgtgagacacaagaataatttaaaaatggaattgatggaacctgaacaaaatcaatcaatgggagaaactttctctccctgcttgtataaagtagtcatcttgatccttaaagaatattaatccagtagtataatcatcagtggcaaaatattcgccatttttttcagggacctcggacagccttcagtgatttcaatgaatgtgaaatatgcttgataaaatgtatcctattgtaatactataccttctgaaggaagcaaactcagtcattaacagaaatataagaaaaggaacaatttcataaaatggaatggcttttcttatgagttttaattgggctttcttagagttctgattttcttcaactggctggattaggagtccctccctccacccctggacccactgacttcccacagatgcttggatacacctttatcatagcacttacccagcattttggttttattttcataggaatcctaagtgagtaaggcgtatttaagccagcagatggatgattaaaggatggtgtgtgttctatctctagttaatttccccagtaatttctgggcatcacatgcagtcaccacatggtagtcattatggctttcctcccttgcctgggcatccactagtcaatgtctgtggcccatgaagtcatttaggggagccccatcatggccactgcttatacattacagataccaggcaggcaagaccagagtctagcttctgaaatgtcccaagttgctactgtcagggccatgctggcttccagatagagtcagagacactggcacccttcgaaacttgaagctgtagtttggtcacatgaatgaatactgcttgggtttctccagcagagtgtgtcctcaaccagctcatccagctgcagtttctcatcctcctagattggaactgaaatcaaatccagagggcctggctaacatcatatgcctagcttttttttttttttttttttttttttcctatctatcccaggaccctactttcaaaacttctctctacaacccaggtaccaaacaaaattgacatggagctgagacaaaaggagagggtcatttctgttattttaaaaaaatgtttgaactctggctgttagaaattagataacagttttaaacacatacttgtgttcctcactagattctgaactttacaaggacaaggactatctttatctttgatccctggcacttaagacaatgttaaaagagtcaaaattaattgaaggaagaattattgcaatgtctcagtcagacttaagagttttcacaactcatttcaagctgtaataactcctgtcgataccctcttctcatccactaaggaatattaaatatgtaaatattgctcaagttctatttcaggactccttttagtggaaaaaatgtttggtgcatcttttatttcccttgagtcatcattgttcttcttgggaatgctgtgataaatgttgtcttgcagattctttgcagtgtaagagctttgtggtaggtgatgcttcctgggcctccaaatttgtagcaaattaaaaatgatttttgtgggctttctcccccactcttctaggtgtggaatatatgagtagagcacatcttagctgttgattttgtatgcctacaggaatttactttcaaaaatattaatttgcattttgctatggtatttaaattgataacagccacttatgtgctaggtgttagcaataaacagcatctatccataatccttgcagcaatccttagaagggggttggatcactttgtaaagggccagagaggaaatattttaggctttgaagatcatatgatctctgtggcaactcctcaattctgccattgtagtgcaaaaggagacnnnnnnnnnnnnnnnnnnnncttttttggccaaaaaaaaaaaaaaaaaaaaaaaaaaaaaaaaaaaaaaaaagactcatgttaacagttacccaagtttaccctgctctagtaagtaccagcactagaatttgaactgacttcacgtcatgattcaaaaaaaaaaattagatatttatatttgttcactcagttatgaatgtttggtacctgcaaggccctgtacaatgtgctatgaaagtgatagaggccaagtttacagcttcctatagtttacagggagaggtagtcaatgaacatcattcctctcacttgcccaagttatgaaggatgacaaggcatcatgatttccggatgacaaatgaacacttttcttacctgtaaagttggcaatagagaacatactacaacatatgagataggctgttccagttaggcacagacagtgtagacaaccacaggactccacatggaggccagcttctgtaacacttcagaaatggcaagcaaattcctaagaaggatggagagagctgctggtctaccatgcacagttccttgttccaaagttcccacacagagaactctcctctcctttggaaacatcagtgagagggaggagaatgtgaataatgtgtgaacaggtgtccactccccattaaggaaagatcaggagtgaagagaaagtgtcctgcctcctcctgtgcgatgtagagcaagcagtagaagggagagaataactaagttgctttgggatttacagtaaagagaaattacttccaggattggagaaaaggaagcaattgacagagaaggtggcatttggacacgttcttgaacaatcttcacttggatatgtgaggtgagggggtaagataagccagagaaaggaaatatcagaagcacagagcagtttaggggggtcaagaaggtcaattgctaggtcagagttaaggtgaccaaatgtcctgatttgcctaagactctgggtatcagtagtgaagatctcacatcctgggaaccgcccagtcctgggtgaaacagatggttggtctcttgagcgtcagcctaagaacttggaactcccattcgttgagtggtagaatatgtagaatggcttcatgtagggctggtcaaagttaccacaccctgaacttcttgatatggttacttcctgaggtgagtcactaggctgggaatgaaaggtgagaggccaaaagctgctaatagacattgggaactactgaaggtttttgaaaggtatgaaggttacattgactcttagagtaggaaatgtatagaaagaagctcggggactgtttaatataaaaccagtggagaacatattaggggtgaaataaaatattgagatgtattttctttttgagaaagatgaaatattaattaattatcagtccctttttattttcccatcaggctctgaaaaagagttatttagaattcaatccccaaaactatcctagtatgttcattctaatggatactgttggcttggaatgaatagttctataattgaacttttttaaaaaaaatataaatactttgctcttgtattttcccaaataaaaatgctttggtaataaagaatgcatttctagtaagtttcttgaaatttttacttaaggattgttttcattatcattattgtatgttactcctgaatctggtcattgtaccagatagatacttcatttggaaaagcccactgggtaaatcttatatggtggcttgttattggcactgaactaagagacggaatgaaccagatgtagatgtattcagtttaagcatctagacaatgtctttcattcaataactacttgttaatgagttaatcagttggataaatctaactactgagaatcccaagaggaaaatgtgacatgtttgagcatgtttgtcttttaaatgatgagttttattatttaagaaatatcagaagttgaacttaggtaatcagaagttttatgtaatatagaagtgatgtagaaatctgatgatttgaaaaaaccaggtgaagtttcacaaaactacttcatattaattgctatagattcttaaaggaaattctgtcaattattttgatatggattggttggttattgcttttcccgcctatacttggattgactatattttttactttgaaataacttcagactttacagagaagttaaattatgcacataattcttgtatgccatttatccagattccttaattgttagtattttttttttgagatggagtctcgctctgtcacacaggctggagtgcagtggcatgatctcggctcactgcaacctctgtctcccgggttcaagcgattctcctgcctcagtctcccaagtagctgggactacaggcatctgccaccatgcctggctaattttttatttttagtagacatggggtttcaacatattggccaggctgttctcaaactcctgacctcaagtgatccacctgcctcggcctcccaaagtgctgggattaaaagcatgagccaccgctcctggccttgttagtattttactatacttcatacttgctatattatatatttctctattttttctgaaattttataagttggagacatgattctcaatatcagtgcacatttcctaaaaacaaaaaggacctcatttataatcgcaatgaatttattaaaataaggaaactagcactgatataatactgttatctagtctagataacattcaaattttgccaattgcacctctgctttttgtagttaaagaaaaaattgttttagatctaattccaggtcatatattgcatttagtggtcatactttattcttctttaatttggaccaattcttcagccattctttgtcttttatgaccttgacatttgaagaatcctggccagttattctgtacaatattcctcaacttggatttgtctgctgtttcttcatgatttgattgaagttctgtgtttttgccagggatacaacaaacatgctattgtgttcttttcagtgcctcatagcaggaagcacattctagtgacattaactttgatcactatgttaaggtttcttgtttgtaaagttactagatttcccagcggaataagtatcttgtgggagatactttgatatgatataaaatcttgtttctcattgtatatttactcaatggttttagccagtgcctgaaataattattactgtaatgattgccaagtggtggtcttctaatttctcattaattttatattcattaactggaattctgcaaagaagagtttttggccaggtgtagtggctcacatctgtaactccaccaccttgggaggctgaagtggaaagattgcttgagctcaggagtttgagaccagcctgggcaacatagtaagatcctctttctttaaaaaaaaaatcagccaagtgtggtggggtgcatccatagtctcagctatgtgggaggctgaggtgggaggattgctagagcctaggaggttgaggctgcagtgagcttgtgattatgccactgtactccagccacagggacagaatgagatatatctcaaagaataaaaaaatcaggaagaccttttccttgtccttgtttacttatttatagcagtatagattcatggtttattttattcaatttattataatctcttactgccatttattctgttgcacacattgtcccaggatggacatggaacactgggacctcctttaaacttctctgtttgacatgttccatcattctttgaacacttcggttctctctggcacaatgtgttttaggtggatttttacattctcttccctagccttggaataagcatttctccaaggagctccttttagttgagaatggtatttagaaaacaaaatctggttgctggatatgctcattactgttggggtgttattatttctatgccttctcagcaaacagagctaggaagtataagtgtatatatgtatgtttgcttgtgtgtgtgtgtgtatacacatttatacatatatacacttataaatttgtttctgcttttattccatttttgagttgcttcttccctatccttgcttttttgagacagggtctttcttgtcacccagactggagtacagtggcatgatctcggctcgctgcccctctgcctcctgggctcaagcagtcctcctacctcagcctcccaagtagctagaactacaggtgtgtgccaccacacctggctaatttttgtgtttctagtagagattgtgtttttccatgtcacgcaagctggtctcaaactttcagactcaagtaatccacccaccttggcctcccaaagtgctgggattacaggcgtgagccaccatgcccagcctatccttgttgtgtttattatctgttgagtacgtaaaatattaacatgattctaaagatcagaacaatagaaagaggtgtgtgtgtacttttcataccccatcccttctacccttttcacatttgcctgtcactctgtttccacctgtccactgtaggtaaccaatttcttttgtttctcatttattcatcttagatatctttttgtacaaattaatagatgtgtatattttatttcccttttgttctgctatcaaaggtaacatacattagatactcatttgcactgagctttttttttttacttaacagtatatgttggaaataactccatatcagtttgtagattttcctcattattttttagtggctttggttgcagtgtactatactgcatggaagtaccacaacttatccaattactctcctgtgtgtgggcatttaggttgcttccagtagtctgtaggtgcagaccgcaaagaataactttgtgccaagtatattttcaggttaatatttttatttcattgaagcaactcaacttttttttaagttgtcgttggagagaattggagttatatatatgtcaacttgtttttttatttctttgtaagtaccctcttttatttcttttgaatacctttgcaacaaaattgtcaaattcccctacttttaaatacagggacacaccgtatttggacaacacaccatgaaattttagtaatttaattcatgtttaatgtgtggtcaaaagagcccttatgcttcctggctttttattatcttaggtaatctgagtggcttctaactagaggttctaaaagaatttgggtaactggttttatagctgtaattgagacacaactctgcataactctttccatccaccacttcctcctccccatacaggatacagaccttaaagaacacaagcctggccatctacttctccaaattaatacttgctcttttattgtcagtagccttagagacaatgtatttcccaaacacttgtttgtctaatatctattacctgtggccataacagagtgtcctatttatgagtagagccatatatattatggatttgcaaataaggatatttgcagagctgctctgcaacaccgtcagtaaccccacttttctgttcaactctcactacctaagaggaagccaatcttaattttatttttacatcctttctcttgtattcacattctgctggcttcttaactctgaatcgaaaatcaaagcgtatcattttagttcagatgccatgtgttgtgttttatctgatcctcatgcacttgaactcgggtttccttgacaaagactctcttgttcctgggtggattgactttaaccagaagctggtgctttctaagctctgtatttgaatgggttctgggggtaatgtggcatgctccccagggatgcttaaatactgggacatttttctcaatgtggaatttcctgaatttgcttaaagtgatataattttattcccttaaataactatgaagagagattgttcttagtatttctgaagagtaaaccaatagcagtatgaatgctaaaggagtttaatttgaaaacttgattgagtcattttattataagaaatcaatcaatgaatctccctctatcgcttcctctctcttcattcttattttagttacacttgtaatacataaatatatcctcaggtgtgtggggcagggagaataaaaagcatctctcttgggtctcctttatttcccttctccagatgcaactactgtgtgtgtgtgtgtgtgtttttttttttgtttttttttttgacagttttgttcttgttgtccaggctggagtgcaatggtgcaatctcagctcacagcaacctctgcctcatgggttcaaatgattctcctgcctcagcctcctgagtagctgagattacaggcatgcgccaccacgcccggctaattttgtatttttagtagagatggcgtttctccatgttggtcaggctggtctggaactcccaacctcaggtgatccgcccacctcggcctcccaaagtgctgagattacaggcatgagccaccatgcccagcacaactactgtgtttttaaacttattgtttgtatttaagatgttcaacatgttttgatatgtaaatacagagcaaaatgattactcaagcagatttacatagccatcactttccatagttatgtgtgttaagagcaatgagaatataaatttctggtattttcttgtgtttatacctatacacacatataaactctcatacgtgtttggggacttggggattaaggggaaatgtttttcttctccagaggccaggttgatgactttaagaaaattactcctaaattttggtgctactattagaaaggggagaatagccattccttctgttgttggagacctgcttagacattttaactgttgctctctctctctgctatttgaaaaagagaaagacgttatgagatatggggactgcctctgaaaggtactaaagatggagcgtggctgtttgactacagggtgggtgagattgggaattatggtcttgataggacttttgtagcatggtgtggggaggtgaccacctaaagcacatactggagggataaagtgtcagtactgccagctgtgtgttagctagaagatgtggtgggagttttgttaatggttagccaaggcctatggaagtcatcatggatggcagttcctctctcctttttgatgatagaagtgatgaagccatcattttttctttcttttttttatattttaagttctgggatacatgggcagaatgtgtacgtttgttacataggtatacatgtgccatggtgatttgctgcacccatcaacccatcatctaggttttaagccccacatgcattaggtatttctcctaatgctgtccctccccttgtctccaacccctgcccccgacaggccccggtgtgtgatgttcccctccctgtgtccatgtgttcttattgttcaactcccacttatgacatcattttttctttcttagcccattggcaatgagaccattagggccaccaaggagagggttaagtcctcaccttttaggtggaagatatgccccctttttctccctagcacactggagggtattagcacatcccttcaatccccatgttccccaagctgtttggaattagatgtttcccacctgtgttgtgaagaggagaggtttggcattcagtttacattgatgttttaaactgaaaaggaatgggccttaagtatggaggaaggactactatactaaattcctacttgctttcattcatagaatctgctcattctacttaggtcactgatacccatctgggaagtgggggctcagggtagcaaaaggggaaaggttttgagaaaaaagttcatttatttacatatcccagtgagtcagactgtctcagtaaattagttaatggtttgtttggcagagaagtacaattgatttgcctttcaagtcaatgatttatataacataaaattgttcaaaatggttgagaccaagccttagggatttttctctttattaatgttgcactaaattggggatattctgcataaatatcttgttaagttagactgtatgttcctggagaccaggaaccttattttattttctaaggagccaagtaaaagtatgtgctaaaacttgctaactgaaaggaactttattttagcaatatgtttcttgcacagtagcaaatgtctatatttgacaccaagtactgaagtggactctgggcacatgaaaatgtataggaggtgatatcttactgtctactggggaagacatacatatagctaggtaattttataatgtaacaaatatagaaatagaagactccagcgtgcctcagagtgatactatagtggcccttagcccttataagtgattagagtatcagggaagtcttcctggaggagattgcatgttcctttataggttagggaattgtatatcatttttatacttattattgtgttcctaatgtgtaggacatagcaagtaatcataaatgtttgtaaatgaataaacagatgtatgaaaaagagttcaaatgagtcttaaattatgaggaaaaactaaaaaaataagaacattgcaggtaaaggtattctaggcatgggtagtgatgagcagaaacaaactcgagtttgagactgctgttatgtgcacagatgagacatagctcagacttgagactagactttgttctttaggtagtagggaatacggtggatttttaaacagccgaagtgataggattttatttaattttttaaagaaatcctggtgattgtatagtggagaatgaattagatggatgtgagagttgggagcatgaaaggcgtgtacgttggtagagttgcccaagttctggagtgagaaatgtgttgataaaaatgcagaagagagaacagagtgaaagatactttggagaatgaagagtgataagagctgctgactgtggtgagggggtgagactctgagatgggacaaaaagtttttgttccctgagaggtaagaaggcatctcctggagagggcttctggaaaagctactgtttcttcttcctctttttttttttttttgtaatttttatgaacaaaatagatcaactggcatacaccacattcctgtctagggtgctctgcaacaaatgcctcctaactgccagaaggtctgggaaaacagtattttttctgtcaggcatgttgctgccctgaagagaattagtcctgaaggaagagcagccactagtaatgtctgacaccaagttacctgttagtcttactactgctagtagcactaaaccagagcacaaagtctacccttttaaagaacatttggaaaaaaccatcatatccccataagggactactatatttgtcagaaaaatgtcactattatttctttgaaaagcactcaatcagcaggtgctttggcagtttctaagactgactagtgttcttgtcacacaggttaacaaacgaaaaaaataaaaagagaagggaggcaattgtggtctttctcacccagcttgatttgagggcaaagttttttaaaaaaacaaaaccattaaaggaaagtttaaaagcagcatgtaaacatgtgactgagaattggctcagaccgaaaggctgagaagaccgaaaggctgagagaaaccctcaaagtggaacgcctaccttggagaatgggtcagctttgcagaagatcagataaacatagaaatgggaaagggttttatgggttgtgtgtgtgtgtgtatgtgtgaattttattttttttaccttaatttattattatttttttgagttggagtcttggtctgtcacccaggctggagtacagtggtgtaatctccgctcgctgcaacctccatctcctgagttcaagcaattctcgtgtctcagcctcctgagtagctggaattagagacatgcaccaccacagccggataatttttgtattaaagtagagatggggtttcgccatgttggccaggccgtgtttttttaaaaaaataagaatcagtgttgggtagttcagagttttgagtagaattcattttactaaacttggatatattcgagactatgtgattcatggatcagaaataaaataatcttctaccaagtttgcttctatgtacatctttttagtatttatttttagaatgatctatgttgtgttagctacacatacatatagtgctacaagtcaggttttaaaactctatcaagcatctatgcaataacatacatgcagttcttaggctggcatgaacgttgttttcttaaaatatgaatcattaaatataaaggccaaattcactaaaagatcttgaagatatgaaattcggagtactggcacttttaactatgggtgtttacagaaaatatatcttagcatttggaaatatttggaagtatttagcttacttccactgtgcatttatttttaatatttatccagattttctatcatgtgcctcctgcttttctgttcctatttaagacatttggcaaaggggaacaaagaaatttaattcttactgaatatgaaactccttaggcctggataatgtctgtattttttctaagtctggaaagatgtacattttagccaatgctggaatagcttaaactattaaaatcatacatgtattgttttgtctcttatgtaggaaagtactcatctgtggcctggttttacttgatgtggtctcagttaagctggttggctgcttgaggtctcctgtgttgacctaaggaaggtttgggaaatattggttaatatactacagtgtgagaaggatttattacaagtgccatgtgtcattactataggcattcttccccttgtaaaccaatactttatataagaatgtgtcatgataactaggattaattttcttatttttcctgggtaaaatgagactccccaaaagggctcaccttagaatgaggtgaatttttctgtcttaactctgattcttgttttctgccagatttaagtgaagtccccttttagcaagaaagtataaatatgaaatgagggtataattttatctgccattaagtaaataaaaatattatgcaaaataatttattttctttctacatcaaacaagttaagtttttctgaattgctgaatgatgcaagattctgtagactgagccttcaaattttaggaaagcttttattttggtagcaattaggaaaacaaatctaggaacttaaagattgtaatgttaagtgctgacagcccacagactactaacattcagctgtatgttttcctccctttgatttttggaggttccatgtaattgaatctttagttagaaatttctttatttccataaggttgaaattttccctagattggcaaatcgttcattactaatattaaaatgaaataaccatattctttgttttaaaattttgtttttatcaaagttgtacacacacattgtttggagacagatggttctgtcagacctgtaatgaaaaactgttcctttccaatgccttcttgttacttccccatccccccttgactactttcagaacctttgggtatttatgtttataactttccataacatgcttttattgctccttctctgctttttaatttggggcattatctactgaattgctgctatggaagagaagtatttagcttacttccactgtttctcttcctcactacacaagagcccacttcttttccccatcctcctagtagagttatattgtcattttgcagggatgaatagttggcatttatattcttataaccattgtattaggccattcttgcactgctgtaaagaaatatctggccaggtgcagtggctcaagcctgtaatcccagcactttgagaggccgaggcaggcagatcacgaggtcatgagatcgagaccatcttggctaacacggtgaaaccccgtctctactaaaaatacaaaaaaattagctgggtgtggtggtgggcgcctgtagtcccagctactcgggaggctgaggcaggagaatggtgtgaacctgggaggcggagcttgcagagagccgagatcgcgccactgcactccagcctgggcgacagagtgaaactctgtctcaaaaaaaaagaaaaaaaaaagaaaaagaaagaaatatctgagactgggtaatttatttttttttaaaggaggtttaattggctcgtggttttgtaggatttatgggaagcatggtgctggcatctgctcagcttctggggaggccttaggaagattttattcatggtggaaggtgaagtgggagcaggtacatcacatggccagagcaggagcgcgagagagagttgggaagaggtgccacacgcttttaacaaccacatcttatgagaacttattgccaggacagctccaagccatgaagaatctgtaccgcccactaggccccacctccaacaacacatttaaatgtgagatttggtggagacacacatccaaaccgtatcaaccttgcgaagattatccaaagctgagccacatagtgtgtgtatatgttaaatattggttacatttcctatcctatatagttattgttttctctgaaggtggttttttttctctgtgtgtgcttctcaaattcaactgtaaatgctcttcagtttgctaaatcccttcctagtatgtttgaatatattagctatcttattttatccttttggagagacacctttcagcattgctggtcttgcagcagtctagtctggctgctttatagcctgcttcacagacgtttacttgggatttcccatcagcataatcttggggaattccttctgcctctaacttgtgttgaatactctgttgcctggattcttttactgtttttgtgtacttccgtttttgtggagcatatatcctttaatagcttaccaagaaaggatacctgggatatatatatttgagaccctatatgccagaaaatgtctttattctgctttgcagttgactattttggatggtcctggattcttactagagattttctgtagccatatcctctctcccagctttcaacctcaggacgtgcactcctctagcatttgttacatctgactcctaatttcctccccattcttctccagcacccaagtgggtggtggaagttaggggcttgtgcctccgctggaatagtatctttcctttctctgcattctctcttcctcaccttcaaaagttatcatagctgccgatagttggcgtcttatttttcttggtgactgtcaaagaataccagagccagagagtagtgaaagtgattaaaaacagattttatccagaaattattgcaataggaggaaagatacctcagtatagaactgggctcgatttcaaatacacaacgaaaagtggagatttatacacaaggagtggggctggtggggcggtgtttggatggaaaattactaagaggagacattaagggtagggggattcttgctaatctgacttaagatcagatatcaagggttgggggtgaggcatttgatcagatatcaagagtggtcagaaatccaggatgggggattctggctaacttagcgggattcttgctaggtaggcccaacaaggacaggggtcacagttgaggcctagtccagagcagagggctcagaggaacctgactactgtttgctcaaggagagagtctttgccatggttcaagtgaccataccacatgtgttcaggtgttagcaaaaattctcaagatagggtttgtgacacttttcatactagtgttatttgtgtgtgtgtgcatgacatatgattagaacgtgagataaatggtagtactattgacatttacataacctgctcaggagaatggtgatatgggttattttttcccctaaggctagttatgcccagccattaaccagattaaataatctcaatatgtatatacatcacaagaatgtgatataactttatgtctaaaatactttatcaccacagaattagaggatatacttatgctgcttctattatggccaagaaaccaacgtatgaatcacaggtataatatggggtacttttctacaaagaaaatatgtagcaagtgaagcatttctttttaatcaagaagtgggctatattatgctttaattcttatatggcccttagtttttccaggagcttattatttatttgtttcacatttgcatgcttttctgcagtgttcttttttccccccgaatgctccatcatccctaacttattccaatctaccgaattttttttcttttttttttttttattatactttaagttctgggacacatgggcagaacatgcaggtttgttacataggtatacatgtgccatggtggtttgctgcgctcatcaacccgtcatctacattaggtatttctcctaatgctatccctcccctagcccccccaccacctgacaggccccagtgtgtgatgttcccctccctgtgtccatgtgttctcattgttcaactcccacttatgaatgagaacatgcggtgtttagttttctgttcctgtgttaatttgctgagaatgatggtttccagcttcatccatgtccctgcaaaggacatgaactcatccttttttatggctgcatagtattccatggtgtgtatgtgccacattttctttatccagtctatcattgatgggcatttaggttggtcccaagtctttgctattgtgaacagtactgcaataagcatatgtgtgcatgtgtctttatggtagaatgagttatagtcctttgggtatatacctggtaaatgggattgctgggtcaaatggtatttctggttctagatccttgaggaatcgccacactctcttcaacaatggttgaactaatttacactcccaccagcagtgtaaaagtgttcctctttctccacatcctctccagcatctgttgtttcttgactttttaatgatcaccattctaactggcgtgagatggtgtatcttattgtggttttgatttgcatttctctaatgaccagtgatgatgaggttttttcatatgtttcttggctgcataaatgtcttcttttgagaatgtctgttcctattcttcatccactttttgatggggttgtttttttcttgtaaatttaagttctttgtagattctggatattagccctttgtcagatggatagattgcaaacattttctcctattctgtagattgcctgttcactctgatggtagtttctcttgctgtgcagaagctctttagttttattagatcccatttgtcaatttggcttttgttgccgttgtttttggtgttttagttatgaagtcattgcacatacctatgtcctgaatggtattgcctaggttttcttctagggcttttatggtcttgggttttacatttaagtctttaatctatcttgagttaatttttatataaggtgtaaggaaggggtccaatttcagttttctgcctatggctacccagttttcccaacaccatttatgaaatagggaatcctttccccattgcttgtttttgtcaggtttgtcaaagatcagattgttgtagatgtgtggtgttatttctgaggcctctgttctgttcctttggcctatatatctgttttgataatgattagtgtagtcttaagtcagtttactactttgaaagagtatgcagcaggctttgcttttggctactaatactaatctctactgaatggtagaagccccatccaatggggagaaattttagggcaagcctttgagcttgcttgagtgtaaagaaacagaaacaggctgatgaatttattaacagtggtggaaaagtataagggtgagtacaaaaaccaaccaaaaatagaaaaagaaagagcaaatctataaacatgagaagttaagtttctagtttaagttactagtattgatcaagggttacagcatccctgaggaagtaggggtggaaaatacaaataatctcaaaaatgatttaactaaatttgtagatgccagatccataatgggttattgtagggaactaggatgttttgggttcactcctaacctttggggttgacatcaaagaacagccattctttccacagcatatcccttggtgtcatcatcagaaacctggacaggaagaattgggagcctgatccaatgtagcaagacccattaggctctgatctgtgccaggtttgtgtgggttgtaaatttagagtaaattccaacgtgagggttgtaaatgtcaatgaatgaaaacttgaaaaccttaacttttatattttctaatctttgttaattctcatttatgtagtgtgctcttaaagctttaactttcttggaagatctttttattatatatcctgtacttgactatagtgatacttcttgaactagtagtttctcatactataggttgaataggatcaattaattaccataggaatagagcccctacttttggaatttctcttacatatcactccattttcaatttgcagtttgagattataaaagaagtttctacttcagttatgattcttgacttttctaatagaaagatatttgaaattcccatttgaatggattttcatctatatgtaggaaaacacacatgtaattttagggtttttgggtgcagattatccgttttccttactattttgagggagaagggctgaattcaaaactttgatctgaatgccttacagcaatgtgtaggaatcaactgagaatcttgttcaaaagcagatttggattcaccagtagagtgaggcccgtgattctgcaatacacaaggtgtgggatgaggaaagtctgagattcagcttctaggtgatgctgatgctgcaggtttgaggaccatgttttgtatagcaagactttaaagcattgcttgccaacttagtgctgtagtttaaaaaaccagtcttggtttcagcttttccactaactatgtttttggaaaggtaaaggaataatgaaaacaaattatttatatgagcaggatccaaatactatagttatttggatgttgaattcgtctagaaatattttctttccacctattctgtattcttcccagctctttctctttttcttatttccattctgtattgaaaactggaggcttaaatgacacaaatctttcttgattctattaaacacacatactctttcagctctgtgtactttgcctaattactggcagtaaaactcagtaaagggatttaaggcttatgaatgttctacttggaggaaattgtaattaaggttattaaggcctttgggttcttgtattttaagcaaattaagactttatgtgttttttaaagagacagtaactcttccctgcccaattatttcctctgcacggataaccttgtacattccatgcatgtggttcaaacggcacacattctactttgttcttttaggtaagtcatggatttaagctgagaacttttttcttttctcaattgccatatatgaaacactggacaacttttaaagcaaaaactaagaaataatccatgtactttggtaccaaaattattttaaaagccaaattattcttctttaaaacatttgaagagagaataatagtcatttaccttttattgcaaaatcactctgttctctattaaagcaatatgagttcattgcaagacgtttatgaagtgccaaacacaataaagaaaactgattcatactaccttgtagtaatcactgttaatattttttgtcttttttgcaagattttttaaaatataaatataatttacgattttttgtgtgtatgtaaaaggttagaaatgtcctaagaccatacctatgggcacaaccaagtcactttactttctttcctttcctttccttttcctttcccttttccttttcctttcctttccttttccttttccctttccttttcctttttctttttcttttctttctttctttcttttttttttttttttttctgggacggagtctcactatgtcacccaggctggagtgcaatggcgcgatctcggtttactgcaacctctgcctcctgggctcaagggatcctcccacttcatcctcctgagtagctgggactatagatgtgcactaccatgccccactaatttaaaatttttttgtatgtggagacaaggtcacactatattgctcaggctggcactttacattctacacttgaattagtttctatcttggtctttctttctcttagtcatggaaaatgaattctggtaaattaatcttgtgtcttgttaatgaatgttttctcatttttatttctgggtgtgctcttccttccttccctgccttttcaccaaggcttgcatcaaggtttgccaggggagggaaagcgatggagacctcatatcatcctgatgctcctgtcccctgcgtgtgctgaccttactgatcttcactcttctgcatctgctcccacgtcaacccctgcatatcacacattcatgagggctctgttcatgtgtccaggctctctgcatctctgtcctgactgtgaagttgtcttcttgctcgctctctaagccacttctgaactcttcttggagtgtaagatattttggatggcttactatactgcttcgggctcaagaggacatctcaggccctctttgccctgaacatcttactaccatgtctcgcgtcctgctcacataagtgtctgggatgaaggagcacccctggatgctgctgcttccttgggctttgcagctatcttcttgtgtttcccacatttgtcagggcaagatatgcattatcttttgttccatttcccgaaggttatagcacatgtacctttgtagacacccactcaaccaaaactcagtgttttcttctctccccactctgctgctgactcatggggtctttatttgtctaagcagataattggctctgaaagattacttagccctttatgcttatgaaaaacttttgctctgagtctttttttgtctctggtttttgatactcataattcagtatctcttttaattcttaatttttttttttatttttattttctgagacagggccttattctgttgcccaggctggagtgcagtggcacaatcttagctcactgcaacatccgcctcccaagctcaagtgatcctcctgcctcagcctcgcaagtagctgggactacaagcgtgtgccaccacacttgactaattttggtatttttgtagagatggagttttgccatgtcatccaggcttgtcttgaactcctggaatcaagtgatctgcccaccttaacctcccaaagtgctggaattacaggtgtgagccaccgcaaccagcctattcagtgtcttataatgtgataaaggaaagggaagatttttgtctcttccaagaattttaaaattctgtttggaaactcaaaatttgagcatttgtacttctttttcttgagaaactttgctttgagccagtgaattccacttgagcatttgaatgaagaaaaagctaagagctaaaaataaattttaaaattatcagttaatattcaaatattatttaatcacatgtaatgtgtgtgactttttaaaataggattctacactgtttttataatctaccccccattctatatagagccttgtctatatattaactaacactgctgtgcataatcagtggttctttgtagtcaatattttatacctaatgtaagttattcagtattttattcatggacatttaggctgtttactgtcctttcactattaaagcaaatgctgtgatataaattgtatgtatttctgcatttatccaattctttcagctagattcctagaagtaatattatgaaattcacatgaaatttctatgaaattcatatttcatagaagtaatattacaaaggaaaagttcaataattccaattctaggagatttataccaatttacattaccaccagcagcatataagatgttaatttcctgaatgcttaccaattgttaaaatcatcagtcccttaaacgttaattttatgtaggggtgactctttattttgatttgcattttgtcaataatgagattggatatattgtacatcttttcatgtctaattaatttctacctttttcaatagcttattatatttttacttccttttctgaaaggacttttcttcattttgatttgccaatattctttatacaaaaaaaatttaccattattgtatgtttcaatgaccttttctagtttatgtactttcttgcaaagaagtttattgtttcagtcaaatttacctttttctttatttttttttttttgcagtttatgacctttttagatagcctttcaggagactctttaattaccctgtgaacatagacttacattgagcaaaccattgtacaaagtatatttgatatattatgaaattagggtacattttaaatgtgtttataatagcttaatatgtattaatacatataatttaagcatgttacttatatgatgacatcaatatttttatgccatttcatgattaataattcacagtgaggagattgcagtggtttgtaagaggattgcaacctctccatgagttgagtgagctggatgttagtaagaagttgtctgtgataatatgagctctggtgtcttctgccctttgtggagctgaatcctcagaggccaggcagtcagttacttctgtgagtaaggaaggccacaggctacccaacagtgatgaactctgtgttaaatagatggattttaatgcaggcggctgctactcggctctggttaatgattatcaagcaggaatgtggaccatgccatctgattattagaaaaaaagcaagaaatttgggttttcacattaaaatttttctagagggaaaaaattggtgcagataaaacaaaattgagctctgtagtgcataaacatatatggtggccctagaaatgtttatataccaaggcgatgaactgatctttctagagaatagctaatttctccttttactccactcccttgggtgtatgtgtgtgcaggcatgtgtgtactgcatacgtgaatgcctatgtgtatgaacctagtgattagctctgtttttttctttttttgagtcaggcaaggtgtatttttaatttttttcatagatacggggtctcaaaatgttgctcagtctggagtgcagtggctattcacaggcctaattatggtgcgctgcagcctcaaactcttgggctcacgtgaccctcctgcctcagcctctggagtagctgagactacaggcatgtgcacagcttgattagctctgaggttgagctaaactcaggctcttcacagtctttatttactggctattttctccttctgccacattctttatttgaaatacattgttcttgggggtactatgaataaaaatgaagagtttttaaagaggaagaaatggggtttctacagtatcaagttctgtttgcctgaagatgaaattggagacttagtgattatgaagtaactgcaagaatgtgtctttgacaagacttttctgcagacgtgtactctctgttgcatcacatcagcaggcgtgtaaggcagtttgtcccattattggtgattctagttttgatcacttggttaatgtaagtttggccaaatctctccattataaaggcaacttttctcatttgtgattaatacataatctcttgggtggtatattttttcccaataaactttcaccaaatggtatttggatggtgatgatctctgtctgaattaagttattacattagtgatggcaaaatggtgaatctgtgtggccgcaatcattcaaatgtggattgtagaatattttacaagacaactagcctggagtctaaaaatctcagtgtcaacagaggcaaaaaatagtggaggaactgctctaaattaaacaagactaaaccgaatgcaatgtatgacccttgataggtttctaaagataggtgggaaaaaagcaatatttttggggagaaatgaagaaataggaatatagacaacatatttgtaatactttaagtccatgttaaatgtctgagatctggcaatggtattgtggttatgtaaaacagtgttcttatttttagaaggtacatgctgaagaatatagggtggtgtactgcgatgtctgcaatttactttcaaacagttcaccaaaacaattatgtgtgtgccttttcatctctacctttagatctgtgtgtatatagatatagacaaatataaatgttgacatacacagagggagagaatgcaagggaaattattttttaaataatgatagttttgatatgacttcgtgacttacaccaggtaaggtgtttatacagtgtttacaatcccggtgtcctacaatctttttcagaatttggagtttgtaaagttgacttttcccaacatattgaaaatcagacatttatccttctttcttcttgaattcctcttttttttttcagaatcagtttgccagtattaaaaaaaatctataaaaatgtaaataattagagccttcttgtctgtcttatattttaatatcttctccttaagctatgcttgatcttttccttttcactttgaaggtccctatttttaacagaccaaaaaaccccatagtcttcctatccctttcatctaatattacattataacttagtaagtgagcttaattttttaaaattaaacttgctttaaaaataatttttcataaatattaggaaactttaaccttcacatttcttttgatattattttttcccctgaatatatccttttgtacatgttgtttaaaatgtttgaattcatcagagaacttcctatgcaattgtgttgaattctctagaatatcactcttcttttcccctttgggattatgtaaagatgttcttattttgtaaatgtccttctaatttatattctaatttagaaactttggccgcaaacacaaacgtgtttcttctgaacttttaaaattatgttcttaaagtataggattatacttctaggatcacagtttctgtatgctattctaaaaaggcccataataacatttgatttctgtattaacagttcttccttgtattcaagtattgagtgactcctttcgtttttgctatttatgtgaaagataaatggccaatacaatcagccaaggtgtatcagacatagtaaactttttatccttgcattccccaatcctgtgcatacatctgtatgtttatgtacatgctgtaccttggacttggaaatcttgttccatcaggcaaactcctgtattctcttcaagacccaagtagtgttactccctatttcttagctcttccaggataaattgcatctcctccttctctaccccaaagcacttgatagtatgcacataaaatacaacttaaaaactacaatattttggagagctcttactgaacaaatctagaataatctgagtattaaacaaagacagtaacagcctatagcccattgaataacattcacgagtacctttctgtctgcttgtttgacgtaacaaacaagcagacagacaaatgagggagaagggaaaggcctccccaaaactagcatgcccactaataaatggagaggaaatgacggagttaaagaatcaccttcgacaacctgacagtaatagtttatttaggcaaaaatcatcaattcttggatgccaaaaccagtgtgtgaaaatttgaacagcaggatatttatacagttttactatgtcacctctcaaaatacttaccaattacagaagaaaaaaatagcaactttatagtatagaaacctagcagacaccaccttaaccaagtgatcaaagttagcatcaccagtaatgggaccaaaatgcatcgtgtgcctcttaagatgatgcacagaaaaaaacatcacttcatacattatcccccaaatatatgaccagtcatgagggaacatcagacaagcccagacagacatgttgtaaatcactgacctgttctcttaaaaactgttaagctcatgaaagaactccagattaaaggagacttggagatatgattttcaaacccatcatattgggttagatttcaaacataatatgatacattagcttaaaagggattctaatctaggaaaaaaataaagaactataaaggacattgttggcataattatagagtgaggattaaaaaataatatatcaaatatggttgatgtaaagcaatgtctttgtttttggaaatacatactgattactgaaaaattttagaggtaagagggcagaatatctgtaaattatacttaaatgactcagaaaatcatatgtatacatttgtatacacacatatattacatatgtataaacctacatgtctatatacatatctggctacatatacatacacatatagttttgccactttttgagaatgatcaagtaccatttacagttttccatgaatgtagatgcaggttgcttttggcttccaagaattggagaagatggaggagactcatggtcaataagcagtgacaaattcctctccaaaactgttcatttcattcctctggctttcatgcatttgtaaagtctagttttgatcatttgagtggtatactcaggctttctaattacataggtatgcttgctgtgttacttcaaaggccccttagccagggcaggatctatcttcaaagacagtgaggagagtggcccatttgcaggaaattgcatggtttgggggtgatttttgttttctttgaacttgtcaagtggagatccctctgtaaaaagtgctggccttttgctgaatgcccaaacagtaaaagactttccatttataattctgaagatttctctttaacctctgccagaggaaacttgtaactcagtttcccccattatcctttttgatggatcagcagttttactctgaagtgtttttgtgggtgatatcttaattttgttggtttatagttctagttgtgttaggaaaaattagcatagtatttttagtgactaatcatcaaaaggaactttgattattttgttgtagctaaaaacggaggaaaggagcagcgaacgaattatgagggtatggcctaatttgaaagaaagttcttgcaatttaaattatggtataatgcatttcttcccctaggtgctgtacatatattgtttaacaggaaataaacagccaggattttgaagttaaaggtcagaactgcattcaaatttgtcacaaactatgatcttggaaagattttttaaaactctctgatctgtttattcactttgataaatgaaaattatacatcagaagcattactttcaaaaagtgtgaaaacctgtagcctgcaatctgtcctgtagcatgttccccggggttaattttttttctttttaacccttattttgactttgctgttttttaatttcttcttattcataatagacagaaccttgttagagtaaggatagttaagcaattagatttcaaattgggtcggtctaaggtatggattgctgtgaagttagcaaatcaacaaagcatgtcaaaataacctgcttataaatgttaaatgcagaccagtggttaggccgggcacggtggctcacacctgtaatcccagcactttgggaggctgaggccagaggatcaccagaggtcggcggattacccaaggccaggagtttgagaccagcctgaccaacatggagaaaccccgtctctacttaaaaaaaaaaaaaaaaaagaatatatatatatatatatatatatatatatatatatatacacacacacacacacacacacatacatacatatatacacacacatacaaaattagccaggtgtgatggtgcatgcctgtaatcccagctacttgggaggctgaggcaggagaattacttgaacctgagaggcagaggttgtggtgagccgagatcacaccactgcactccagcctgggcaacaagaatgaaactctgtctcaaaaaaaaaaaaaaaaattattgaggtctaaattctgtgcaagtctggagattcagtaatcattctgatttttgttaacatttgacttttaccaacagtgaactacattgtagaaaactgactttttttgcatgatagtatagtattccataataacatttgtcaactttaggtgtctgttaatatgctttttattaaggcaattaaaaaaattatctttgtttaaagaaacctttctctaaatagtgtagttaacaagagtggccattctcaattttaaaacacagtggtaaaacccatggaagtttccacatttaaaacacatggagtctttgatctggttagttatgacactgattcttcttgagggctgtgtttatgacaccaaataagtcatctagtttgtttccatttattgtttttaatattaagacagtgatgtaagcaggagtgaccaactagtttctattctaggaagcaggtgatatatgagggataattgaataacttaaacacggtgagaattatacattaaatagagtccatcctacccctctttttaaaaaagcaatttaattttggataggcaggaggggaagattttcctacaggcagttggataggtcagacactatggcacttacattccatttcttaggaagtatgcaaaactgtttttaaattgtgttagtataagaagtatttaagtactttatggaacaaaaatctggctctgtttgtgagcagtttgttttcttctatttaaataattggattatctccctgtataaacatggaaccatgtgagggtggtggttttgcaatcttcataaatgtatatatttagatctgctcatgctggggttaccattagcaccagcagtctgtcaacatttccacagggtcttttaagtatgttgtgaaagctccagccaacacttggcataagtaatctgtacaacacagcagtttcaagctaaggcttataggatagcacgcatgctaacttttttttattatactttaaattctgggatacatgtgcagaatgtgcatgtttgttacataggtatatatgtgccatgttggtttgctgcacccatcaatccgtcttctaggttttaagcccggcatgcgttaggtttttctcctaatgctatccctctccttgcccccaccccctgccagacaggccctggtgtgtgatgttcccctctctgtgtccatgtgttttccttgttcaacacacacatgctaactttaagcatacttttcttttggtgttggaagaaatttatggagtacaattttttttttccctcactgattcaagcaggtggcttattttatagaacttaggatgtgattcttcccttgtttcaaaaacatcatctctttctggaaaaatgagcaacacccaaccatcctatgttttacttctgattcaactaattaatgttattggtgttagcagttgtacaaattgaggagctcgtgattctggtagcatattttcccacttaaatagttcagttttccgatgcatgtgttgtgatccttaattgtacactttttttcattacctgtgagaattaacgtctagtgtagggatatgcattaagatttttgtgtcaaaagagtttctagggggaaaaaggggagtaattcttatagggcttggtttcccaaagtgttaattatgggaagggcttcatcatttggggaattgtttatgctaaattgaggtctcacgattttaatttcttattggggcctatagataactacttttttcttgtgttttgtctttttacttgatttggggtattcatgactgtttttggaaatgttccctggagaatttctttcctttttttgagacggagtctcgctctgtcgcccaggctggagtgcaggggcgcgatcttggctcactgcaagctccacctcctgggttcacgccattctcctgcctcagcctcctgagtagctgggactacaggtgcccgccaccacgcctggctaattttttttattattttatttttatttatttttatttttttaagacagagtgtcgctcttgtcacccaggctggagtgcagtggtgagatctctgctcactgcaagctccacctccctggttcaagccattctcctgcctcagcctcctgagtagctgggactacaggcgcccaccaccacacctggttaatttttttgtatttttagtagagacagggtttcactgtgttagccaggatcatctcaatctcctaacctggtgatctgcccaccttggcctcccaaagtgctgggattacaggcatgagccaccgtgcccgggagttccctggagaatttctaagtcccacttatttcagttgaatcctgttctacttgagcttctcactctgactggttctcagttggctagggcatagaactggcttggcaaagtgctaaatttagctttccttgagcctctctctgtggtgctaagcctatgatttaaaaaaactcaaacaaaaaacacaaaactctcaaaagtatcttgccttgctattgatgtgtcccccacaaaaatatttctcaaaagtacctttcattgccattgatacacatcagcagctcctttggaatatctctgactcccccaccagatgcacaagccacatgtgctgcttatgttttgggtgggaaatgttgaagggacactgctttgtttcaaggtaaaatgtattgaaccaaagttatttttcttctgatgaccaccgtgattatttgctttggtctgtatcctttaaatctcctccagtttgacagattatctcgaatgttaatgatgtgtgtaaattgttagaatgagaatgtgtttatcatgttctgtgcaggtccattgtgccctcaagcagaaccacctaagactccacatttattttgcaaccatacctcagttcatcgtctttccttgaaccgtagttattaagtattctgagctgccctgtgacgtcttaattaaatcagactttgaagcattcatgacacatacctcatagatcattcctgtttcttttgtgctgtgttaaatacatatatttttccagtgacccatgctatggccatagttaatccaggttgtgaatgtccttcagaggtgccaatgtatgaggattacaactggaatggtgctggcactggagagtatttaagggctaatagttctggtaattttcttcattttttttttggaagatattagcacttcatgtgttaaaaatagatctgtgactctaactttctcccccaatatttaaaaactcctaggtttggttgggcacggtggctcatgcctgtaatttcagcactttgggaggctgaggcaggcggatcacttgaggccagaagttcgagaccagcctggccaacatgacaaaattttgtctctactaaaaatacaaaaattagctgggtgtggtggcacaagcctgtagtcccaactactcgggaggctgaggcacgagaatcacttgaaccttggaggtggaggttgcagtgagccaacatagtgccactgcgctccaacctgggcgacacagtaagactttgtctcaaaacaaacaaaaactcctagtttctcctagctttgagtttttgtacagtgaaatacatattttaataggagaagccaaatgatcggattaaagacctttaatcctgatgtcattaaaaatattcatttgtagagatgatttccatatttgaggggcttacaaatgtttagaaataccattttcccaaggaaatactcctagacaattatatgtccaatcttttattcctaattgatatgatttattaatatttaaataatattgttagataaattaatatgagtttctcaaagttaatgcttctcgggaggttaaagctttgtaaaccttgtacctaaaaatatcattctctattaaagaactcaagaaaagataaaaagattctgagaaaatatgggttatttttatttttatgtttttggagatggagtcttactgactggagtacagtggcgcacgatcccaactcactgcaacttctgcttcctgggcgcaagcaattctgtctcagcctcctgagtagctgggattacaggcatgcggcaccatgcccagctaattttgtatttttagtagagacagggtttcaccatgttagccaggctggtcttgaacacctgacctctaggtgatcggcctgcctcagcctcccaaagtgctgggattacagacgtgagccaccattgcctggccataaatacagtttaattctaggagttctagaattttgaaatttttgatacaagctttgatcttgattatcaatttttttctagattaaatttatgttaatatagcccttctaaatattaaaggaaatttagaaatttacctttaagctttattaacatttttaatcatggtatttattttctatccaaggcatgatgcttataatggtgatggtctagcattaaaatttgttgtctttacattcacaatcggactactgggtttgatatttaaatatttataattttatataaaactaagcaaagtatcttaagataggcattttccattttggtcaaatcttgtgtggcacattaattcattacgttgattgcttaattgagtttgagcttggtagtatacatgattacaggatttttataccactgctgccaagatctagtggggagaatgtatccaacttgatttctatagcatccgacatgcaagttccctgttattggtgccagagttgggtttcccccctacctctctcaatcctgctccttctatgggtttttttttttcttccttaaatacatatcttgaacttgaggttaagaagaggcatacattagcaattttgtgatattaattgatgaagttaatattaattgttcatttaaaaatttgttgaacttgcaacattatttgaccagcaaatacagagtgaggctaagatgccaacagcccactgttcagtcttattattttcagaattagaaatctgtacctttgtcaggatggatgccttcacctagaaggaattcagatttcttcttgcttggcaagggctaactgcagaaacaacggaacacatttttttaaaagtcaggagtatattagaaacacatgggcattcaacacctacataaaatactctatgagataaatgtgaataactggatttaacaaagggccagactttagaataccagaattcataaaaaggctaaacttactttataatttaaggggaacacaaatcaactaattagaatgaataataaagagtaatacctatgctgcttttttctctcttgatataactgtttgtgatttaggtagtgttaccttgtttcagtctcatggtttttcttgtttgctaaatccctataatattccttttcccatcaaggggatatgtgtgggtttgtgctagaatcactgtttatgactattttcaggattttccatgttttatgagatatatttcatctttagaattttgggtgggtctagatttagaaaactgttttggttggaatgataaggctctggatctcagcgggctttagggttggaaaagttgaagctcacagagagcaaataaacatggtcatcaaagctgagaattaagatctgtttatccacctgcacacttgaattaaatctcagagcaatgggcagagccattcaacttatgaagatcctgacaaaataaattactctattcatgtttaaacgtctattttttgcctgtgtttagacacagaggttggtgtagtgaccatgtggtagatggagaagttcttgtggaattactaagctattgatttacaacagggagaatgccactaaaatagtggacaatggtgaattaaatggaaaagtctgtttgaggtttggggcaagaagcttcaaattgtaaaaatcacatgggctcttgtccttcagcactgagcagcatcatgattgaagattggagaaagtggggagagagtactcaggttaggtgtggttcacatcacttttgctttaagggaattcctcgtgtgtagggttataaagataacctaagatatggacttgggtaagtattccctaattcattttcattgtttaagtctgttgaggttcaagtaaataaagcaatgcttttaataataccttttttaaaaaatgcagggcacagtttgttgactctgagatctttgtggtcaagatgaaagttggctcctgatacataaaaacaaaacaaaaagcctttaatttgtgttgattctcttggttctgtaattctcttttctctatacttcttactgtggagcatgatttatggtgataaagagctttggtttaacttttgaactgaaagtatagcttcaactttagcatgtgatgactgtaggacagtgaacctcctccttaaaccattctgctgtgtacttgtaaaccttccagaatctccttttatttataaagctagatttgggttggatatttccttgggtaattgcttgatcttggtttttcaaatctgcatataaattctagagcagaagttcgtcagtatgtttcagagggctttgtagtgtggggctacttctgatgtagcttcagccagcaacccttgcccttgccttagtctctcagttgttcatgttaaaggggtggctttttcgtgaaagagtcataaattgtttctctaaatatcattccatagggtcttcatgcttaaggtgggttacaatcttggacaaccctgaaaatgaacaagagttggattctctctagctaccttttcctccaccatagccatttcctcacacagcctgtcagtattcccagtttcattgctcttctccagcttttcccatctccctcaattttttaccctttctggcacagagaagttaaacgatatcctaatttttttgaacctcactcacttacaccctactcaggatactaagaatgataccagaataaaacctcttcagaaggcagctggaaaaattgtagatagtataagcttatttttggtcagctatgcaaaaatgattttcaaatcataattatctggcaatattaaggtgtaacaaaataccatagtgagtataaaagcaggaaaattgagcaatagaatgtagagtgaagtagggagaggtaggtctagggttgggacttcataactattcaaatgagaagtgataaaggcctgaattatgagaagattcatggaaatgacaaaggtgagggtcagaatcaaatctgtaggagaagatattatcatagaagctagaggaggaagaaaaccttcagcaacctaggctattggaattgtgaggatcagaaattgagaatgagatcttgaatgagggatgagaaaactggttgtggtcttcataaaagcagttttagagataattcagcagaggatggtgataagtagaggcaacaggtttaactgacactttgaagaaatgtgacggtgacattggtttggttcattgttatggaaagatgctaacaacttagctgaaattgaacaagttatgacccaacaggtacagtatgatgtgtatgaaaaacacaaattatataatgtatacatgcatatatatataaaggagcatttggaaagtcgcttacccagaattttattggtaactgtatctgaggtgatgatttttcatcagaattggttccctagctctgccccccaacaattgcagatttagggaaataaagtattaaatgagaattatttggaaagcatagataggttttcaagtgagagaatgtccatgaaatagattcaacatgcaaataaaagagaacagttgatagaaaagagtcctagaatagatgtgaagagtagatctttctggccaattcaagatgttatattggccttgattcctgatcctgaagggccttgtttcttgtttggtccctttggtagaataagccctggttttgggacttcctggatgagaggctgtgggaagctttggggaagaaggaagactctcttgtggatctaaaatctgtgtagatttgctgcaagttgctataaatataatggccattaaattgttataataaaggaatgacatggtatacaatgtactctgtatagctgccagtctgaccacttattgcttgatattagttttatacacaagactgattatatggagggtaaacaacatgtagtctcaaagctaaaagtttcaataattgatgagttttctatttcttctctcctaattctttcttgggttaactcgataaaatgaagtcattgtggcctcatgtattctgttgtatttatgaccttgcttggcgtagtgaaaactaaaagttacatgaatttttaatattttagaaattataatatttcagattgtatcatttctacattttataccagctataggaaagagtattttgtgtcttttcttttaaggtacgattgtccccatcagatgcagtgaacttcatatggttcaggtattaacttatcttagatgctatttcgacatttgcttagtactgtcttctcccaccatgtcccatcagtaggatatttctgtttggaaaaaaaaagtaaataatatcttactggtgagtaatataatttatggaatcttcaaaagaggtgtaattgtaagtaagtacattgtactgaaattagcacatagcctttatatgctttactttttctaatgagatataatttacttgtaaattatgcatattaattgtaaaaatgtacaaatatacttagataaatgcatagttttgggttttgcaaatgtatacatttgtgtaaccaaaatccaggcaagatatagcacatttccatcaacccctttagcgaattgactagtgcacagggtaaacttgtgtcatgggggttttctgttttattttctccaatattcaccccatgaccccaactcatatcctcctggaaacttagaaggtgaccttttttggaaacagggtctttgcagatgcaacgaagatgatgaagatgagattctatgggattatgggataaagatgggccttaaatccaattagagtgtcaatgtaagagacagaaaaagacacagagatacaagagaagaaggcataagacaatggaggcagggattgacttcatgtaactatgagccaaagaatgccttgggctaccaaagactgaaagaagcaagaaaggatttgccagagtccttgagaggaagcacgccctgctgatacgatattgggatttcagacttctagtctctagaattgtgataataaattcctgttgtttaagccaccaaattgtggtcatttgttacagcagcccaaggaaactaatatacctcctccatcccccgcaaattctattatgcccctttccagtcagtcctcaatcctcaaaggcatgtagtagtcttatttctatcaccacagattagccgtgcctgcctttgaccctaatataaatgaaattatctagagcatgctcttttttgtatctgtttggattcttttgaccagcataatgtatgtgaatttcattcatgtcatgtgtatctgtattatcctttttattactgagtaaaactcaaatagtttgaatataccgtaatttgtctattctgttcatagatattcggattgtttcttcctacccatattttatacatatattacatcttttgtagctgtcactggtttagaagttatagattctgttattgtttttgtagttaggaacttaaagttatagtaattacattttaatttacattagtcttcctcactgataatgcggaaactctgaatgctttaagtttggcttccttctcaagtcttctgtgttatttttgtgaatataagatatttagtttcaaaacttgaaaatcattatatgttttttacatgctatgcttttgtatagagacatgaacatgtttttcaattggtgtgatcactatagcttgttgcattctacttcctctgggttctgttttattttctccaatattcagagtttaatcttttagttaatgctttaaaaaaaattaagatatttgcctttactttggctaaaatatcttcattttgctcacctggttaaactataactgcttatagaattatagtttgataatttttcctcaacatgttgaagatagtatctcggctatctaatctttatttttttctaagtctgctgtcagtcaaagttttatccttatctagataatctgctattcctctctggcttgactttattctcatggcatgtaaatgtactgcatttagatgtagacttgtttggtctcttaatttttaatctaagaactcatgtctttatctggaaattaatcagccattatctctttgaacagtgtgttttattccttttttaacatatacttttaagttcacgggtacaagtgcaggtttgttacataggtaaacttgtgtcatgggggttttctgtacagataatttcatcacccaggtattaaggctagtacccattagttatttttcctcatcctcatcttcctcccatcctctgccctccaataggcaccagggtctgttgtttccctctatgtgtccatgtgttctcatcattaagctcccacttataagtgaaaacacggggtattttgttttctgtttctgtgttagtttgctaaggataatggcctccagctccatccatgtccctgcaaaggacatgatctcattcttttttatggctgtatagtattccatggtgtgtgtgtgtgtgtgtgtgtgtgtgtgtatcacattttctttatccagtcagttgttgatgggtacctaagttgattccatgtctttgctattgagaatagtgctgcaatgaacatatgtgtgtatgtgtctttataatagaaggatttatattcctctgggtatataccccgtaatgggattactgggttgaatggtttttccatctttaggtttttgtggaattgccacactgtcttccataatggttgaactaatgtacactatcacaaacagtatataagcgtttctttttctccacaacctctcagcatctgttattttttgactttttaataatagctattctgactggtgggagatggtatctcattgtgatttcttatttgcatttctttaatattcagtgatgttgagttttttcatatgattgttggccacgtgtgtgtcttcctttgagaagtgtctgttcatgtcctttgcctgcttgttaatgatttttttccttgtgaatttaagatctttatagatgctaaatattagacctttgtcagatgcatagtttgcaaatattttctcccattctgtaggttgcctgttcagtctgatgatattttcttttgctgtacagaagctctttaattagatcccacttatcaatttttgcttttgttgcaattgcttttggcatctttatcatgaaatctttgcctgtgcctatgtcctaaatggtattacctaggttttcttccagggtttttatagttctgggttttacctttaagtctttgatgcatcttgagttaatttttatatatagcataaggaaggggtccagtttcaatcttttgcatatagctagccagttatcccagcatcatttattgaatagtgaatcttttccccattgcgtgtgtgtgtgtgtgtgtgtgtgtgtgtgtgtgtgtgtgtgtttgagatggagtttcactcctgttgcccaggctggagtgcaatggcacaatcttggttcaccacaacctctgccttccaggttcaggcagttctcctggcttagactcccaagtagctgggattataggcattcgctaccatgcccagctaattttgtgttttgtttatttatttattttttgtagagatagggtttctccgtgttggtcaggctgatcccaaactcccgacctcaggttatctgcctgcctcggcctcccaaagtgctgggattacaggcgtgagccaccgcacccagcccctcattgcttgttttggtcaggtttgtcaaagatcagacagttgtagatgtgtggtcttatttctggatactctattctgttccattagcctgtctgttcttgtatcagtaccatgctgttttggctactgtagctctgtagtatagtttgaagtcaggtagcatgatgcctccagctttgttatttttgcttattattgccttggctatttgggcttttttttggttccatgtgaattttaacatagttttttccagttctgtgaaaaatgtcaatggtagtttaatggaaatagcattgaatcgataaattgctttgggcagtatggctattttaataatattgattcttctatccatgagcatggaaggtttttccatttgtttgtgttatctctgatttcttgggtagtgttttgttgttctccttatagagatctttcatctccttagttacctgtattcctaggtattttattatttttgcagcaattgtgaatgagagtttgtttgtgatttgactcttggcttgactgctgttggtgtgtaggagtgctagtgagttttgcatgttgattttgtatcctgagactttgctgaagttgcgtctcattttaaggtgtgttttattcattctctttactctttccttctgtagtaactactaatcatgtattggaacgtttctgtttttttcttacaaaaacagtacctttttatcttgttttgtgctacagttatttaaaagtgtttttggttatgtcattctcttctaccattcaatttgtccatagaattttttgttaagttttagaattttcatttcattgtaatgtgcacattcttgctttttcccatgtgatttctagttatccctttatctcttcagatattctgtagatattcattttaaagactcctttagaatgtccttatttctggttttttaggtgtgaagttttcttgttactgatattgttgactgttcctcatgaaggtttacttgctcatatgatttgttcatcttgatgttaaggtagcatttcatgaaagtctaggtctcaggattgtagaaaatatctagagagtaattctatatttatttattttttctttctgggttttcctggatctggacaaattcttattttaacttgtcaacatcatatagcccccatgctacaatgataattttgatttggatcccagccttgtggacttggtgttctgatgtctcatgaattatattttctcttgtgcttacctgctgtgtgctcccaagctagggtcagaatcccctgctctagccagttagggcagggggtcatggacaaacagccccatttactccatctacataaagggagctaagtgctagatcttcacataaatatttcttggcctgggttgaggaccttgccctaagttctacctctgtctggtctgacatccccatgagccattcagctttagcttctggcctcaactctgcctctgagtttcctctttgtttctaagtttggttgtgtattaacaactttttgggtggcggaggtagagggaagaaggggagggatattttatttagtatttctatgtgagtatagcagaaagaaaagaaacatttgtcttttcagcaggtgtatttaccaaaaatctgattatactgataattaaacacaatttttgtttttcttttacagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagtgagcatttggttttgtctatcctgtattgctggatatgcaacttaggagaggagctaagttgaagattttgaatgatttttttaaaaaaaatgtgtttgtaataggtgatagaaatagtttaagcttgctgggtgtggtgggtcatgcctgtaatcccagcactttgggaggccaaggtaggtggatcacttgaggccaggagttggagaccagtctggccaacatgaggaaaccccatctctactaaaaatacaaaaattagccaggcatggtggtgcacacctgtaatcccagctactgggatagctgaggcaccagaatcacttgaacctgggaggcggaggttgcagtgagctgagatagcaccgctgtgctctagcctgggcaacacagtgagatgtcatctcaaaaaaaaagagtctaagctcaaacttggaaaaaatgagtatggtaggataagagcacttttactttatattttgtatagagctgtaagacacaattccacatacacactttattttagattatgtaagtagttttttaatcacaacgatctcaagtacaatcttgtttgacagatttttgtaacgagtacctactcagtgcttataaaaaaaaaaaaaccacaaaggaatttaagtactttatgctgagaacaatctctctggtttaccaatttctatagcttctttttctctttttatctgagttggtaatccttcattagtctaacctgcaattaaatatatggtaaaggtgtttttttttaagtaccattactaatataactaaaatgtttaggttattttaaagtaatctgaattataagtttaacaactatttaaaaacgtttaaggaatggcattttgtacatagtaatgagggtgcaatttttcatcttttaatccaaaaatcacttacagaatgagtctcgtcttctaggtcagccatagaaattgtggtttaaaaaaatagataccaaaggaacatccctttctttaaggaactcaaattttaggggatagaaaggataagaaaaaggggaccacagaataaaatgacaaaaggtaagcaggttattcataatttaatatattaagggctgtgtcagtaatcattaaatcactcatatatatatgagataattaaatctcatatttatgagagtgatttaatgatctcccattaacacactgtgtatgtgtctattcaggcaagacagtctttagatgagaagagtttgaattacatcaaccaaggacaatattattttggaaggtggcagaactagtgggggctggttaaataaattctagaaagaaggaaccacatatatgtaaaaataatgtatttggggaacaagaactctcacctggagtgttatttggcattttggcaatgcagttctctgtttcatgggacctgtcctacattgctggacatttagtgtccttggtccctgcccattaaatgtcctttgtgtcttcactactgttataagcaaacatgtccccaaacatttttaaacacttcgtggaagagcagtacagtagctggatgaaaaccattgaagagcatgtgcctagtgggaggtgtggttggaattgaggaaggaaagggaggctgcagtgcaactgataaaggtgtttcctgctaggctaagaagtcttggtattatctaagggtactgagtaggcagtgaactaaagagattgctttaagataattctagcagaagtgagggagatgaattggagaggaacaaaaagtaaaggaaggctattataatgattgcagattagaaaacttgttctgatgattttttttgtgggtaataaattgcggaggctttaaaaatagaaccagtggggcctggtaactaactggacagagctaagagaaagaatcaaacttgatcctaaggtcttctagctaaagtactggatgatgttacgtcgttagcagagttagaaatatttaggcttagaggaaacttggatctaccttcatttcatggaattgtttggattaatatttaaaggaaacaactccccaccagttgtagactggcttgcaaatatgtttgcaaatatgaattttgttcttaaggcatatgatttaggctacttgataatttatttctcatagtttataaacttccagaggaagatatgttccaccttggaaaggattcctgttcagatttctttagactacctatggcgggggtggtggtttgagtccacagttttatgtgtttcattccagactattagcgcacaaggaagacaaggcaagagtgtagatggatagaaacatttattccaagttctagggctagcattgtatgtacttatatggacaatagggtggccgtataatgtattactcaatgtgggacactgggaaatgagaggggctgccattaacaactatgcagggatattggatgtaaaccaggaccatcctatgcaaactggtatgaatggtcacctgagcaatactttgtagtatatcaatggagtcttccttagatactctcaggcaggagttaatagcacattttggcttagttttctcagaaatggaaaggagagcagtgactgtaaatcagccttagaaagaaaatctgcatatgagaaagggtttgctatggatagacttcttgtaagtgaatacaatcaatgttggagtttactgacctagagaaaatcattacctggtacaagcaggaagtgctattaacaagaccccattagagcaaagtgaaaaatggaaaattatttcttaacagtatacgactttggataatcatgtttctttcatgccaattatttgctctttttcatgactagtttgcatatattgcattgatatttgtattttattcaggggatgagaaagatttaaattggaaaagctgtcacagacttagaatttgaaatgatatccacttttctcttccttaaaagattatcgctcaatagtagagaagaaaattatacttttagcaatagtagcctaaaaaatcttgtaagtgaaacttgaaacttgctcatctgtttcctaatcactagagtatgatttccaatgtaaagcaatatccttcttttgaaggaagatttgctctctgaaaagttgtctgaggttggcttcttggtgcagacagtatgaagcttatgcagttcaaccatacttatggaaaccaatccaacaactatctgagtaattctgtgatacatgtactaacagacactagaagctgccattgtccctgatactatgttagatgttaattcactcatattttttctcattcattaatgaaatcatttacataaaactttattctttaaattgttctaaatagtccttgtagaaaacttagaaaagtacacaggcctaaaaaaagcaaaagcaaacacttctctcaaagataacaacagttaaaagataacaaaaaccattttgtcttctgttcttgacatttttgtttctatgagtatttgtcgttatcctcaccttacaaatgtgtcattgtgttttgtaacttgtttaatgaattatgaacatattttcatgccattaaatacggttgcaaatattctactgaatggttatactatagttaattgcctattgaaattcacttttagtttttcatgattataagcagttctatgaaaaatatccttatatataaattcttgctctctcatacacatatttttacacacttgcatggtttatttttataagataaatgtttaaacataatacatgttttaaagatatatattgccaaatggatttctagaaaagttttatcagtttacatcttcactaacagtggtcattttcacttgcatctctctggctattaataacaagtataaaacttcatttttgtcttaatatgctttttctttgacacaaatgaagctgaacacatatttgtcacttgaatattggcattataggatgtttaccagagtcactgctccccttttttctatttgcacaactgtcatgtttttagtaattaaaaaataaactttttgaagtatcatgcagaattctaaattcacaaataataaatggagtgtttaatgaactattacaaagtagatacatttaactcccactgatgtcaagaaagaatgttagtactacccactcactaacttcccattcactactgtcttctcctttggcataactaccatcctgacttgtaaacaaaacacatataaaacattattcatggcaacactatttttttaaaaacataattactttattgatttcttacaatcaaataccaccaactagcattacttccactcttgcatcattaaaaacaaagggtatttcctccttggtattttcaaatgatgcattatacaataaacaaagttagaacttgaaacgcaccctgattaattatgtaaactggtaatttgtttaaaaaagcataataatttggttcctttcttcataaaatggaaatttaaatatttcttctgatagtcttgaggttatcattatgagtagtgcaaagtgtggcacatatagtttcatctagaagggtgtggatcttaccttaaacaaacaaaatgtgcattaacaaagtgcatacagttaatgcatgatagaaagcatgtttcaaatataaagcagcccctccggccaccatattatttaggttttgcattatcatttatggcattatagattaattacacataacttttatacattttaaacctgaagataagaaaaataactgttgcttggaagaaattattccaggtagccatttggtttggatcaggagaaactgaacctccatgagtttagcgtctgccaagtcagaatcattagctcaagtgagtgaatgagatatgctgcgcatttcacagtgactgtttcccaagtcctggcaatgcctctgctcccacagtccaccagatgaagcatttccgggatgacccttctatgtggttttcccttttctttttgctggattaacgattactgtattatttcctcttttccccttttggtggccttctatttcaattattcataaatcctttcagaatatcctcagagagctccataagaggaagttctgtagatggaaaatccaagggcggaagacaggaatgtccttggctttcccagtatttgctgcaaacttctgccaggttgaggaggctgtagcagtttctgaatgtggtggcaagctccataactctgatgtttctacaaaatcagcatctacatccagctccttttctattggaccttttagaagtctggccttttcagcctttagttgttattttcttcccttaatctttaattctctgccacaaggaattccacatgcctcttcaaatctgcaattttggttgcctgctcctctataattgttttatcgtcttttggggctttacttccaatacatggctctgctggctcactcttttgctgaagtaaatatagtagtgtgtctggatccctgtcaaagatcccctgaatctcaggcagacatttctctgtggaagggctgtacttctgagaaaggggactctggccctctgcatcctctacagagggtttgtgagatgcctgaagatgggcagctacatccttgtctgtgttctgctgggctttcaatcttgcttcaccctgggcccttttccatctctcttggatgaggaggagctgtttcatatggctatccctttgcaattccagtgaaagatgagcctgctcagactgtgtcagcttcatagcttcagaaagatacgctgcagcctttttgtgacaagaaatagcctcttcgtatttgcctacagctaataaacggtctgctcatctgctctgttgatgagccaggttgaggggtccttcattacttccatagaccctggggtaagcggcggccttaggaaggggagtagtggtgccagggaacatggaggggactgcaggggagcgtgacacagccgcagagactgtggcccctctctgcaccccaggagccagtcgtaggcgctgagggagccaacactatttatactaattacaagttggaaacaactcaaatgtccaaacaatacaatacctaaaaaatatagtatattaatattgacatttaacagaaagcaaggaaaagccagtggaggaggctgtgactaagtcactaggaaagcagagaggatgatgtcccagaagcagaatgggaaggcttgcggagaagtaagtggtcaatgtcagcgttgcactgtttaaacaatagagttgttgaccttcatatgagccatttcattgtttttgttgggtcgctattctgattgctatggttttggggagtacatggagtcataggaaagcagccagtgattatatacactcattctcttcttcctctaagtgtatttaaaaagagaatctgataactggaaggctcacacagatggggaagttggggtgtgtgtgtctgtgagtgacaggagacataactaggaaagagccagctgaggaggaaagacaaaaaataatgaagaaacaagatcactgaagggacagaagaggatagagtccaaaacataggtgggaaaattagccttggacaaacatttattcagcaatttatgaagtatctacctcatgtcaatcaaggttaaggattcttttttgtcatgtaccaggaaggtatcagaaatatgctgaaattaaggaaaaaggaggagtaaacttttttaacctccaaatttatgtataagaaaacaatatactttgccagaaatagtactttggaaaatcatctgtaaacaaatacagaaatgagatattttataattttagatccatgaatttgctacattttaactatttctgctacattttatgattctacccttgttttgacattttgtgaaatatgtatttaggctaggagaacactacattttgtttccttttttttcttctttctttccttcctttttttttttttttttttttttggtgttgttgttgttgcacagtcatagctcaatgaagcctcaatcccttctgtgctgaagggatcctcccactacagcctccccagtagctgggactacagtcgtgtgccactatagccagctaattttttaaaaaatgtattattagagatgcctggctgttatttatttatttaaatatttttagagatgaagtcttgccatgttggctggtttctaactcctggcctgaaacaatcctcccacttcagcctcgcaagtagttgagattatgggtgtgagctgctacattttgcttttcaaatgaaatgacacaggttttaaaaactagtaatttttaacatataagaaaatccaaagttaaatatcatcttttaatttgtgaactccaagatcactatttaggtgtttttaaagaattactacatgtcatcaagtttgaatgcctttagaaacacctgttttcttgtctttctttctttcttttttctgagacagcctcactttgtctcccaggctggagtgcagtggtttggtctcagctcactgtaacctccgcttcctgggttcaagtaattctcgtgcctcagtgcaccaagtagctgggactacaggcgcacgccacgatgcctggctaagttttttgtatttttaatggagatgaagttttgccatgttgcccaggccagtctcgaactcctaagctcaggaaatccccccatcttggcctcccaaagtgctaagattacagtcatgagccactgagcccagcctgtcattcttgaataatgtaatttaatgatgcatttggggaaaaaaaaagtctaggtatttaaaattaacataaatatgtttgaaatgtccaaatctggacaactgtggacacacatataattattctaagtaccataaattctatataatgtgtttgaagatctataaagatacagacttccaaatatattgatgtaaccccagtatgtttgggattactgagaaataaaattaaaaataacaaatgtcttcgtttggaggatacttagaccattaggttggagaccatcaggttgcatatgaaactgatacagaattagacaacagtattagatagcatcattacataaagtggtgctgaaccccagtgggccaatggggttagtattttgcacagttatagaagggatcacagaagggacaagttagtggttaggttagaacagtcatgaaaaattgcagggctcaggtgtatccttcccttccttcaccatctaacctgggtggcgaggctgttaagagttaggggcattctaggtttagaggaaatgcatgagcatgaggggtgaaaggaccagtgacaagacctgatagaagacctggagataagtgattgatgttgaccaactaaaggtaataggattcaaattcagggactgtattctgattacacttaaaccagaaatgctctaaatcatgtattagagttattttactttaggtttaatctttatcaaaccagcacatgaataagggctacattttagaagcctataatattctttaattttggaatacaggcagtgctggaattaagaaagcctggtgaaaacagccacttgcatggttttcccaacagtattagtaggtatttatctgataaggaaagagaggggaagactgtaatttaggggatggcttagcctgcttaatacagcttacacatttagcaaacatttactgctgatatactaggcagggccaatgtgtgtttttattaaaaaaaaaatggaatggaattgaatgtgctaagaactgtgagggtgacacactggctgctcagggaacccatggggcatcagctgacttgcccttggagatgggtgagtcttcagattttccgaagagtgtgttataaaactatcttgaaagaggagtagggtgagtaagagtaagagggtaaagggtactcatagcagagagtcacttgagcattggaatgcaaaatgtgagaaatgaaatcttggaagctgaggatggaggattcataagctgggaagacatataatgctcttgttgtagaatgtcatctgatgtcaccaggggaaataggttgagcagagagccagagaggaggcacagagaccaattaggaagctgttgctgtaatcccaggccagaaaccgggacttcagctaaggcagtggtacttgaggtggggaggaagagacagattcaagagattagaagatagaaccagcagaaggtggttcattggacacaagggtaagagagggaagagacctcaatgactcacagatttctgcctttttttttttaattattatttaagttttagggtacatgtgcacaacgtgcaggtttgttacatatgtatacatgtgccatgttgtgctgcacccattaacttgtcatttagcattagtatctcctaatgctatccctcccccttcccgctaccccacaacagtccccagtgtgtgatgttccccttcctgtgtccaggtgttctcattgttcaattcccacctatgagtgagaacacacggtgtttggtttttggtccttgtgatagtttgctgagaatgatggtttccagcttcatccatgtccctacaaaggacatgaactcatccttttttatggctgcatagtattccatggtgtatatgtgccacattttcttaatccagtctatcattgttggacatttgggttgtttccaagtctttgctactgtgaatagtgcctcaataaacatacgtgtgcacgtgtctttatagcagcatgatttataatcctttgggtatatacccagtaatgagatggctaggtcaaatggtatttctagttctagatccctgaggaatcaccacactgacttccacaatggttgaactagtttacagtcccaccaacaatgtaaaagtgttcctatttctccacatcctctccagcacctgttgtttcctgactttttaatgattgccattctaactggtgtgagatggtatctcattgtggttttgatttgcatttctctgacggccagtgatgatgagcattttttcatgtgttttttggctgcataaatgtcttcttttgagaagtgtctgttcatatcctttgcccactttttgatggggttgtttgtttttttctggtaaatttgtttgagttcattgtagattgtggatattagccctttgtcagatgagtaggttgcaaaaattttctcccattttttaggttgcctgttcactctgatggtggtttcttttgctgtgcagaagctctttagtttaattagattccatttgtcaattttggcttttgttgccattgcttttggtgttttagacatgaagtccttgcccttgcctatgtcctgagtggtattgcctaggttttcttctagggtttttatggttttaggtctaacatgtaagtctttaatccatcttgaattaatttttgtataaggtgtaaggaagggatccagtttcagctttctgcatatggctagccagttttcccagcaaccatttattaaatagggaatcctttccccatttcttctttttttgttgcccaggctagagtgcaatggcatgatcttggctcactgcaatctctgcctcctgggttcaatcaattctcctgcctcggcctcccaagtagctgggattacagatgccaaccaccatgcccggctaatttttgtgtttttattagagacggttttcaccatgttggccaggctggtctcaaactcctgacctggggtgatctgcccgcctcggcttcccaaagtgctgggattacaggcatgtgctaccatgcccagccaggtttctgcttttaagaattgtataaatactggtttattggatattattattgatttattgggattattggatattattattgattttggttttgattgatagatagcaaaaggagttcaggtttagaaatgttgacttgagatgacacagttgcgtagagatgtgcattggagagtcggatacctgagtctgttttagataaaagccagttaggatctagtatctccttgctctcctgtcacatctgacgatcctattaatactgatcaaaaatactgatcacaggtacagatgttaccaggaatatttattatgcttaaatgcttaccaggatgctaatatatggttaaacctgaatctggtgggagtgaaactgctacatcatctacctgtggcaaagatatgtgatacctccagtagtccttcaaacagagggccatatattgggaaaattattttcctctacagtgaatggcaaacaggaccaccccacacaaatttgtatagtttttttacgtaggtgtctgtctctctcagccccactcccccaaactttacctatgttttttattggtcatgaccctttctcttctactgactgtgtattttaatcattatcccatctccatcattcccaaagatgggagttgttcattgttgacacatactgctttgaaacctcttcatattagaatgaagtggttctcaaagtgtgcatcagaaccacctgttaaaacacagattgcaagattgcaccgccagagtttctgattcagtagatctgagatggagcccgagaatttgcatttttaacaagttcacaggtgtggctgacccgactggctcaaagactacactttaagaatcactgctaccgtgtaataattatgtcactagttatggaatagaagacttcatatttaatggaagacgagtttcagtaccttctaagcatatgaggatattatgaggaaatgtatatttctccccacttctctcattcacacatacctgtttatgggctgtactgatcatgagctgatcatgatagaatgtgttagaatatgctggcttttgggacagcctttcactatacttgtctctccccttccctaacttttttctctgcctcccacactttctcataccatgtttcttccttctctaagattttcactactttatgtgttctggcacatgcattttaatttgtaattgtgtcttgtatcttagaactaatttattctattgatttttgttgataaagttctgattgaactatagcttctacatgaatagaatcattttaaagctttattttgtgcaatagtttaaaagaaaggaagaggaggggagtgtttgtagacaggagaacagggatcatggtggactgtgcagccagactcccttcttgctcagtccacaactggcttccaggttagaggttggacaggtgccttaaattactctttaacaatgagtgaactacataatctgagccccagtgtcctcatgtctaaaaattagcagagactgtgagatcattgctctaacattctgtggttctgtgaatgcttccagaagttactgccttttgacattccagaccagcctgtctcctcaaactgcagatagaaatggccattctaatactctcctaagaatcctatgatatagttaaacattacattctactctatagtatttgtaaacatttacattgcacatttgcactctgacaagctcagagaggtttacaaacctacccaaaggacacacagtatggagagctaagaacaggatctaggattctctctaactctaatgcccatgtttctttaattaaaccatgcagcttctcttggagaaaacaaagtaaaaatgcatcatttggtccagttcaactgcccatcataaaaaagaaatacatcattggatagggttaggattttttcccctttggcagagggtgaggcaggtaggtcttcactttgaagtggtacactttcagcattcttttgtgctggtttcttttccaaattgaaaagggacctttcctacagcccagtctgcagaaggcacttcatgggttaacaggctcctgccagctggagaaagctcattgccctgaagtggctttacatcactatgcaggagtggctaccagctggttaataccctggccgtcacttgatggggtggacaccctactatccacttattagaagacagctggatactattacatgccaaatctctcagttcttttatgctttctcctgaagaaaacccatctttgcaagacagctggctatatttggatgtacctatgactgggataaaaccgtatatctagaaaatctcacaattgtcaattgattttagttttgggagattatataaaaaatgtgacctcaccagggccacagtttagttgaggccagccagtcaaggccttggcatctcataagttctcagtacatattaattgaatgattaaaatgtcccaggtggcatggggtccctaagagtaggagcaagggctcactatattagttgctcttttgtgccagatactatgtcgtggcttactacttataaacacttatttagcactttgggggctaagtcctttcaatgagttattcagtagatacatgactaccagaggcaagtgaactgaggcgtagagaagttaaatagttcaatgaaagtcaattagtatgtagcggagataatactagagtgtgtgtgtggctgatgacatcctatgtttgttgttactgaactgtaagtttcctggaatgcttttcagttttgttccacagatcactataaatttgtggaagagaaaaactgtaaattgaaactatttttacatttaatgaaggcattcctatttattaactacttttagcatttaaagtcatgtaaagataaatgaatctcttgatcacaagatactaaatatgaattatctaggaaggtggtggtacagtggaacaacctgataggccactatttatcatgggacagcccttttcaatgtctttgttattgtttcagtgagctagtgtggacagtgataatcaggtggttcttttatttaataggaaataattgacaatgtaccaaatctctgcattctgtagattgaattcagatgaagataagcagtaacttactgcatcggttaaagaaaagaacagtacacttcaaataattcttaaaggagagtatgtcttgttcaattaacaaacactttcactgattaacctgtgtgtgtgtgtgtgtgtgtgtatgtgtatgtgtgtgttcacaatcctgcatgacctttgtcaggtagatgttcctttaaactaattaaaaattatatacatagatctggaagagacttaattatattttcttcttcttcccccctccctgctttttcctctcccctctctccctgtctctctccctcccacctctcttccctcaacaaatgtggatactgaacattacaaaggtagtatttctccaaagtcacataattactcagtagcagagtggccttgacatctaagaatactgatattgcactggtgtcaaagtctttctctctttctctgtctctttctttcttttggttaagacaaggtctcactctgttgcccagactggagtgcagtggcacaatttcagctcactgtagcctcgacctctcaggctcaacccatcctcctatctctcagcctcccgagtaactggcactacaggtgcgtgccaccatgcccagctaatttttcttttctttttctttttttcttttttttttttttgtagagatgaagtatcgtcacatagcccaggctggtctcaaactcctgggctaatgtgaccctcctgcctcggcctcccaaagtgttggaattactggcataagccgctgcacctgaccagaatgctcttttcattgtatagtccttgctccttggtatgtgcagaggatcagttctgggaccaccctggaacagttagacctgcggaattcaaatatgaagttggcacccctgtaggcaggttacccattcagcaaatacagtattttcaatgcatgttgtttgaggatgtggaatgagccaatacagagggcttacagtatttattgaaaaatcttcgtatgagttgtaaaccaaacagtgactgaggcaggtctcaatcgatttagaggtttattttgccaagattgaggacgcatttaggaaaggaaaacacaagttacagtagaatctgcggcttatgctttttccaaagagggttttgaggacttcaatatttaaagagtaaagagcaaacaggaagggaagaagatggggggaaaaaaggaagggatgggcagtaaggcaagtagttatattcttgcaaggctttgaatagtgctcagtgaatctatacctttcaggggctggagaaaaagtcaagtatgcatttgtttcactctcagtaaatctgcattttacatcagataaagtcagcatgtgaaattatggctgttttagaacaacgggaggcagttttcttttttttgtttgcttgttctgtgtgtgtgtgtgtgtgtgtgtgtgagtgtgtgtctgtgtgtgtctgtgtgtgtatcactcagttcccaagctttactttccctttggcatagtgagtttggagttctgagattcttttttctttcataaagcagaccgatataggtcaaacctgcattgtgcaagggtcaactgtaccttaaaccatgtaatacagacaaaactgacaaaaccgttatgcagttataaatgcaaatattagaaaaatctgaatttccttggctagttccccccccatttttttttttgagatggagtctcgctgtgttgctgaggctggagtgcagtggcgtgatctcggctcactgcaaactctgcctcccgggttcacgccatactcctggctcagcctcctgggtagctgagactacaggtgcctgccaccatgcccagctaattttttgtatttttagtagagatgaggtttcaccgtgttagccaggatggtctcgatctcctgaccttgtgatccacttgcctcagcctcccaaagtgctgggattacaggcgtgagccaccgcactcggccgccagctttttcttaaacaaatggtcagtttaagtgtttcaaatcccattaaaaatatcaaaacattcaattttatcttctgaaaggattatggtaaatcctatctctaaaagaacactggattggaagaaatggtgggctctgatttgagctctgacagtaactagctttgtaagcttagacaaatgatgtaacacactctggaataatagcatcctagtaacttgggtctatgaaaacatctcagtaaaagagtaatatctgatgttggcagtttctttttacagtattgatcaccttatgactttctgtgtattctaagtctagtttaatgttcagtctctccctcccacccttatttctgcttggtttatggttaaggactgtgcataccttttgtttcttaaaggcaaaacatgagacataaaagctttaacatgatatttagtaatttggtgcctaatttgaaaatgtagctctgcataatctgaagtatttttgtttgttacagaattatgctattacactaaaatatacaaaatgggctgggcacagtggctcacatatataatcccagcactttgggaggccaaggagggtggatcactggaggtcaggagttcgagacctgcctggccaatgtgatgaaacgccatctctacaaaaaggacaaaaattatccagacatggtggcaggcacctgtaatcccagctacttgggaggctgaggcatgagaatcacttgaacctgggaggcagaggttgcagtgagctgagattgcactactgcactccatcccgggtgacagagtgagactctgtctcaaaaaaaaaaaagactgtgtttattctaaactgatagaaacttagcattaaatttgttaattcagcagatacatctatcatcatctgtcatgtcaggcccctatgctgagatctaagaatacagactagcataagacaggctctgttttctacatttaataggaggattatgatggacagagtggtaaaaccatgagggaagaactatcataggtatctgggtgttgggagggcagaggatgttttcaagaaacttcacacatataactgagcatgactaaggtgaaaggtacatgtggagttgaggctaagaaggtagatagacatgcctagcaagaaagatcttgtattttaaaatcaagggtttgtacttgattctgcaagtgaaggtgagccattgaagcattttaaagtagggaaatgacgtgaaaaatgtgtgtttttgaaagatcacagtgttctcttgtagctgcaataaagcaatcttaattttgtcattgtgatctgtagcacctgtatggatacaccatcaaagatttcagtaggccagatcagggatgatattaacaacttcagtaatggttattcacctgcacagtgcactgtttaatgtactggtccacagttgcaatgcagtagctgcctgttgtgagacgtaaaccctgttttaattctattccattaccctttatggaaaactcaaagggcattctttctcctaatttgtcctggaagatagattatatcaaactgatactctaaaagctagaataaacatttttctctctgtgagaaagttggctatatgatttttgatactctttacaaaacattttacttttatttttagtaatggtactaatggttggaaaataaaagtcgtgactttccgtttaatagaggtaattgtatttttcaagcttacatttgtttcttgtggatttggtagttcttgtaagtgagcctattatttcaacataggcccaagttaggcaacatcgttctattattatatttccagggcagaagccaccttgtgctgtttttatgtaaataaaacatacacctagtgctttagtttttaaaatactttcacctgcatcttcttaaccgcatctggaaatcctgcgaggcagttaatatcctcatttacaaagcaggtaacatgcattctgataagtccactgactggcccgaaggttgcctgccactgcgtggtacaaccaagactgtatctacttttatcatcaaactagatgggcatacatgacaaagccaccctcacaaacagagcaattaaaaatatcaaactacaggactggacataaatgtcaagctagtttcagcccaaacatatggcttcgtaaaattcttctctcttccttcctttccaaccagcaacttcgttcaaaagtcagtgccacagcaagcaagaaattaaaaacttattaaaatagaatggaatattgacccacagacaactgatcaggagttgtcattcttgatttatcaatacagtgtgaataaagttaaaaatattgaaatgaaagtattcccatgtcaactgaattccagcatcctcatgcttatctgatatttgtcttatgcccacagccagatggtatatggaagacatcactatgcctccccaagcttcaatgctaccatttggtgttttcaaaataaaactctttattttcttttccttttttctatcaaggtaccccagggatttcagtaattctctagcctaggggtcagcaaactatgacccaagggcaaaatttggactgctatctttttgttagggcccttaagctaagaatagcttgcagatttttaagtcattgagattttaagacaaaaaaatgaaagaacaatattttgtgacacacgaaaatgatattaacttttaaatgtcaatgttcataaagtttttttggaaaacatccatgttgaatcatttacatattgtctgtggctgcattttgtgttatgacagacatgagttgtttagacagataccgtatggtctgcaaagcctaaaatatttattatctggctcattataggaaaagtttgctctagcctatttggagtataaagagattaaggtattcttcttgttttccttggatgggggttgagtggagggcaccacatatattagcttacatatgcttttccatttagttgggtggagagatctgcattttccaacatttggaaaaatccaactaagatgcaggtctgaagctgattaaaccgctctacttctaccgtaatataaaagggtgacaagttaccaaaaaaggaaaagcacaagaagtaaccaagatgagagttctaataatggcaggaatttaaaatctgatatgagatactaatttggtttacaatttttgaaacttttcattactatcacattcctttgctattttattttgaggtagttgtccttctcccactgtttcacaccttcaccatgggaaaaaaattctctttaagcatttaacgttcttagcaaatgtgttcattttaatttcatttgttttgagaatgatttcaaatatgcatcacttgaatatatgagaaataaagccagtattttcagagttcctcgttatttgaccacataattttacacaagcctccacgtttcttcatattttttctatgtgggtgggcaagatataacatttaaacattcaaatatcacagtgaagctactagcagcatattgcaaaagtttgaatttggagtttttaaaaagtgaactgttgtgacacttcaagttaaatacttttccctgatacattttttgacagcatatatgtcctcggcagttaaaataaaagatactatggcatgtaagatagaactctatagctatctgaaaaacagtatgtaaatttctagatagaaatttattctgcctaattggaacttgaggatttaaatcacagcctacgtcaggattttattgtatgatataggtaagtcaggtatttccccctttttatctgatggttaagggagtagggcacaaagagaatgtgatttctaccatctgtccccacaccccaggtcaaaattgcctttagatcttggtttcctaactcctggttcctaatgttcaaagcagatgattttccatgtaggtacccaacaaatgattgtgatcagtttgttaagctgtgtgacctaaacaagggtgaagccactaagtgtactctagacagtgggtaatgccctttattgggtaatgccctttgagtagtgcatatgtatatatttatttattaaaactacatatatacagtttattaaaattatatctattttttccatgtggagtatcctatttgagcttccttccattcaccatcttgggctgcaatccttttgtcctagttgttagattaaaatgtattttattatttatatttaatagttgtatgtatttttaggagtacatgtgatattttgatatctgtataccatgtgaaatgaataaatcagagtaattaggatatccgtcacctcaaacatttattttttttgtgttgggaacattacaattcttctattttgaaatatataataaatgattactaactatagtttttcctactgtactattgaatactagaacttattccttccatctaactatatgattgtagcccttcactaacttctcttcatccccttccgttctcagtctctggtaaccaccattctactctctatctccatgagatctacttttttagctcccacaggtgaatgaaaatatttgatatttgtctttctgtgcctggcttatttcacttaacataatgtcccccagttccatccatgcactggaaatgacaggatttcattctagttttatagctgaataacattctattgtgtgtatatacataaaatattttctttatcctttcatccattggtgggcactcaggttaattccatatcttggctattataaatagtgctgcaataaacatgaaagtgaagatatctctttgatatattgatttcccctcttttggatatatactcagcagtgggattgctggatcacattggtagtaaatttttatacttataaaagctcacttttaataactaattacacagcaggtactgtgctgagatctttgcactgattaagcctctgaatcctctcaaaaagcctgtaagatagagactgataatacctttaaaaaaatacatgaggacattaagacaaagagagcttcactgacttgaccacagtcacacaatagtaagtggtccaagattctaacctcagatctgctaaccactgtactatttgagtggccactatattctccacatagttcttatttcctgccccttgctcttattctaagtgtcctgttctgcatttgacatagttgaattttatcctataccaactatctgaactaattaaggcaatcttgatttaaactcattctactgggttataaacagactttaaccctgtatcttctgttaatttagtaatgctggttctctgtgtcatcattcaaagagtttaattgtaaatataaaacattgagtcctgaaacttctggattcatcttttatttaggttgaaatataatgaagttctaatgagctgtgtgttacttgactgtattacaaaaaaatgtaattttagcttttaggtataataatttttatcaatacatagtctagtggaattactgtaatggtacatattagaaatgcatgattttgataacataaagcttaaaacttgggatatttataaccccattgcaagttttgagaggaaatgttaaatagtacttgaaattgttagataagcctaaaactaatttttaaaaaccttatattaagttccatagtctagtgctttccatgtgaaaatttgctgaaagtctaattttgaatgttttgggaacaaactgtgcctttaatttctattcatattttagcacgcagtgggcagagaaatctctagaggtttctagaggttggcttgatgttctttgatcctttcatctactatgtggggactaaataaatgccctgtttttgtcattgactgccacattctgaacagagatgctagtttaaaataagagcagttggagcaacaagcaattggattttcatggtgtgctaaggcagtctgaagtccacagccctgatgggcatgaagaaataagagaacatagattcccaggggtgtttgaggttccttctactttattgacttcttccctttctccaataattgattgtaatatatataattacattttgacagctagatttaacaaaggttgatgtttctctgcttttaaggatttacttttctcatttatctgattgaccatgctgagatattcaattaagagatgattcttgtcatcttaatttagctgggaagagaaacaaaaggaactctgtccatttgccaagtgccctgaaagcactgttgagaccaaaggaagagaggatagttgcatgatctttggcttctctcagttttccatcttctcttccacttggtttgtcacttttatggattcattataactccactccccggattgttgagcctaccaatggttttcctgacctctactgtcttctgctttcaggaaggttaactttctgaaaacgttcactctccagctcgctgtgtctttacgtcaagcttagagtagtcatttattccctaattgcctctctgtagagctttcccctcagtggactgaagatcctgaggtgtaaggaccttgttttctcatctgtgcttctatgtacctgtcaggatggttggcccatagggactgttacctgtctcaatgaggaaacatggtgatgttatgctcatggccagaatctacagggactactcactgctagtcagaccaaacccctaatcttgaactgagcttcatttttattaatactaattattacttaaatacttaaagccactcaaagtatgaataatttataatccccacccaaagcttctaaacccaagtaaccatcccatagcctaacctccttttcctccaagccactcctcactggacccgtcacttgccatatggattttctctattgcctcatgatgagggcagccacccttgccaggactctgcttcttcttgtctccctaaaacttgctcatttgaagttccaacttatagcacacatcacccgccttcctttgatagttacattctccagtataattgttttcaggtgtttaactgttggttcttccatatgatttgcagttctttacaacaagtatggctttttaatattagaaatacagtgcatgtgcaatcagtctctcactaagcatgcaaatattacagaaattgaatttttgaatggcattcatgttcatttacttagcaagcattaaaactccaccatgtttccaatactgtgttaggaatggggaattcacagattggaaaaaaaaaaaacttgaatggcaggacagaaattggtcccttttctgtctctaatgtacccaagacatgcctctaatatctcctgttacattgtgatgctctgttagtgccacgtggacccctctggcttagcacctccaggatagggaatgggtttaggttcttagggtctggcatatactaggttcctggagaatgttgagaatgaactgttgagctggactacagtgtgatttgaaaaatgttatattagagcccgtacggggtactgtaagaggataggagagagggtgctcagcctatttttctgtttcttggccaaggttaagcccttcttgccaaatgacagccccatcagactgtatttggatgcagtttcacttggacagtaattttacttaaaccaatattggcagtcctcattcggtgggttacatttttgaggaggcactgtaatttagaagcatgtaagttggctgaactagggtcttttatttgaacgaggacttaaaacccatatttttatagaaaagtcctatgtttagtaaattttaatatacctattatgtagcatacagttttctaaggtttaacaatctattgtgtgatcctactggtgttttaatggtgactaactcatttataagatttacatagaggttttctaaagtgtatggaagaaactgttaacacagtggctatttctggggagtaggcctaatgtgccattcaggtgagaaaaaggatttctattttttcctgtaaaacttctgtactgctttgagtttttacttataatgagaatgttttacttttatataaaaatgagttaatagagttgatatgaatcccagtgaagggtaaaatgcttaagtagtttttggaaaatggctacaagctgggggagaaaatataggactatgagactgcacaggagttccccccaccccctgcaaagcagaagagttacctcctggagaaatggctgaacagagcagggggttgtagttggatctggagctgctgaggaaaggtcatcaagggctgtgaagcacatcaagtaggagacctcctggattaggtggcttgtggtgctgcttgctttcaaaaatattgggtttggccaggcatggtggctcacacactttgggaggctgaggcgggtggatcacctgaggtcgggactttgagaccagcctgaccaacatggtgaaaccccgtctctactaaaaatacaaaattagctgggcatggtggcgcatgatgcctgtaatctcagctactgggacgctgaggcatgagaatcacttgaacccgggaggcagaggtcgcagtgagccgagattgtgccattgcactcctgcctgggcaacaagagcgaaattctgtctctaaatgaatgaatgaatgaatgaacgaatgaatgcataaaaaatattgggtttgtaggtgtttgtgagcagatgagctctgtcagtgcaggctgctgaatgcatgggccacctgcactggttttatgcagtggcaaagagcaaatgaggccaggagggtcagcatagcttcaggtgctaggacttggcactgatcaaagcttttaaaacaatgctttattacacagacaatattttatttagttttttccccttacaatttgagtgaaggaaaagcaacactattgaacatgtgaaaacaaaggatacggagatggctaaatgaaggtgtatgttgaaggttatagcaggttcaacattattaaatcaggggtataattcatgcactcaaatatgaaaaagttttagattggatagatgcctttattcttgcctgttaaaatcaaaagagcttaattttacaatgttaatgaagtggcacttttttgagtaaacttaagtaggtcacaaatacatattgtaataaccttttctatgatactttaattacataaatgtaattataaaggatatgattcagaaaaataacatatttcaaaattctactatcccctccccaaattaacttccgtaagctacttcatacccatgaacacacgcacacatacgtagttttattgtgtcatactatatatatcttgcagcctgccttttttttttttttttttttttttttttgagacaggtctcacttcattgcctaagctagagtgcagtggtgcaaacacagctcactgcagccttgactttctgggctcaagggatcctcctgcttcaccccccaggtagctgggaccaacaggcacataccaccatgcccagctaattttttagagatggggttttaccatgttgcctaggctgaacttgaactcctgagctcaagtgatgcattgccttggcctcccaaagtgttggaattacagatgtgagctaccatgcccagccaacttgtcttttttttttttttaacttaacaatgggtttttcaggtcattacttatacttcaccttgtacttttaaatggttatagttttctacaatttgaacatatcatatttatattctacttaaatttgagaacaaataattaagctttcatccaacatgatttatacctgaagaagtcctcagggactttacagagcatgataggtatttcagcaattccatattctatgaactggtattgggagcatggaatgaaatgaggaaagggagctacaagtaacaataaagatcagcaaagggcctggtaaaattaattccaaatgcttattgctataactttttggccaaaaagcttattggtgtggctttattttaaagagaagtcagacctcatagatgatagctgatttatgaagtgtaaagtcctctttttctctttaagtagaagagcttttttttttcatcttcaccctttagttctgttttatcctttggaatgctcattactatttcttggaaaataactacggcaggaagggctgcttgttttttaaaaaaatatagcaagaaaactaacaatttgtggacataatggtcatgtagtttgaccatgattaagaggttattgaccagctatggaccatggttttattaaaatataggttacagcatgtaagactacaaatgaaccttttatggggtgataaactgttctgtgcttaccatttccctccccaccaaaggagcagtagtgtagatttgtatgtggactttgacccacacatatttggtgttctgtttataaatttggtaacattttagaagttgcattagctgcttcatagtggtcatttaatacaaagaagcctgtttagactcaaaattgaaaggcaaagagttggcatttttaataggtctagacacagttatttcttatgtgatctattttaatgaaatgtatttttagcctttaaatttagcctttaaatcactgaaatcttcagtgatttaacattttggctacattttttttttacccctttatcgctttgcttataggaactatatgtcttaaagcttttctgaatccttaaagcatgaagtatagttctggagccttgtaaaatgaatacatgtgatgtcacagagttttcatagcactttacgtgctgtcaattgcgtcggttaaaactgttacaagtaataatgtaccacaatctgttgaaaacttgaccttggaatttaccggtcctgcgaacttctctcctttactttccttgaagagtagttaagagtgtatttattttcacctgtgcatgccaaggatttctggcccagatgttctggcctaccagggaatgtgatctagaatacaagcttataaattattgcttctttttataccttattgtaatgtatgtggtttagtggaaaaatacatgtttctaattcactgtggcttctatctgcagactacctattatgagcctatcaatttacatatattattacaaaaccttacaatagttttgtaaggtcagtgatgcccctgtttaatacaggaggcaatagaggctcagagaggcatatagttgtctaaagttacagagctggtaagggcagagcttggtattcacacccagatgtaacagacctgaaagcacatctgtttcacaaactcctagtggactgcagtgagcgagttatagagagaaagagaatggatttaaaaggcagatggttttggtggctttcagaaccaattcagctgttactctgttagtcccaggtttcttatttgcaaaatggagtttctactgcccagctgtaggattattgtgaagattcagtggaaatatatgtaaagcctttgatacattgtaggttttcaacaaaatgacctaaacttccacccccatgccccacccaggtcaccctctgatgaatgtaggtgctagcattgaccagtgccctgtaaaatagaccatgcattttaaaacattttaaaaattaaaattcttaactcatttactatacacaaacacttattacagtgttcccattgtaggccttttgagggcaggacagatttcaatactggcagcaagtaatttgtagagggagtgttttctttgtcttttgaattttttgttttaatcccatctggagattaccaacatgtccaaaagttctcatggtgcctgggaccctgggctggcattctctcttggattcttgatgtagtaagctgttgaaagagacagggatgacttagaatgagatggcgctaggaaacaaatgagttaaacaatatttctctgatgatgagaatttcaaatgggctaacttgtgagtttacaaaaattttatttgtaaaacaagtaaatttctttgactgaaattttcttttttctctttaaaattgtttttaggatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtgggtgagtagtttttaatgtaactctcaatctgcaacttttattttagcacttgtttcttaaaaatatgcatgctggatatatttaaactaagaaacaaattggttctcttgttcagtagaactgaaaattaagttctttgctgattttaagcatcatgacaattggatagtctcatatcttgctgtaaaatttgctagttgtgcatttgctaggttaatctacttaagtgctaacaaggtttttttttaatcatccgtgtaatacatcaatttcttaatagattattagtaactgttagagaaaaacattttgttcagaagagaagttttaagcactaccacatcagctagctactctattgctcctgctatgtgtggatattacagaactgcttgcttagctgtttgtttaaaaaaaaaaacttgaaaagaaattctttgtgccatattttgttgattatatgttacaaatgcattaaaacaattactaaatttatatacctggaatgcataatttgatatatatactatttgtgaaaatagtaacacattttataaattttatatcttctgagtgttggtaaaataccttggcattcttataccaccatttgaaaggtaaagatctgtcagtggctacattatgatgaatctcttaatctaatcatggatgtattgtcatgccccctccccagaatttcatttgatgttatatatctgatatgatatacaacacagctatgtattagactttacttcccttaaaatggagacttagaagaaaagttgacatttttctatgaaaatattgctgaagtagtctgtaattgtgtatttgagagcttgcgaagaagacatttaaacaagtggtttttgaagaaatatgtgcatttatgtttctacttatgtgtgagttaatacattttataggcaccactattaaaataagaaagtcactagaagaacatattcagaatgttgaatttgcttttgagaggcaggacacacacattacacatgtttagtggaaacgctgaaatccttaactataagcatattataaatagagtcttatgcattccctgaataaaaaatcttaaatgtctttgaaaagtctaagaagcagctgtgatacccactgatgtctagaagatggaaatattaattgtatgcagactctggacctgagccctcatccactagcatgaagaggagttttaacggtgaagttgatgaggaggtttagctttgtatacccttatccttttacttcctcctctccctcccctgggagttggggggtagcctattttccactatgtggacttaacataggagatgctaaagtttttacgtatgtagtaaaaacatacattttcaaatgactgatcacatttgtttacttttcaaactgtagtaatgtacaacgccaatgtggggaataagaactgtggtctccagaaacctgttgaaagaacagaaaaaatcagaaaatgcaaagcaagctccccatctttttcaccaagtgcttcccaactaaaacacatttgtgggtttggtggaggcaaatttagaactagcctgtaaaattttgtcttctgtcatgacaggaaatagtgtcttctactttaggttttagctgttgactcttttaaaaattacacattttagtgtcattagaactattcataatagcaaagacatgggatcaatctaaatgttcatcactgatagactgcataaagaaaatgtggtacatatataccatcaaatcctatgcagccataaaaaagaacgagatcaagtcccctgcagggacatggatggaactggaagccattatgctcagcaaactagtgcaggaacagaaagccaaacaccgcacattctcacttataagtgggagctgaatgatgggaacacatgggcacatggcgggaaacaacacacactaggtcctgtaagaatgggggcgatgcggggagggagagcatcaggaagaatagataatggatgctgggcttaatacctgggtgatgggttgatctgtgcagcaaaccaccatggcacatgtttacctatgtaacaaacctgcacatcctgcacatgtattcctgaacttaaaagttgaaggaaaaaacagaactgaccaatagcatccttcaaaaactgaactaagacaaatggaaagtaacagcttttttttgatagaaatatcttatggttcaaaaaattaaagttcccaaaaggtgagtataggtcttcaaggctgtaccacttaatttttggtatctgaaggtggggttagtgaaggaacactgctctgtaaatttgatgacagtgaagcaaatggatactaacttatgtgcttgtgtttttttttctttttctaaaaatctttactagaaggatgtgaagttggtcattggagcgaatggggaacttgtagcagaaataatcgcacatgtggatttaaatggggtctggaaaccagaacacggcaaattgttaaaaagccagtgaaagacacaataccgtgtccaaccattgctgaatccaggagatgcaagatgacaatgaggcattgtccaggaggtaggtgtggatataatcactactgtgtgctgtgtgcttcctgtgaattctcccgcttcctaaccaccttcccttccaaaaataagtatttatctttgaaggaaacccaataatattggtgaggggataaagttttgttgtacttatttaaaaacaaatgcttcagttgtgaaaaatatgaagtgcatattttattactttcataatatcttaaacataacttaggagagtaccttagtaatgagctttctaaaatgagatttctaaatgtgttttggtggctttttctgcaaatgtaccataaaagcgggttcttacgaaatcaggccttcgcagatgttgctctgagggaagcggccaactttcagttgagaagagtttagattagaaaggtttatggagtctgtaaaatcatctgtatcattactagttgaagatgacaacttaaaataaacttgcccaaacactgggaggaataaacattgtcttaatgttaccacaattagccgtttctctttgttttgataataatttgtagaaaacagctactggtatgtgtgtgtttattcaaatctttgtagtaattgtgctgatttgcagtaattattctgtaataacaggattaggcccatttagaaattggaagagcacatagctgaggtgactggccgatgcagaatcagtaagttgaaatgtgggtctgagccctgtcactgtgctgtccctaaagcagtaatcactgggttacatttattttatcactagcggatgctacaatgtcattcgctcaaaatagaagagcaaaaaagaaagttgtgtttggaaaactgctctgtaaaagaatcataacttttgtttgccttcattctttctgtgggtgcatagcttttcagctttatgaccatagcccagaaagagaatatataactgcttaaaacaggtttatatccgtgttatgctgcctcatagagaatgtctatgatccatggagaaagacaatacttttaagactcgaagactccagtcggcctttgagaactattagatccagattcagaagctactattaggaaagcagcttttcctcttgaattagttttgcttttccttactggatctttgaaacaaagtttttttaggtctgcttttcactaacaaggatggttttgttcacttaaactaggtatttttcagtcaaaatataagaaaatgttttcttacaaaactaataagccacttcttggatagctgagagcatttaacctgcaaccttctccctaaaaacaaacttgatgtattcaggtattggaaataaagactttctttgttgtatattgtttacataactagcccctcccccattcctcttccagcaatgtggtcccccaattgtggtttacattaatagaaaaaattaaactgaaaatgctcctataacaaacatgctcatgtgtaacaagaggcaacacatttccctcccctccaaaactctttattttgacctagccacagtctggcttgagaattttctagattacagctagattgttaaccataatatttattgcatttgtatttttatgttatcaacaacaacatactgtcttagttgaatacaacttgatactgtcagcaatttaagttacgccaaaacaaatgcttatgtatcatctgctaatattctctttttgacaagccagtaacagactgatttaattcttactgaagttttaccaagttttacttattaggaaagactagctatagctctaattcttgtgtctacattttcagtttaataaaatcaattttatataacctttaaataggttttcaaagttatatcattttttactattttattgaaaggaaactaaatataattgttgagagaaatggcaaattattctgtaataaggttacttatatttaaaaatgtaggaaatgaaaactacaaaattagctttgtaacttgagcaccgattgataaaaattggcgtaacttccaggggagtatcctaccttgcctcaggtgagagagagaaaagttcctttcttcaataggtcatggcgactagtggaagaatggagaagaaagccactttatccctttttacatcttgatttgatttcagtgatctgctttgacaaaccatgcaaaaatgtaagtcgtaatcaggttgggaatacaggcatttttaagatctttgcaacatatgtatggatttttctcctgttgaagccaatcttaacctgattgcacacaaacgcagccttaagctccttcacactaaagcagcagcacattaaaatcagctgcttctgattactgaaaggcataagttagaggtcagtgtaatgctatagtcatcactatgcatataagatattacattgaaaactattaaatatgaaaacataaatggctttaagagtttttttttaaaaaacagtgtaatgcttagcctagtttttccttaactgttatatgcttatttgctttcttttttaaaaaaaaatcaaataatatctggaaatatctttagtagatcaatttacacttgaaatactcagtcttcattcccaaacttttcctttagatcagttgtcttgttttttcatttttgatagcataacctgtaaggtttcttgggcttttccaacaatcattcttcagggtcctggtctggagttatctgggtccctacatcgtgtcaacttgttaattcagtgagccctgacaagtcacttaacctctcttggcctccatttcctcatgtgtaaaattgaggatttagggggggataggtgatctctgaggtcctgttctgttctaaaatctgatgattctaggattaattgccaaaagttgcaggcaagttctgtggctgtcatatgaaggtgaggaagagacttggaaggccaggagtgtagtttcacaatgaaggatctgaacactttcccagtagctgccccctgcatttgccaagccttccacatccagcagctttcagcttcctacttcagggaggactctgcttggtccttcaaagactaaccaagattctttttaaatctgtacatgacctgtgacttagctaccaatatagcagactgatttatggcgaatgacagaagagaaaagggtgcataaaagaccatggaaaaaagagaggccaggcgcaatggctcacgcctgtaatcccagcattttgggaggccaagacaggcagatcaagaggtcaataaatcgagaccatcctggccaacatggtgaaaccccgcctctactaaaaatacaaaaattagctgggcatggtggtgggtgcctgtagtcccagctactcaggaggctgaggcaggagagtggcttgaacccaggaggtggaagttgcattgagccaagatcgtgccactgcactccagcctggtgacagagcaggactccgtctcaaaataaataaataaataaataaaataaataaataaataaaagatggacaatgaaaggaaaaaatattgaacactgagtataggaaacaagtggaaaaaaagagtgaatgacttgaaaatgaaagctgtacccatggcagatataactgtctccactccctttgccctctccctgagtatactaattaagaaaatcatgttgggaccaatttatgaatatataacctgaagctttaagtggaaagaatttcaagtctgggccatgttgtacattagggaatatcttaatacaaaagtataaacttgctttttgtcatatatttaaatgacacatggaagaacaaatttgtgattgctaaggtattatgttggaggatgttcatgtacaagacaaaatgtcatctgtaggtggctgtggtcttctattctttcacaggaggattgaccaacatcatgatctcaatctgaaatattctgtcctatctgtgtgggactccctgctttctttgtcaagccccatcacaactcattttgttaatttatttcatcagatacttgttgagcactgctatgtgccaatcataagtctaggcatgggattgctcaaagagtccttagagagctttttctagcaggaatagctgcaataaagaagtgggtgatggtacataatctcatgtgaagacaagggctgtggagacaagtaggacagggagctagtgaatgggtcagggtatactatgttatgtagagtgatcaggaaaattgaggaagttacatttgatcagagatctaaatgagggatatactttgaagctttaagggaaattttttttggagcatccttgattctcctgccatattttagggaagaggaaagaactgagctccatggaggctctgactggtccaaagtgatacctaacaagttactagtggtagaaccgagagtaggaccatcatcctgctgcttaggaaacctgttttcctgtgctttttccttggtctttatgataaagaccaaagataaagccatggttgtccaacattaaacttcccaacttttaaccatttctccctctatgcagaaatatcattttacttttgctctacaaatgcttttaaacaaccctgccatcgccatcccttccaatttggaatcactggtgaaacatatcccaatggtcattgcataagggccaaagtgttgagccactggccttgttttgattcagctttccctgtgaaggccctactctcctttagagtcattggtccttggttggtagtggggggaaatgtggcttcaagattgtagttgccatccctaatctttcaaagccagccctctagaggagactgccttgtgtggagccacatccaacattcatctttgaccattgctccttggcctacacagaagccctgggtaacctgatccccatctccacatcagaaggctctgtgcctggcatgtttttttccttctgacacatttcaactatcggactcttaaagtaattaaggtgatgctttgtcatatactgggatagctttctgcctcttttgctcacagctgcctcaactcacgatagtgcagtttttagtaaccacacagcaattctttaaactccagtcacattttcttagtactgtgctaaatttaagtatgaaatctgctactgtatactattttaattttagggtattctttctttcttcaaaagtggttcttggtaggaaacaaaagaaagtattagctacttagaaccttgatctctgcaaaaatctacttttaaaaaggtagtagtagtaagacttctccaaacctatgttttttcgtgtgtgtataaactgacagcaacatgtggactacgtattaggtaatatgactaaagatggttgtagattgtgatagattaaccccagagcaggaaataagcatatttttcaatgggacagggtcaagaaaatatgcgatggacatatgttctttatttctctacattttgtttacatttgagtcacaatttatgtggtctgctttatacatgtcaccctaaagagtagtttggaagagaggagataagagagaacctcttttcttttagagtttgtcaagaatgtcgatattaaaatttttatgtgaagaagagagcatctaaaaggaaattcttattgtctttctgtttgctatgataaaagtgttataatgtctgtctgagaaatcaatgatttgtgttagtcattttaaattaagcaagttatactattttccaggtactccggctacatggaagctaatcataatatgtgtgtgtgtgtgtgtgtgcatgtgtgtgtgtgttttaagtgattataaactgggagggtaacccataagtagccactttgaaaatgttagtgtataattattaagttggtgttaaacaaagatccacttgcctccaaacattcctttaaggagctaaagtgtctgaaattcctgcgtcaggggtctgaacagaatcttaagaggaatccccttcctctccccagcccaccctcactttttaaaatatttttacttgtttcctgaaagtaggtagaggataaccactggcacctggtgatggtggtggtagtttttcttttcaaggaacgatttcttgcagactgactaattttcacatattggagggtaagggtctgaggaacatcaggggggcagaaaaggggtctccaaattagattcgctcttgggcatagacatggacatagacataaatataaaggggtgcaaaacactcagaacgtggaggatgagggggtggacatgagacaacttcttttctcggtttcattttgagacaatccgaatgccagccttgcttgccttgggggccgggagtgagtgaactctagtggaggaagacacacctttgtgctgttctctacagcttcccatctggaatctctgccagccccatttcaatgtagtctggggcagcacgtactagtctcttttatgggtacttgtaaaaagaatttctcaactacatatgccactgaagacccaaagttctatgcagtaagctactcttatggtaatataaaatatataaaacattttttatgacactccaaaataaaaacaactttaataggacacacatggtgtcagtggtagatatttttccccctccgtgcaggagactcgtttttcccttttataagataggaatgtcttaagtataaatgtcctaatcattttttagaacaacttattctcagttgggcctggtggctcacacctgtaatcccagcattacgggagcacaaggcaggaagatcctgaggtcaaaagtttgagaccagcctggccaacatgtggtgaaactctgtactaaaaatacaaaaattatctgggtgtggtggtacatgcctgtgatcccagctacttgggaggctgaggcagaagaatctcttgaacccaggaggtggagctgaaatcgtgccactgcactcagcctgggggacagagcaagactccttctcaaaaacaacaacaacaacaacaacaacaacaacaaaaaaaaaaacttattctccctatcgcctcatcacatacttctctgggatctttaaatggtgttgataaaaagagcagtcaatttgctcatctagatttcctgtaatacttctctagctactagattaacctagagctgtatgtgtagatatccttcactatcagaagacaaacattttagtgaaaagaaaaacagaattttactaaaatctcagcatgattcatgtcatcatacagaagtagttaagatgataaaattactttgtgtaacagaggtgtcaaattttttttttttttttttaccattaattaacctaaaaatgtaaaggcagtagtttttgctttacaactgacctgttgatatgatactcagacctaatgttactttgtgttaatactatcatcttgtgtttgaggactttggaaactaggagcaaaatagttgagcttgtcaagagacgtttaataactgatgctgtgtccatatatcctgcccattactcaaaggatttagtaagaacttaatgtacaaagacataagataacatggtaaaaaaaaaacaccccaaaatgtaacctattaaaactaggaataatttaaattagaataagagctcaggcccgaataaaagaaaaaataagctatttagatctgtgttggttgaagtaattgagccaaaaatttgactttaggtttgctaccaggcaaagggaaaaagtagacatggttctaggttgatttaaaataagtgcttgattttaaaatatcaatttaatagcagcttttagaggggaaaatcacatatgtatgtatctgtttatacacaataaacacacatgtatggtacatgtacacacatgcacatatatacaaatacttattccaatttcagacacattaaagtgtgcatgtgttcagggaggtagtaggacttatggaattgaggaaattctcacagaaaaaagctcagtagggaggcaaaagctaaacacatttctgcagtattagacttctcaagtggggaatcacatggtggacgatgtcgtcacaccacccatgtcacatacatgcttccaaaaggtagaaagcagcttggcgtttatccttggatgaaggctgaaggtgtgactatgaacttgactcaatagtggcatgagtaatactgattcaggactttaaaaaaatcatataaatttaaagggtacaagtgcaggttggttggtgtattgcataatggtgaaggttaggcttttagtgtaaccatcgcccaaataatgtacattgtattcattaagtaatttcctattccttagcctcctctcaacttcccaaattctgagtctccagtttctattattccatactctaagtccatgtctacctcttatttctctcctacttacaagtgagaacataagagttttctgtttctgagatatttcacttaggataatggcctccagttccatggaatcaaaatgttttgacttatcagttgttttttgctgtaatcacccagtaggctattttggtgaatattgaatgcctttggaacttcatggtatctagtgaatgcaggaaatatgtagatctacgtttatagcagtacaattcgaaattgtaaaaatatggaaccaacctagatacccatcaaagagtggataaagaaaatgtggatatacaccatggaataccactccgccacaaaaaaggaatgaaataatggcatttgcagcaacctgggtggagttagagaccattattccaagtgaagtaactcagaaacaaaaaaccagatattgtgtgttctcacttataagtaggagctaagctctggggacacaaaggcatacaaatgaaataatgaactttggggacttggggggaagggggtgagggataaaagactacacattgagtacagtgtacacttcttgggtgacaggtgccccaaaatctcagaaatcaccactaaataacttatttcatgtaaccaaaaaccacctgttccccaaaaactattagggggaaaaacctccccaggtgtttctaatatgcaataaaatttgaaccaaaaaaaaaaaaaaaggtgcagacctattatattgcagggggcagttactcttcaaacttgtcaataaatatgtattttctaaatagatttttatttatttatttatttattttttttttgagatggagtcttgctctgttgcccaggctagagcacagtggtgtgatattggctcactgcaagctctgcctcccaggttcatgccattctcctgcctcagcctcctgagtagctgggaccacaggcacccgccaccacgcccagctaatttttttgtattttcagtagagatagggtttcaccgtgttagccaggatggtcttgatctcctgaccttgtgatctgcctgcctcggccttaagatattcttaaataaggtcaggagttgcatatttaggtgcagagttatttctggtgattatctcaaggcctgcactcatatttttagataaccttttgcaattttttgttgtttcctctccaaggctggcctttgattatcttaatctgtgtcaaagctatttgttatgagagaaccaaggagattttgagtaaatgtttaccgaattgcattgacttttaaaaaatatgttacaggatgccttccaatttctctttcaacctacttccccaagataatccagtgttggagctgggatttaagcaatctgtcatttttctattgccgtgtctttaggtccattgaatcaattaagcatccattacttcctatgttctaaagaaatgggaagattgggaggagagagtgatacaaacaagagagtttatagccaggttacggaataagaaaatgcacattaaagataaaaggcaaagcttaatttttaaattattgagtgtcaggtaaagatgacattgttacaggctctgatactatagaacaaaaggtattgtttttagctgccattgccagggaataggaatagttcctgaagaggataacttatattaggaggagtgggtagaaaccatgtttaaaaagggagatcattttagacagaacactgtgaggaaagatacaccagaatgtgcctcatgcacccaagggaggtgaagcaaatgaacctggccgaaacgcagaatttgtgaatggcagtcacagaagctcacagaaaaaaatataagttgcagcctgactgaagtgtgtccatggagaagacaaggagtttgaattttaccttgtgtactgtggagagctatgagacatttgagtgtgaaggtgtttcagtagaaagctgactgaagatggaagtgactgaaatggtgttgctaaagtgttaggaagaggatcaactgtacatccctgatttagggcagagcattaaacagagtctgagtctgatgagagaattagcagagaatacttacgggttctgatgtttacgtgttttcctgttgtttgcttttctaaagagtggaggattttgccttggcttgtggtccactgtggcccctgtatctcttttgccaactttctaagccaggccattctctagtttgtatttgtacagttttttctttttctttttttgaaatctaggcacaatttgctttcaccctaagtgaactatatttgtttctaactactactttcatctgccatttaccaagatccttggatgtagtatttcctattttctagcttgccatgttaaccttataatgagtttcctgtactagccagcttggagtactctgaaaatttaatgtacacaaatcaaatattcaggtcaaggatgaaaatgttcctacaaagttcaatttcaattgtataatctaacatggttttatctaacatgccgctgactagcaaaagcagtgtcctggaacattgggttgaaaaggattctgagttaaatgctgtgttcaggagaaaaccatgtagctaatcagtttgcagtttgtggcatgaagtgagaagcaatgtattttgtattcattcctctgaattctaatcccttgaccggttctgcttacagctcttcctgctgccttctctccaaccttacctacagcacacacttggacatctttgacaaataatcatctagcttttattttttaccttcagtgatggtggatgtctttgtatgttggaaaaaacagaatcgggaaatttaaatggggttttaaatttggtatatggccggtcttgactacttacgggttgaatgacaagttattttatttcccaaagcttagtcatgtatgacatgtaatctcaataagattgttgagagtagtaaagggacatgcatacaaacaggtgagttgttactattctgttacattttgttgtaatcctgttgttaattatacaatatttttcacatttttcatctttcttatagctggcctgtttttgcctcttcattctcctttaatttcggcctaccttgtggcttcaactatgattcagacatgcaccttccttctgtgccccagtcccacaggtttgtccgttcgtgggcacctctccctaggtgtcctgccagcatgtgcaactaagcacagctaaactgtaactgtctttgcaaaacctcatttctcctgggacagcccccctttccaaaggcatcactagtcttctagttactcaggcttgcagtcctatctttgaatcttttcctcacattcagacagattggaagtcgaagatttgcccaaccacctaaaatgtatgaaccagacaagtttacttaatctctctaaacttcagtgtcagcatctatgttacggggataacagatgcttgcttcacagggctgttatgaggattaaaggacatcattcatactttgcctagcacagagtgaaggatcacaaagtgtgagttctttaaataatgacccacccagtcttacatctcagtgctccacacatcttcatttttattgtctctactcaaagacttttaattctctttacctagaatgttgctataacttttgttaggcagagggagcaaatattcatttgcatttcagcaaacagatgtgtcaacatatacaaaggtgaactcgtttcacctcatcgacagtgtaatctaggtggtaaaattgaaacattaaattttaaaaatggcaggaagaggcactgagcctcctgattagcatagggcttagaacagaggaagcctcaaatgttgaaaggaatgagggttgcaggatgaacagggcaggctaatggtggctgaggagatgagacttcagaatatagacctggagtatgggacaattgaataaatgaaaaggagggtgaagggaaaagataaactgagctaaaatatgaacattgggatgtatacagcctaacatttactaaaatatagagaacctgttgaaacaatgcatgtgttacgtagcaaaagaataaaaattggggcatacaatagaaataaggaaaaagaagccgagcacggtggctcatgcctgtaatcccagcactttgggaggccgaggcaggcagatcacaaagtcaggagatctagaccatcctggctaacatggtgaaaccccgtctctactaaaaatacaaaaaattagcccggcgtggtggcagatgcctgtagtctcagctactcgggaggctgaggcaggaggatagcatgaacccgggaggcggagcttgtagtgagccgagatcgcgccactgcactccagcctgggtgacagagtgagactctgtctcaaaaaaaaaaaaaaaaaaaaaaaaaggtaaaagaatgaactcaggagataaatcaaaatctgtaagaattggttaccaaattgaatctcatagattggccattccagaagaatttgaggtttacagaattcacacagggaagaaaaagtcattgcccatttgtgatgattcatttacaaagatatttttcctttggaaatttaattccttaaaccattatatattagtaattcaatcttaaagacagcatggggcttgtagaagagaaggaaactctaggcctagagtttatcactagtttatctagtgataaaactagattttctcagggtttggagagaggcctggcaggtagatatctggactctcatccttggttaaataaggtagttctgtttttttgtttttctctttgacatttcagggattttgtatgcatgagtaaaaagagcatgtcttcctataaaaacagaacttcaagatgcactcatttgcatcccttcctttacagactggaaactaaagtgctgagaggtgaaagagtgaattccccatgatgatgatggtagatgataaagcaaagcttaattcttgctttgatgttaaacctagagcactttctcccatatggcttctttgtctttcaacccataataatccctgagaattgctcagatgtaatgcaattaagattttttttgtgttatggtatagaagaactgtggtgattaagctattatttttgcagtgtttcctctcaaaagaccagtatgaaacttggcatggactgaattcagtaacatgtctcctatttttggtggactctgcaagattctatgatataccaataaaaagttatctttaagtggcttacaatctttcatttggatatacaaattatatatacttaaatatagtataaggtggataagcacatgatatgtacctcagcaaaacttattttatcttgaattgcccctataacattttattcagcagttattatctttccttagtcctacgagaaaattttcacagattttctgctcactttttggtgatacaatcctattagtcattaatgcaatcttaatttagttattagaatgtctattccaagataataaaccagagacttgaattataagtttgattattaccataaacttagaaaatatacaaaagactttggcttatttgaagagtctattttgcaaaatactgagtgcttatacctctttcttgaaaactctaaaagaaatgaacctctaaataaatggtaaaaggaattgagtactaatccaggtaagatgtgtattgtgtaagctcccgtccccctctccctctgttcttcttttcatcttacgtcaaaacctgtggaagaaaaccacatgcctgtgtcttgcatctgtgcacagattccttgtagtattcttgtcttttacatggtgagagtgatattgctaacttgagtaatttaaagtaattttggcctcaaatgtcaagtgtctgttgcatttcagatcttcctctatttggtataattgtcaactctaagtgtgcagattgacttaatatagtcatcaaatatgctttgaattaagagttatttgggttgcttctgcagctgtgtttgaagcagtgtactctgtgttgccattaccagtttgcttctactttatcagaaacataagacctggatatcccaagaaccgctacgtgaaatttctccaccaggcgatggcacgtgagcatgtctagttgcaaaactataacatcagtagtagcctaatttgaaccgttccttttataataccttgcatttattaagaacttgctcaaaggagttcaagcaagggcggtgacctcttaaacacccatatttcaaagttttttttaaccatacagttctcaaaatgctgatattttatgtaactttcagtacttagtaacattattccacaatcagtattatgcaatgaacacataaagattgaaaattcaaaaatatgtgatcacttattgtgtgtgtgtctgtgtgtgcgcgcgcacgcacgcatgtgtgcatggtgtggggaggagagggaataagtattttcagcactgcatttaaggaaatgttcaatgttgggctcggcattttgtttgacagttgtcacattgttttcattgtctctccacttttgtttatttccctgctgcttaagcagcctgatgaaatctcatcagctaactgggactgaattttgatgagtgtcaagttgctttgatgaaatctactgtaatcatcttaagcccaactttatttggctttaatgctggcattttccatattgagaaaattagtgcatttgtccgctactggagttggaagcccagtaagaaacaaagatagtcaaataaaaacagcaactataatttaagttcattttatacctttgaatgcatggacaagctagctatgaaacaaccttttttttatgttttagcatctgttccttttaacaacaataacaataaaatcaggattagttattagccaaaagtatttttacccatgaacaactagaaaaagcaaatgtgtagttcctattgaccagaaaaaaagctttgctgtcctgttatctggattttcctaagaggggcaaacatgattttgtatttttatactaaaattcaagatatttaattttatgaacaaagaaatttagtttaaaatttttactttctagtgctatttcaggctacaaagtcagtgctataagagaatcaaaatatcctaaacttagatctttattttagatacttaagatgtagaagaaattaagcttgctgaaattttatataatgaaactatgtgataacactgtatctcttaggagatcattgtgacaatttcaagaggcgtgggcattagatcatagcactgcaaatggtttttaaaatgttaacatgggctgaaataagatatttaggtgttcagccagtacattttactctcctaatataggaagtcagcaaccttctcctttccccagggcttctaaatcaaatttgtcctggggctggaattggaagagaccctacttttagggtaaccatgggcagtttagccacccttggaggttcttggggagaccagggctgttgtctgaacacttagagattattctctgcttatctcagttttctggtttcagttgattctcttaagttactatcgaatcttgaccctcaaaggctggcacagaacatcccccctctaaaactcctacagatggtggcagtttatatgaaggcagataattggtggcagttctgtggtcatgggagaaagttatatagatttctgcacaatcatgagactttctagaacctaattcaaatctttcccttttcatgtttttttcctttgtcagttttcagtgggcctaacctgatttatgaatcactaactataaagaattcacttcatagttttactacattgtttatagagtgttcaatcaagaagcacttcagaattacaccattaccaagtctgctcactgtgaaaccaagcagatttctgcgtgtgaacagaacagaataagcaacatgctgactctcactggttagatttattcatggtcagagtggtctcttatagtgatacaaatttcattttattttatatcttaagtaatttatgatagctttcatttatgtttaagtaaatatctagccgggggctatcttaatggattttacagaagaagccccaaaacacaaaaatggtctacatttattatgtatagggtgtagaaattgcctttacataaataacgttagaatttacattttgcagtgatctattttttggcacccatttattagtctgttatcattgcaatctagacaaagcatctaatgagtctattgtaacacccaagttcctagaccttcttgcagtttgatttagaggaaggccaccatagagataatttctaaatgaagaatgtaggaaagtgatttctaacagctctgttctgagcctcatttctggattctgactgattgtgtcacagccccagatgaatctcaaataattatttcagagtcgggatatgattggtataaggtccacgccgatccaccagcctgaaaaaaaaatcagtgaactatacatttttttggggggtaagatgtgtggtttttcattatagcaaatattttaaaaccatgagctgtgataatgaagtgattcaagatttgaaaaggtatataaactgctacaacagagattaaaaaaagaaccaaatgctgatagcagggaactcaaaccgctgattccaattgtttgaaggttcataaaggggaaatataataagcctttctaaaacaaaagaaaaaaactgtatcagaagggagctgtgattgatgttttcatcaatggctaaaacggttccatttttccattttttccttattcatctattggttaaaattttgcaaatagctgtttccattaaatgaattttctttcaaaattgtgcttggaaggggttctttagctttccaagttctttggtttttgaggacttgaatctacattgcttgctagactctacttcaggaaggggttttgttgaggcagatgctaaatggccttgggccaagaagctatgagccaagcattcactgggagttgaagctttccttagagaaaaagaccatctgactttttaattagaaaactgctccagtccacacctcagtgtcatctcttgggactcctaaaccagaatctagggtagctttactagtgtttttcttttttaaaacatgcaataaaaatatagaaccatagccaggggagggatggaagggtaagggggtatgtctcaaggggttgataacaggattagaactttgtagaaataatttgcatttctggctagtgtctgttaataaaacacacatacttaacttggctggagttacgaaacctggtgttttacattttgagttcctttaaggcaaaatccaacactttatctgctaagcagaaatgaccacctctgagaaaatttaagaactagccctcagcacaggaagaagtagactagtttgagaggaaatccacttgagatgaagcccttagccagttcagtggcaaaggcagaactttcttcaagttgttggttggtgaaattgatgatgatagtataatagcaaaatcaaagggatctagggtggctgcagtctataactttgaagaagctatgttctgctctgctgacttatagggcatcagttcagatctgttggtattagatatttccttgatgttacctctggttcaaagatgatattaatattaagcaactataaatttttaggagcgatactgtttaaaataaaccacacttagctaaaataggcattttacttgccagacagtcccagaaaaatcaaggatttttttaaaattaccaagctagtagcacacactagactttgagattctagatgttttttttcttgttatgttgccagaatgcaggcaaaacgcttggcatttaacttgccatcttctgcctgtggttctatacaagttgagaaggtgctttatgggggtcagtaatacaaatgttacaacaaacttctgaactgttagtactttactctcagcaattcgagctgtgctcttgcaaatattcttcatttttaagttattgaacagcagaaccagagtcaaaagcacagtagagacagccttaatgttaaaaaaaaaaaaaaaaaaaaagataatttaatttatttaaattgtcgtttggtgtaactgtcccataataactttttcatcattgagccctttggtctagtaacttttctatattttttcgcttgttctctcagcttgtgataaatcagctataccactaggccatcaaatgtattcaattttagaagaaaacacttcacaattgtttaaaaatccagagtattcacatggggaaagtgtgggaggtttcaagtttctgaaacattctgcagaaaatgaagtgataacagttcctgccggtggccatatgactcaataataactggaaggaaaaaaaaaatgtttgtttagacttggccggagttaataacaagcaagaattatcttatttttgctcataaacatgtttcctttcttcagaatccctttcctcatcttttgtagatacttcaggctctcctgacacctggcttcgctcttggagggatgttcaaaatgtattttgtgctgattcaaggctttattttgattcctactattcattaaaaatgcaataacagaaaaatctcatttttcttgcctcagttagcctgcgctatggcaaaatgtgggtagcatttgtagtaggcagtccaaggttgatgtctggaaggttttcattttaattccaggacttaactgcctcagttcatcaaaatgctttactgtttatggttgcagaacgcatttggcaccaacatgtgctaacatgagcttttgttgtgtttaaatttcttcccagcttggctggccagatctttattttattttggtgcaaaggcacatctgtcacctgtctcctcagaggttatatgcctcttgggagggactcctttttactgaatctgtgctttatgtttagcttccaaatactttacatgtttctatagccaccaccaggtgagccacccaatttttaatcgacttggttgatgggctggggaattacagtctgttttattgtatttatttattttcactaagtgggtgggatattacagctttaataaatgaccttttgtgttgtgagcagagagaatgtatattttgacaagaaaagcttttatttcaatatgttaagtaattcttgtaggaattcataaatgaaagatttaagataacgtatttgaaggagggaggctgaagcatttgcctgggaaaaggtggatagttagaactatcacaaggctgaaattacatgagtatttctgggttaattttaatgtattaatattttaaaaactaaattcacaaagactttaaaaagaggcaaaatatttgataaacataccaagaaatgtagcaaaactaaaatttttagcttaatgtggtgataagacttctaattttgtagaatgttttatcctaacttgaaatttaaactctaatgtcactaagtttttatgttatcggagtgttatttgatacagcacttttatgctgcaatttcatttcaaggatattattgtggacaggtttaggattttcagtagactaacaagaaatatttatatataccccatttgttcagtgtgtgtatatgagcaaattgtgtattttcataactggtctgctgaaaatattgatggggagcactacctgtatatggatcaaattcatttggtgaagcatccagttactaaaaattttggtgagagtaactttacagaaaagccgtaatgtagaattgcaaatttagatatttggggtaagaattatggtgattcttttgcgatcagttccttgatgacctggcatctctagttgatgccaatctgttccaatcttgacaccaccttggggctccacttctggccaccttcttctgttgctctttttttttttccttcaaatgatggaaggtataatagcaaagaaataaaaagagcaagggcagcaaagcagtgtacagagaggaaaaaaaatgccttcagattttcttcccaggactaccacttaataactatgtggacttggacacatctctgatactgtggagactgattatggaactgatgttgcaggctcgtgaggtttaacattacctgacttcacaatatgttacaagtccatggtaatccaaacagcatgtattgctgtaaaaacagacacatagaccaatggaacaaaatagtccagaaataaatccacagacttacagataactgatttttcagtacaagtgctaacaacatacactggggagaggagagcctcttcaataaatggtgctgggaaaattgagaatccatacgcagaaggatgaaactggaccttgtctctccccatataaaaaaaaaaaaaaacaactgaagatggattaaagacttaaactaaggcctgaaaccataaaactactagtaaaaaaatagggaaaacactttaagacattggtctaggtaaatatttcatgactaagaccttgaaagtacagacaactataacaaaaatagacaaacgggactacgttaaaccaaaaagcttctgcacagccaaggaaacaacaaagtgaagagacgatctgttgaaagggataaaatatttgcaaagtatttgaccaataagagacgaatatccagaatatgcaaagatctcaaacaacaataaacccattagaaaatggacaaagaacatgagttgacatttctcaaaagatgacagagaaatgcccaacaggtatatgaaaaaataccaacattactcatcatcagaaaaatacaaatcagacctgtacttgtacctctgaatttacaagttaaaaacatgtaaaaataaaaaatccaaaatgagatatgatctaaccctagttagaaaggttattattaaaaagacaataacagatgctggtgaggatgtggagaaagggaatgcttctataccattggtggaaatgtaaattaatacaaccactatagaaaacggtatggagagttctcaaaaaactgaaactaccgtatgacccagtaatcccactgctgggtatttattcaaagaaaaaacagaataacaatggatttctgtgtgattttcttcagaaatcaacactcatctgtttattgcagcactattcacaatagcaaagatatggaatcaaaccaagtgcccaaggatggatggatggatgaaaggataaagaaaatgtggtatataaacacaatggaatactatttggctataaaaaatgaaatcatcattttgcaataacatggttaaaactggaggtcattatgttaaataaaataagccaggcacagaaagacaaatatcacatgttctcatatgtagaagctaaaaaattgatctcatgaagatagagaatagaatgatgggataccagaggattggaaggatgtgtgggtaggaagggaggtacagagtttggttggtgggtataaaaatatacataggtagaataaataaactctaatatttgatagcagagtagggtggctatagttaacaacgtgtatatttcaaagaagctagaagagagggttgaagtgttagcaacgcatagaaatgataaatactcaagttgttggataccccaaataccctgaattgatcattacacagtctatgcatgtaacaaatattcagatgtacccatagataggtaaaatattttgttatcgatttaaaaaaaatggtgtctgcaccatttgccaaatgcctccggctatttaattagtgtgtggcaactctttcagctgacccagggtggcttgctaagacactagagctcttcagtttccataaagtagtattgttccagattcctagctcctcagttagacaagtgaacctaggtcctttattcatgaagcatgaagggcaccattttaccatccagtagagcatgattttgtggtagagcatgattttgtggctttggtgcatccatcctgagccttcgtgtcttcttattcttcctatctgcttgatttactgtccccactggcttgggcagttgtctctaatttctattagagttctggccaaggtttccccaatacctgacaatcctcccaggaggataagaattttttacaggacccagtaggaagccatgaggttacaaaattctaaggtaaatatttagattatatccattttattcttatctcataatgcataactattgggttattaatatatatcttctgaaaaaagtttaaaaattagcttgaagatttacagtagtatgtaatttttatctgcaactgtataagacagacactcccagagtgcaagatctccccatgggaatgcattctcttagggctgttccttgctgagaaaaagaattcagcgatatttctcctattcacttttgtaagaagagaaatactattctgttctgtcccgccccgcaggcagtcaggtccaatggttatctcccttgttccctgaaaatcgcagccatcctgttccttttggatgcccagatttcatattgttcaaacacacatgctctacaaacaatttgtgcagataacgcaatcatcacagggttctgaggcaacatacatcctcagcttatgaagatgatgggattaagagattaaagacaggcataggaaattatgagtattgattggggaagtgataaatgtccatgaaatcttcacaatttatgttcagagattgcagtaaagacaggcataagaaattataaaagtattaatttggggaactaataaatgtccatgaaatcttcataatttatgttcttctgccatggcttcagctggtccctccgtttggggtctctgacttcccgcaacagggccaggcatggtggctcacacctgtaatcccagcactttgggaggctgaggcaggcagatcacctgaggtcaggagttcgagaccagcctgaccaacatgaagaaaccctgtctctactaaaaatacaaaattagccaggtgtggtggcacatgcctgtaatcccagctacttgggaggctgaggcaggagaacggcttgaacctgggaggcggaggttgcagtgagccgagatcatgccattgcactccagcctgggcaacaagagtgaaactctgtctaataaaaaaaaaaaaaaaagggaaatgagaagatgctttgtatgtaatgagtctggttttttttaaggcatacctaaactttttaaagattttagtacattctgtattttggattattttcttacaatagattgaatagtagaattactgtataaaaggatgtgattttttttgccaacatatttatattgccaaatggctttccaaaaagcttgtgtttgttattatgctaccagcatgagtactagccttacgacatcttgccagaacttaattttgtattgtaaaacataattttataaaacaatacttgatctgttttcagtcatatttatttattaatgaggaggattcctccttcatttctttacaagttgcacttcatttttttatgaattgtctttggaactcttgcccaccataggcaaagaacatgcattccttaacaggtttaaaaaatatattaaaaatgtggttattttattttttaagatgagtgtccaagacttccacaatgacaaagaactttgaatttttcagagctggacaacttaaaactagattattgggtccaagtacaaggtctttaatttttagatggattgaaataagtccaaagttatactaaaaatgctgaatttatagactgttttgtcgtacaatgatagttttagcttctgttcttgagttctaagctttctaagtcttgagtgttgccagctaaggcaaatagaattgaggacatgtcaacttgtttttgaaaaattgctttaagaaaaagaattttaaaatattcctgaggtaaaacttggcatatgtgcttcaccagaaatctgttcatgggtttcatcaatttttagcattgttaatgtggtggtacttaaaacatttttttacataaacacacacacacatatagagagagggtgataaatttatatatataaatgggtgataaatttaagaccaacatttttatgagcatagaagtaaatgaaagagaatggataatttaaatatgtgtatatttcgtatacaatccttttggccagttacttttcaaaagttgactatttttgtgttcttttacttttatagcaggctcaacatgtgcatggactaggttgtaatgctagaaaaatgatgccatctgatttcttatgctgatagtgacatggttaatttaaactcgcatcagattggagaggtgtacctatgtataaggaaagactccattaggcagtgttgatgagaaagttgcatcatggctattagtctttttatgatggaataacataaacaggctaaggaagataggctggtgttttggtgttctgtagggatagagagaaggctctctaggatctgtcctttcagccacccacataaagtagacatgaaaagcatactaatttctctatcttcttgccactttcttatcccatccccttctagtacatcaaagttttccaatgcagatttagcataaggtttcagaaattacagactgtgtggatgagtgtccttacaatttcagctgatccctcaggccagcttaatgatcggttaccttgctctctctctctctcatttggcacagtagttattcctaaacttgactgtttcttttcagtagatgatgttgttttctctttatgacagacaattggaagtcagcaccctcacctttctgcccatctgtatatctttaaacattgtaccgacttgtattttcttgtgaaagagataaacttttttcttttaaggctaccccaagcattcttaggccttagctcttcttttccaagaggatcttatttacctgttatgacctgtttattatcttttcctccttttctctaccagctctttctgcatgtcgttattactccagcgcctaatcttcatatttccacctggttattccacatgtatttcaaattcaaaatatctaaaatgacatctaattctctgctcaaatgggctcttcagcctactatgccctattttagaaggtggtattacctccctactcactttagccacaacctagaagtcacccgaaactcctccgagattatccttatttcccatatacatttggtcaccaattccactggattctaccaccttcacaacttgttggcttcttcctctcttaacccagctctactctttcctctctttgcctaccttgactacttcagtggtctcttaagtgatcttttctctaagaccaactctaggagaataggtatttattatgcaaaattataatctttaacttcttctgggtattaccttgaaacaaccaattacgcacctatatttatcatgttgccaagatcttaagcattaactgtattttggagatagtcttttaaaaaaaacatacattgcatttattctattatggtagtcacttgactgtaaattttcaggtaacttgttaatttcttgttaatgaagtaaacaaaagtggaggtagatgcacatgccaatgtataatatggggttgtcttttgtcattcttaatcccctctccattaaatataccccatacatacacaaggaacagcttacctttgtgtgtacaatatcttaggaatgtcagaactgaacttaagatttaatatctggctatatggaagtttctctgcttgacaatgaaaattagatgaatgcacttttgacaacctaggattttccttgctcttatagtacagaactactatgtagtgagtgccattaaatactctgaaacttacatccgttggttgtttcatgttacttgttactagttttgtgtaactggacgtccacagactttattctattttacttgattttatttttctattttttagtacaataattcttcctgtgccttgatacaaatgattcagttaatttcgtgagcactaagtgtccaaacataaagtaatatgtagtgataacaatcatgtgttttgatggaaaggaaaataaagggggcttctgtcaaatgtgtactgcaggtctcaaattaccaagggctttactggactttggctatcgtggagccaaaagtactccaaagctattgatatgatttggaggatacggggagaataaagacacactttatattaatacttatttttactaggaaagaaatagcactaatttgaggagagctagtttacacaaagtaactcttatctgttgttggtatcaatttttagtgcaagattaataagaatttactaagcagtttaaaccttaaattttacatcttgtaattggcttaatttcctatcatatgtttttatagcagtaatctatacttctttcactagcaaaatatgttatttttccagcccgggtagaaaaacactggattttatgtattccctgaaacaaattagcacagtttggttaaaacagctgcctaaatgatgagaagcaaattggattataaaatcctgcttgatagtttagcaagtcagttaagtaaggattcgaaccatattatatggtcatgggatgaaaaatgacacacactggttaagccaagtgtctggtaatcgggcaaacctcaatgcctggctctgctgttgatctggtggtggtatgtgtgtgcctttctgacaataatccagtttctccaagtgtgagatcatagttgtatatttaataaggctttatggagtgtccatcatgagttagatgatttatttagggatgaaacaacatactttgaaatcattgcaaaaccatgactatataattttattgcactggtgtgttattcaactttgtggttcagaatgtatctgcatatcatgaaaaatgctagtggcaatatggtgtaacaaaggtcagatgaatgagtaaacctacaacattcatcagttattcagcagttgaggaagccttgcagcttcagaactggaggtagtgaacattagagtgacagagatctgattaatagagcctgtgaaatttaatttctctttatcttcaaccttattgcaaacctagttccctatattccatttctactttattgctaaccctttcagctcttatataaccaaggaaatacaacacattgttaaagagtgaaatctttggggttcgtaagcttctttacttagtacctctgtgaactttgcgattaagtgacttcaccaatcctttacaaacccaaaagtttcctcatttgtaaaataatacctacgtcaaaacttgtaatgaataccaagtaagtcaatacatgtgaaatgcttgatgttgtacatgggcacatattaatggtaattagcaatgatgttgataatgtcagtccactaaggaatatagataaaatgatcttaatggtactgatctagagaagtggttcttaaaccaaggagaacatcagaatcacctgaaaatcttaaactaagtaggcaaatagatgcatagatttttttctatgaatactagaactgaattggggtgaggtaatccagtctggcagacattgtgccttatactgttacttctttaaaaattagagttaataaatacagacggaattgctttgcatttttcttcatggtagaaaacctatttggataggtggaagaaatagaagaaaagcagttactgaaaaactaaaatctctaactgttctaagtttcctataatatatactagatagttctaaggtgagagacagacactgacactgtgttttaaagtatccttcagcaattttgaagtcttaattgaatgttttcttcctcagcagaaactgaacccatttatctgtataagctctccaagcttgtagttattgaaaaagttctctgtcctccctctctctctcttcttagccaagagcagtgtgcatattatttgcttgcttgggtgctgttatgcgagtttgtgtatttaaagcttgtgagagagccaagccacaggatctggctggctttcagctgctaaacagggggcatgtaacttgccattggtccccaactgcgagaattgtggatgtaatttctttttggtaaacatccatcctgaagtgaatttatctcctctacacatttgttttcctttgggtgttttccttttgttgtatgatcctcacttcgttggacatgagtacttctgtagtgttacttatcctctcaaaacaatgaaaaattacttttgcaaagctgtttaagtcagaggatgtaaaatggatcccatccaaagcagccattaccatccatcagaggtaggaagagagacgtctactaccagtcagacaactcacagtccatggtgtgactgagctgtggcagcagccgtggcattggccttgcaacagtgtcagggcatgcggtccagcctttcttgtgatttggctctgagttagattgatttatatggttggtttaaggaaggctaagaaaatctattcttgatcttctggtctcattgacattctctgtcactgtcattgttattatcaccaccaactaccatcaccaccaccactaacatgtactgatgctcacaatacgccatgaaccggactaaacttttacttaatttccttatttaatcataacgccaactttatctcataggaactactatttctcacacttcacagatgagaaactgaagccctagagaagatacccgctatgaagctttggataagttacagtggcagagctgaggctgaaaccaaggctcagtctccaaagagcatgttctaaacttgtctgttatattgctctcctgaattaagatgattgttggaaagcatccactttaggaactcaccacttttaaacattccatacatcaaaatttggaatggcatttctcctagttctgttacttttatgtaatctaagtgcctttactaaagggaatcaaaaggttaggcttagaagcacagtgttggagaagtctttacagtgtaatctggaatactttggcaagattaaatttttagtcttttgtttaaaataaaaatgacatttcaaaagaagaataggcagtatgtgtttatataaaaagctaattattcaaactttgtcagctaagcagtacatctgttaactatgtattttttaaaagggtaaaggatgatctaataaggtttaaggaatgtagagattatatggaacctggtggctatttttctctctcagaaactactgaagtaacgacagaagggggttcagagttcaaataatcaagagatccttagcacttaaggttattaagaatacttaagtattctcatgggtctctaaaatactttttccaggataaatgcaggtatacatattttaaggcatatatatagagcagatgagcactctaggtctttacctgcacagtgatttttttggtctatatttaatatttctgattagttaggaattttagaatttgctagttaccattggtgtaaacaaaacagaattggacatgtgagttgctctccattatataaaccttagttgcacatctgtaatacagagtatttgaacataggattaatgatcactggcctctgatgaacatcgatacaaaaatcctcaataaaatactggaaaaccgaatccagcagtacatcaaaaagcttatccaccatgatcaagtgggattcatccctgggatgcaaggctggttcaacatatgcaaaccaataaatgtaatccagcatataaacggaaccaaagacaaaaaccacatgattatctcaatagatgcagaaaaggcctttgacaaaattcagtagcccttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactcctatccaacatagtgttggaagttctggccagggcaatcaggcaggagaaagaaataaagggtattcaattaggaaaagaggaagtcaaattgtccctgtttgcagatgacatgattgtatatctagaaaaccccatcttctcagcccaaaatctcctgaagctgataagcaacttcagcaaagtctcaggatacaaaatcaatgtacaaaaatcacaagcattcttatacaccaataacagacaaacacagagcaaaatcatgagtgaactcccattcacaattgcttcaaagagaataaaatacctaggaatccaacttacaagggatgtgaaggacctcttcaaggagaactataaaccactgctcaatgaaataaaagaggacacaaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagctcgcattgctaagtcaatcctaagccaaaagaacaaagctggaggcatcatgctacctgacttcaaactatactacaaggctacagtaaccaaaacagcatggtactggtaccaaaatagagatattgaccaatggaacagaacagagccctcagaactaataccacgtatctacaactaactgatctttgacaaacctgagaaaaacaagcaatggggaaaggattccctatttaataaatggtgatgggaaaactggctagccatatatagaaagctgaaactggatcccttcttacaccttatataaaagttaagatggattaaagacttaaacgttagacctaaaaccataaaaaccctagaagaaaacctaggcaatactattctggacataggcatgggcaaggacttcatgtctaaaacaccgaaagcaatggcaacaaaagccaaaattgacaaatgggatctaattaaactaaagagcttctgcacagcaaaagaaactaccatcagagtgaacaggcaacctacagaataggagaaaatttttgcaatctactcatatgacaaagggctaatatccagaatctacaaagaactcaaacaaatttacaagaaaaaaacaaccccatcaagaagtgggtgaatgatatgaacagacacttctcaaaagaagacatttatgcagccaaaaaacacatgaaaaaatgctcaccatcactggccatcagagaaatgcaaatcaaaaccacaatgagataccatctcacaccatttagaatggcagtcattaaaaagtcaggaaacaacaggtgctggagaggatgtggagaaataggaacacttttacattgttggtgggactgtaaactagttcaaccattgtggaagacagtgtggtgattcctcagggatctagaactagaaatactatttgacccagccatctcattactaggtatatacccaaaggaatataaatcatgctgctataaagacacatgcacacatatgtttattgtggcactactcacaatagcaaggacttggaaccaacccagatgtccaacaatgatagactggattaagaaaatgtggcacatatgcaccatggaatactatgcagccataagaaaggatgagttcatgtcctttgcagggacatggatgaagctggaaaccatcattctcagcaaactattgcaaggacaaaaaaccaaacaccacatgttctcactcataggtgggaattgaacaatgagaacacatggacacaggaaggggaacatcacacaccggggcctgatgtggggtgggaggaggggggagggatagcattaggagaaatacctaacgtaaatgatgagttaatgggtgcagcacaccaatatggcccatgtatacatatgtaacaaacctgcacgttgtgcacatgtaccctagaacttaaagtataataaaaaatatatataaatatatatataaaagaaaaaaaacacaaatcctttgtcagttctgtgtgtttcaaataacttctcacagtttgttttacacctcttttaaagttgtttcttattccaatagtttttggggtacaggtggtttttggttacatggatgggttctcgagtggtgatttctgagattttagtgcgcctgtcacctgagcggtgtacactgttcccaatatgtagtcttttacccctgacatcccctctcaaccttaaccccctgccaagcctctaaatccatcatatcactctgaattcattcaaaaatgcattcataaaagataactttataactcaagaataaaaaaatcatatgttatcacttataaatgggagatagctatgaggtttatctgagtgcaggatagtgatcttattgtaattgtatatactgatattttatggagatttgaagaatacttccctacctctgtattctcctgtatattgtgctaaaagctttcattttttttgcatgcatatttaaaccataaatctacttgagaacttattttgtgtgtgtgtgtgtgtgtgtgtgcatgttaggtgagagctgggaatacaatttatttgctttcctttttggaaaaccagacatcctagcatgactgatttaagatcctattctttttccactgctctggcgtatgaggtttctatatatgtatgggtatggtctcttttctgttcagtttgtctgttcatcaatcccttcatcagtaccctactgctcttaattactatacattaataataataaatttaaaatttggtagaacaaggttcctcacctcaccttgttttaattcagaggagtcttggccattttggcttcttgatcttttataaaaatgttgaaaccaacagaggtacacaaaagccttgaggaatttttattggaattgcatccattttccagacaatacacggactttcaaagagtttaatactgatcccctcctctctcttttcaaagaatatgttaatattgtgcagtactaagttccaccttatgtttaacctcaaaattagacattttttattgtttgatatatgcaatgcttgttttgatttatccatatgttcatgtctccctccccctcagcattcctttttgtgtctcaatttatttctgtggccgatttcctactttctgaagcacatcttcagatgctccctttagtgagggtttgtttgtagtaacctcagtttttatatgtcttaaagtatcttggttacattcactcttttttgtctttttttttttaattgtatgttcaggggtacacgtgcaactttgttatatgggtaaacttgtgtcaagggggttgtttgtacagattatttaatcacccaggcacttagcctagtacccattagttatttttcctgactctctccctctttctactctcaacccccgataggccccagagtttgctgttcccctctatgtgtccatgtgtgttcatcatttagctcccacttataattgagaacatggggtatttagttttctgttcctgctgagattggtaaggataatggcctccagcatcaaccatgttcttgcaaaggacatgctcttgttcttgcaaaggacatgctcttgttcttttttatggctgcatagtattccatggtatatatgtactacattttctttatccagtctatcattgatgggcatcttgggtgattccatgtcttggctgttgtgaatagtgctgcaacaaacatatgagtgcatgtgtctttatgatgaaacaacttatattctttgggtgtatatacccagtaatgggattgctgggttgaatggtaattttgtttttagctctttgaggaatcgttacactgctttccacaatgattgaattaatttatactcccaccaacagtgtataaatgtttccttttctccacaacctcactagcgtctgatattttttgaccttttagtaaaagccattctgactggtgtgagatggtatctcattgtggttttgatttgcatttgtttaatcagtgatgttgagctttttctcatgtttcttggccacatgtgtgtcatcttttgaaaagcatctgttcatgtcctttgcccactttttaatggggttgttttttcccttacaaatttaatttccttatagatgctggatattagacctttgtcagatgcatgcttgcaaatattttctgccattctggaggttgtctattttactctattgatggtttcttttgctgtgcagaagctcgtaagtttcattagatcccatttgtcaatttttacttttgttgtaattgcttttcctgtcttcatgaaatctttgcctgttcctatgtccagaatggtattgcccaggttgtcttccagggtttttgcagtttgtagttttacatttaagactttaatttatcttgagttgattttttatatgctgtaaggaaggagtccagttccaatcttctgcatatgcttagccaattatcctacttattgactagagttctgtctccattgcttgtttttgtcagcttcataaaaaatcagatggttgtagatgtacagtattattttggggctctctgttccatttttccatgtatgtttttgtaccagtaccatgttgtttgcagccccgtagtatatagtatgtagtttgaagtcaggtagtgtgatgcctccagctttgttctttttgcttaggattgccttgtctacttgggctcagtttttggtttcatatgaattttaaaatagttttttctagttctatgaaaaatgtcattggtagtttgataggaatagcattgaatctataaactgatttggacagtatggccattttagtgatattgattattcctatccattctacccatgaacatggaatatttttctatttgtttctgtcatatctgacttctctgagcagtgttttgtagatctttcacctccctggttagctgtattcctagatattttattcttcttgtggctattgtaaatgagattgtattcctgattgggcactcagcttgactgttggtgtataggaatgctagtgacttttgtacattgattttgtatcctgagactttttctaaagttgtttatcaggtgaaggagctttagggctgaggctgtggggttttctaggtatagaatcatgtcatctgcaaatagggatagtttgacttcctctgtttttatttggatgccctgtacttcttttgtttgcctggttgttctggccaggacttccaatactatgttgaataaaagtggtgagagaggacatccttgtctcgtgccagttttcagggggaatgcttccagcttttgcccattcagtatgacattggctgtggatttgtcatagatggctcttattattttcaggtatgttccttcaatgcctactttattgagtttttattgtgaaggaatgaattttattaaaagccttttctgtatctattgaggtaatcatgtgtttttttgtatttagttccatttatgtgatgaatcactggtattgatttgcatatgttgaaccaaccttgcatcccaatgataaaagctacttgatcatggtggataagctgtttgatatgctttggattcagtttgccagtattttgttgaggatttttgcatcaatgttcctcaaggatattggctggaagttttctcttttttcttgtcaggttttgttatcaggatggtgctggccccatagaattagttggagaggagtcagtccctcctcttcaatttttttggaatagttttagtgggaatgctaccatcactcctaaaagatagttttcctgttatacaaatctaagttgatagttactttcagtacttagattttgtggcctctgctgttgaaaattcagtaatccatgtaagaataacttttataagtgatgtgacacaaatctagacagtacagaaacttaaaaactcaccactgcctcatatctcacaatggaagagtaaattttttcttctcttctttttttctaaaggggagtgtgtgtgtgtgtgtgtgtgtgtgtgtgtgtaaaatctgctaatcaaaacgattttctatagtcttagaaatttttcaaaacttattttctatcagaagtgtgttttctagtcattaaaaagtcactacagacaacattaatagctgtataatctattttagggtataatgtacccaccaaaaaattccttcagtgtttaacctctaggttgagtccatgtctaattatatacataaatctgcagtaactatctgtgctaacatccttttctgcctttcaaatatttttctcatgttagtcctctaattgcattaaaagaatcaaaaagtacacactttttgaagaagtttaaaacagctgtctattgcattccagacaggttgtaccattttacacttaaaccagatgtatacgtgaacacttcattatttttaatctactttacgttttaacttcttgcacttaattttgaatgtatagatatacaggtatgtaccagttgtaattgataatatagaaaattcccatagtggcatttggggaaggaactctttacctgaataacattatgcattcatataatccttaatgggaacgtatctaatttctacttctaaaataaagtctttctggcactgggaaacactcatgattttagtggaagaaccacagtatttcaatcaatcaatgtactcaaattgtgaaatgcaccatttatgcagttttatggaataaatatggaaggggatttatgcttgaatcctacttttctttttactttaatgacttaaagtggcatatgatccaaatattgtcacatttaatgtttccattgcagacttccctagaggatcatgtttttagaagctccttatgatttagtttttttggagttggcattatagaaaccttttggataggatcaatgacaaagcgatcttaataccaatttataagctctaacaagtagcttcaaaaatcatatcctgtcacgaataaaatgtttacctgccatatttgtgatctcagtgaattattattaaatgagaaggtttttataaaatgatcccctaagccaatgtgtatttaggtggtagccatagtaattaaagtctcatccttaagaaagagagagaatcaactcttcacatctggcaggcatcattcttccctccttcttccctccttctctctcttcctcctaatacataacctgcctcatccagatttttggtcatttccatatcttgttcatatatacaggaacttggagggagataagtcttgccctgtccctagctaatagactttatttcaccttattttgtggcataaaatactggacgcttgaagctttgctgttcagtgaaaaatgttcttcatcagagccagaaaagtagcagtgattcgttttgactcataaacttttactatagcaattttgcaactcttattataatttttatttctttaatttttgtaactttttcttttcagaggagttttattattactcaaaccagtctccccgagcattcagggatcagagtttttaaggacaacttggtgggtggagggaagccagtgagccaggagtgctgattggtcaggtcagagatgaaataatagggagctgaagctgtcatcttgtgctgagtcagttcctgggtgggggccacaaggtcagatgagccagtttatcaaactggctggtgccagctaatccgtcaagtgcaggatctgcaaaatatctcaagcattgatcttaggagcaggttacagagggtcagaatcttgtagcttccagctgcatgactcctaaatcataatttctaatcttgtggctaatttcttggtcttacaaaggcagtctagtccccagtcaagagggaggtttgttttgtgaaagggctattatcgtctttgttttaaactataaactaagttcatcccaaagttagttcagcctaggcccaggaataaacaaagacagcttggaggttaagtcaaatctctttcactatctcagttataattttgcaatggtagtttcaatccctccttttgggttttataacaccttaaatcttaatatgttggctaaagaaggtggaaaaagggtgacaactgctctaacttcttcgtgctgatcaggggaatagtgggggtaggtgttgaccccaaggtaagaggagtgaaactgctttgcaactgtctgagcatacccatgcaggcctggctggggttccaaggcttatatggcaaaggtgttagtattgttatctatagttttaataccgactagggtaagaagtgcaattcccagttttaaaagtaaatatttgaaaacattagttttgggacttgtagcccacaaagaatttaggatttactccaaactgcagaaaaaattcaagaacagctaacaacagatatactatagtttttcttttgaagtatatttttttctctctccagtccccattttctattaaaaacaaatcatgatagaactgatttgtttaaaaaataaactatagtcttattgtacttggcctgattatgtgcataaagtgcagcgagaataattattttttcacataggcttttaaaattggctttgatgggactctgttccataaggaatctcagataagactttttaaaagctgaggctagccatgggtttgtatcctcgaatacttaggagctgggtaaattcttctcctctggaggtcctaagatcacttggggctcgtgggtctgttagaaagtgatattctttagttaccacaggtcaggaaccttgtacagggactgtacagacaagatatgaggccagatttctcaagagggtcttagtgactctgagtcaactttgattctttaaagaaggcatatcattccagtcaaagccttggtaaaataaccagtttctccaatggtgtcccattacaaagaaaacagatttttattacacttatgcaaacaactacaccgccataaattgagaatactcacaaatagtttccaaattctggaagaatcaggtagagaaaaataaatatgctcaaaattttgttcataggagtatattttactcaattgttaaaaatgctgtacatagctcggaagacattttcttggccctggaaaacaaaaaggatcaacaacgttttaagcaaaaaagtttttaaaaaagattacttgtctattagttcagtccattcaattaactcctgttatgcttgatatttatgaagatttcagctttccatgagagtcccaaaagtctttttctctattctaacgtcacattctctaaagttattagaaacgtgcattcaatagcacccataaaaagtcctatagctgattctaaaccaccttttgaagaggaacaaaacaagacaacaattgtctgtggaggacaaaacagccattattaaagccacaattgactaggaattttggttacttctgtggcatacaattttacataacaattataactattaatgacatacactaagtcatcagaattatgggagttccacataattttggaacatacaccagtaacgtatttatacaaatatagtccaaagaaagccaaacaccatttcatatttgacaatgcttcctgtatgactttcataccaaataagccaaacacatgatttgagacttcaggggacctcatgtctaaaggattagttaggccagaaaatgacatacttaataatttgattttggaaagtttgtcaaatatcaaaggtttaaaacactggatatcacaaaataggatcacagattattcatttatctgaaatagtaactcaattttattttatttttttggctggagtgcaatggtgtgatcttggcttactgcagcctccacctcctgggttcaagtgattcacctgcctcagcctcccaagtagctgggattacaggcacccaccaccatgctcggctaatttttgtatttttagtagagatggggtttcaccatgttggccaacctggtctcaaactcctgacctcagctgatccgcctgccttggcctccctaagtgctgggattacaggcatgagccacctgcctggcctcaaaaaaattttaaaggcaaaaacctttactctgatagaagaaacttggcttttcaaacaagacccaatgaagatagcatgaggccagtggaatctgtcccttctctctcctctttctttccccttgttatttacccaaaagggcaaacaaacaaaaacctttcattacgttttaatattgcataaaaatatttcaaaagagaaaacaaaatggcatttttgcattagtgcatctttaatgctaaagctagtttttaaataaaattttacaaatctatccagttttaattcgtttgaccataaggtaacattttcataaactttttaggatgctttacaattttctgttacacaacagattaattttctaagaaaaccatgttatttgggcacatggactgagattctggcccctcattagtgtgcttttattttaatatttaacctatggaaaaacaattaaataattcccttcaaatcttagccaacttgctcatacccacagaactttctttacaagaccaacccttttctcttgcttaagtcttcagttttgtcccattactctgttactctgtttgtctgaactagaaaaaattacatttcctttaacaaaagccatattcccatgccttcttataatcttttaccaaaaacttattcctcttttcttatgcactttgtatgtaaaactgtttctccagtagtctcaattacatgttacaatgttaactgttagcaacctttattttcggtgaaaacctgacaagtaagtgattttaattatgtactaggtgtggagtctaggccatcaggcaaataaggtctgacttttcccagcatagtaactaggtggggcatggctaactccacatgtcctcaggcctcatctagaatctagtgctccaaagtaggtatattgaacaattttttaaatgtcagaggcagtttatgacaaagcatttagcaaatgtgatatatgaccttaatttagaccaaatgtctacattttgaagtcacatgaagaaaaagtcattaaagtttgtttctctgacaaaatacttgatttaagaacttatttttctaagccaattaatcagagctcttttatatataaacatcacatatacaacacatataaatagacagaagatatagtagttgtacagtttttcatttgccagtttcttagttggattcctggcttcagggtgaagctcttggagaacagggccaggaaagcatgcagtttctagggcctaataagtagacacagctgtagggcaaagccagatccccaaagacaaacccacccttttctgttttatggaaccacaggcaaaagattctccgttttgcaagatgtttcccaataggccgcaggggaaccaaattaacatttttcatcccagcaaaatacacataacaaaacagacactagtcacctgcgaagagtggatagtcgtcccaagacaggcctgttgaactctcttcagggctcaccgaatgtgaccagacaaataaggagggttctctgagttagacctgctggactttcagcagttccttctgagatccactccacatatacacacacacacacacaaagacgagaaggatagaaggccttccaaatcagatccctaaccaagaactccaagagtataccttccaaactatccttctattctccatctgagaaatctccctgaaatcttcctgtttgagaagtctcccaaaccaagattctttctactagtcagggagagtcaactgagacctcccagaagccaaaccaagacagacaccccaccacggtgctacagaaccagtcgggagaaggaagaaggtgttggcagaccctaggatactcaccaacccagacaccccaaaatagagctacagattccctttaatatggctacagttatgggatgtctccaataatttttaaatatccagattttttggttttacatttaaggatatttgtaatttgttagtcataatcctaaaaacacacatttatgtagaagtaaactgtcttctcaccaatatgcccagatgtgttctatggaaaagtatattttagattacacatgcacatatgaagacacaaaaacatacacatcttggggaaattgtgcatagtctccataatttttcaggtggcctacttcattgcactgaaactatcagtgaccccgaatttaagattcaatggtcattaaaacagctgcagttgtctttcaaagaaagatatatgttagaaccaatctggctattaataaaacatttagatgatgagccctgggcattgtattactggaatttaattttttttctacaggaagattaggaaaacacataaaggcacctaaaatacacttacatattgatcttctttacaatttattacccacaaattttgtctgttttgtattagaatcaaactgattggaaggaatttccagaagtgtcttaattcattaattccttctgatttctaagctactgtaatgaaaataggtaactaatttttgaaaattctaaaggaggaaggtttttttacatctgttctcaataactcagtgtctagcttttctaatacataaagacattattataactatgttatagctttgtagttgcaattctgtttttgattagttacatagtaaacagtagaaaacacttctatttttataatagaaatgttaaaaggtatttttttttttttacctattctgtgagcattgacatctttttaaatttcttgacaatgcattctctgtagtcttctcaaagtacctatgattattttcattttttggaactcttatttggatctgctgccttaaatcatcaaaagccaaacagaatgcagtatttgagcacagtaaatattcagtggccatcttatgtttactgttcctgttcactgttactggcatagacttcaactcaaaggcactcaccaatttagctcaagtttcagtacaggtccttgaacctgccctgctaagatcatggaaggtttgttttgtattcatcataagtcactgatactctttatatgtcaatctccaggtaatgtcttttactaaaattatggtagtttggactgtgaatctcttcttggatacctctgattcactggtgattcattttaaataattttcattacatttaaaatttctaaatgctatttttaaactgttggtttctcatgctttaacgcctgagttaagtaaaactgacaagaacatactgatagaagcatgacaataagcaatacttggaaaacttattacagatacttgttgcatttatatgtgtgtgtatacatgtagtagcttcctttgattttagtttatattgtatgtttaacagtctctatactttttctggagagtagaatgccattttcagttgaggagacatgaactcatttcattaaatatgaggctgtttgtaaaatataattaactatgttctcgtgttttaatatttggtagttatagacaaagatatttagtatcaagataatccagcaaggctgtagatttcttacaaccttggaaatgtgctgtctctaataatcgtgaggtatgccaaacatgttagagttccttctcaaatatttttcccctaattgaaatccattgcctctacttgggtagttgacaaagattctgaagtgaccaaaatatttgtctggtcttgtggatagagactattttggcaaatgtttgttactttctttgtcctgtaggaataacaaaatataccattggttatcctcgtcttgtatcaaaccaataatggccccaggcttcattttatgaatttaaagattcagccacttaaaggaatgaccagttcatggggtttgcaggaatttatgacagaagggaagagagtaacattggccatttccttcctctcctcccactcaggattatatttatgtaagtcttataatggacaagagggtaagctttgggaccagactacataagttcaaatcccaactctactacttactgcctgtggcatcttaggtttactttacctctctgatcctcagattcttctgaaaatttgggatatcttcaccttaaatatttatcccaattacctttctttgattatatgaatgttaaattatcacatgtaccatgaaaatatgtgcagctcttatgtatcaataagaaaactttacaaaataaaaaaggaataaagtatttcatagggatattttaaatatgaaatgagttatgctcagcacttggtacttggcacactacttacatttatttgattttaataatttggaagaaactcagcatctaaaagaaaaatatttcttgccttttttctgtaatccagcaaatatcttgataccactggtatttgtgtcacctggactgagaggtacttttctcatctttttagtttttgaagtgccaactctgcatcccttagttaggcagaagccccaaacttgattatcaatttgatttattttcaactgcaattttcttagtctctttagaatttttgcaaatgaactagacagccttttaaaaagaacctgttcatgaatagagatattctgtagagtaactccagtttctggaatatgtccacaggagagatgaatctgctatagcacaagtgacctgctccaccttggccagaacataaagataagggccctacccctgggtgtgtacccatgggtgtgcctccccacactggaagcttaatttctgcttgcttgcttcttgggggattgcctacaaatagatcccagggaagggagtccaggcagaaagaggtttgcacaccctttcagcagtactttatgctctagaattgcatgcagttaacttcgcactaagtcatctatgaagcttacaaaatattcttggctttcaggagttggtgcatggctagggaatcttttttaagttccctggaggattgttttacttctggcctgtgagctggcttttggaaccacaggtttaaactttttctgactcagctgaaaaataagcatcctgtattttttgtttttttccttgagttttgccataagcacactgttgatactgagttggagctgctaaatgtgttgcttgaccctgggaaactgaggctttgaatgtcttaaccccagggaataactgatttgaggaatatgggttgtaggccaggcccatcagggatctaatgggacccaagggaaccctgatattgtgtgggattgagcaggaaggctgatgcccttctccagcctagtatttacttattaatttgtttgttcagcagccatttaaatgattacgagatcaaaggcattttgctgggcataagggatccgaagactatagtggaaaaagtacaggttttagaatctgccagatgttggtttgaatcactgctgagctatgtgattttgtgctatttacttaacttctcgaaacctatttcctcatcggcaaaatagaaataatgcttgctttgcgagttgctgtaaggattagaaataatacaagtagggcaccttatatagcgctatcgtttatttagtgtttgtgtgccaggtataatatgtgaaattttatacatattctccttccttatacagatgctgaagcaggcatcattgttactaccagtttagaattgagaaaactaaggtttagaaaaagtgtctagtccaagatctctagtttctaagtggcataactctgctttgaatctagggctgtctgacgccccagactcatgttcttaaccttgtattctagatgcctgccaaggctagtatcatgttgtaccctgctacttctccaggttaggcctgggagtgatccatccaagagctgttcaggcatccatggctctgtggcgactgaggcatgttgaattcctctctagagaatatgcaattgagacaaaagaggacagaggctattataagagggaggtaagccaaaaagtcacagggtttatcagggatagagtgtagcctacatagaccatgtacaaagctgaagttgaggccagaagccgtggggaagcctaggaagaacaggagagttcatttaacagtagatgacaaagtatggctttggttcctgaccactttcagtgtttagatgtagcccttatatctttgctccaactctcagttgacatgagtgtaattgaatatctgtaacttgatttttgggaagactctaaccaggatgctatggcacattacattgtagctattttaaaattttttaaaaatagagatgggatctccctatgttgtccaggctggtcttgaactcctggcctcaagtgatcctctcacctcagcctcccaaagtgctgggattacaggtatgagcccccatgcccaacctgtttttaattatttacaaactagtaaccatgatatacagccaaacaaaactgcaataggaggtggtaaatattacaatgagggaggttcaaagtgctgcagggcacagagtggggaatgtatttatgattctttgtggagcatacatcccctcatattatcttgtgttaactgtgttcatgtaagacctgccacttaactgaactgttggcttggaccaataacctatacccttttctttaagagacagggtattgctttgtcacccaggctggagtatggtggcatgatcatagctcactgcagcctcaaaatcctggactcaagcaatcctcctgccttaggcttctgagtagttgggactacaggcatgtaccatgcccagtctcattatcttatatagctgccatgtataaaccattactttcttttcacttgtgtgtcaagttccatagaaattgtgttgaatccaaattaagtaaatgctgccatatgacaatggtcttaaatgtcatttcttgggctactactttttgtttttcatttagttaatggttattgatttaagaccaagaggaaggtattacatcttcttgttctaatggaattattttaaaaggtaccttccgttatagtatgaagtcagctatggaggaacttaattcttttctggttatcccatacctcctaatcaaatgaaaacagctgaatcattttctctgcaaacctgatggtttttctgacttaatttaggagtgccaaatgagcttgatatttatctgcatttattttgagttaatttagggcaggcacctgtacaacatcctggcagcacagtttgagtccttaccttttcccccaaaacattcaattaaatgaaaatggatataaagcacttatagggcctggtacaaagtaggagtgttcaccatctcaccttacttaggaaactttatagcctgcatcttgctaaaatgtaagaaaaagaataagcagtgaatcaatgcagtataaatttacagaaaatctaagttacagagaagttgttatttatgcagaatttaccagttcatacagggtttcagagttaggatgaggtcaatgactttttttgtggaactcagtcagggtaatattgtcttcagtgcttctttgccttccttgcaaaatgactcaataacttgaaaaatgactatccgtatttattgacctttaaagctgggaaagtggccgggcatggtggttcatgcctgtactgtaatcccagcaggaggatcacgaggtcaggagtttgagaccagcctgaccaacatggtgaaaacctgtctctactaaaaatacaaaaagtatccaggcatggtggcatgtgcctgtaatcccagctactcaggaggctgaggcaggagaatcgcttgaagccaggaagcggaggttgcagtgaaccaagatcatgccactgcactccagcctgggcgacagagcgagactccatctcaaaaaaaaaaaaaaaaaaacaacaactgggaaagtatatgagagaataactgaactaggctcagagcacaggtttccccttctaattagctgtagaagcatgggtaggggtcactctagatcttctgtgcttcagttgcttcatatctaaaccaccttgcagaagtggactacagcagggcctagcaaattgcctagtatatttgctgtctttccaccctcaccagtgcagccaactcattgtggtgctggaaggccaacttgtcaggaatcaccaccaaacagctttcacccttgatgtcaaatctatgtgactttctgcaccagaagttagtgaagatcatttgcagttttacatctctattcttataaataaggaatccaagataagaacctgttatttgcaggtagtttaactttcccataagaaagtgacaacaagaatttgtgaataatgctttttctctaaatcagtatttgaatagcagattttccttcttaattttcttttcttctctcattagcccaaatatctttttaacagcagtgcaattatatttttaccttgtgcagtacttgggtcttgttaatctttagtccactaaagagactacctatggttagaaagaaataaaaagcctccaatgggggttcaacaaaaagtatttaagaaattagagccccaaagttgccctgtacattgttttaaaaaaccatctcttaaccagtactcttactgtaaaagtgaattattgcccccttgtggtagaattgtgcatttattttttcacacaaatagtagagtcgtattttactgtttctactgctctgaaaactttgtcctttacaattaacctaaagtatttatgaaaataattttagatagttttaaaactatctcttcttgtttgtgcttacctatgtgaaacaccacagaatcctgtcttcaaactgttttgtgtttctctttgacggactacggatttaagaaacaagcccaaatctcattcagattaccttgttgtagtccttattgcttcaagaaagctgaaaaaggttatggaatattcttactgcccctttaaaagccatgtcatacactcgaagaacagattttcttcagagctgtaaaatgaggaatttctgagaatttttgaaataccgtgtgcaggaaaccgtactggtaaatacagttcatttataaaggttcaggtgatcttcttcagggttagcttttctgaatacagttcatttgtaaaggttcaggtgatcttcagggttagctttttttccatttccatcattttgaacatgaaataaaattttaaaaccaaataggacttcctgtcaacaaagtgggtaacagatctgactcctaataaaatgtcttctatgagaaaaattgaagtcttaaagaagccatttcataatttcatactattttagataaaaaaatatggtaactttttacagatgaaagaatagtaacagtcagaggcttcccatttaaactggctgattgaaatagcttttacaaattagtgtaaacctgtgcaggtagtaagtagtctgaatcctgatattctgaatgattgtcacatttgtatgttgagagaagtaaattttgtccgttatttattttggacagttgtcaccctctatcaatagtccctgcaagaagaacaactcttgtaagttatctgtagatcatgtgtagattttaaaagcacatgctcttttatgacgatgaaatgactaagtgaccctttgaaaaatcttctaagttactacttgacattcaagtaaactctcagcaggtggcttgttattattttcaacactttaatgtttattgctttgtctctagattattttttcttaaggaaaatgatagcaaaccattattgaaggattagatgttgccagtcctttcaaaacacagctatctgtaaaatctttttagtgaaaagaagaggtgcatttctagaaaaccaaatgattgttactgaaaatgccttaaaaggaactgacaacactttgtgctgtcagtaaagagccacaattgattcatttcctttactctttccaccttaccctcacttctgactccacagccagtgtaaataagtaactcttattttatttacattttacattatgtaaataagtaaaataaaaataattaaaatatgcccatttacattatgtgaataagtaaaatgtaaatttatttttaataaatttttaaatttacattttaatacataagtaaaatgtatatgtgttaaatatatatgtattggttgtgcattttacttatataactcttatatttgaaaattgcaaagagtagatttaaaatgttctcacacaagaaaaaagcatattaggtgatggatgtgttaattcgcttgattattagcttgattaaccatatcacattatatacatacatcacaatatcatgttatacactacaatttttatttgtcaactaaaataaatgtgttattctgaactatatggacagtaggaagatttttatcttaggctacataggacatagtgtggtagatcccagtcctgctcatcatatttgcccacttgaactgctttctagaaggaaaaaagcttcaagaactaacaaacctccattcttaatgtctgaagtgtttaggccaatagtttttaagcttttatatttcagatctaattacaagtgatgactctgcaaaagaatctgcttactatcatttccatcatagtaggaatgcttttgtattacaggctttttcttagatccatttatgataagttttagtgatatccaacagtagtattcctggatataaagttaattgttattacttaaaatataaaatataaaaatataaaatgctatttctaaaataaaaatataaaatgctattactaaaaatataaaatataaaatataaaatacttgcattcataaagggaaaacaaactttattccctcagtaatcacaaaaagaagaggtcatgaaaagtgtagtcaggacatttaagtacattacaattttttcagtattaaagatccctgtgcatgaatctttgtccaagtttagattatgttctgagggatagagtcctagatctgagtcaaaagttaagaatattttttattacttttctacacattggcagatggcttttcagaaaggctgtatcaattttatattctcaatgcatcctgttgcctgtctcatgacattcttacaagtgttagatatttttacttttaaggatctttgtagtggcatctcatcttatttggaggttttaattgtgagatttgattatttaaatatatttattagctatttttatttcctttatgaattgtttaggtctcgtctatttttaaatgaactttaaaaaatattttagaaaccagttggtgttttctagacaatcactagtcttaaataaatacctcttgctactcattcttgggcaaaatcaagttgcccatatgggaaaaaaaaaatggtacagtactactcatcatttacaactcagtccttctgactttagatgtaaaaggagcatttcatgttctgcttccagagtgttctctgaaatatgacaatatctgccaggttggtggttacacaggtttcttgtccctaagttttagtggctttgaagaatgactgaatctctctgaggtgatttcgaaatctccatgatgaattttataattcagtgaagcccaggtttcaagttagagcattacaaacttaaaaatcagtaaaactcagtcctagttttgtcgcagttgtggctacaacagtaaattccagttaattatatttgtcataattgtggcttactttccacagcttgtgtgtttatatatgtatgtaggtatgtccatgtattacgtatacatatatatatagagagaagctttaatctcttttatagtcaaagctactgaaatttttctttagttttcttccattaaaagcctttcttaaaacacacagcattatggaaactctagacagcctcggtgccttactctgagggatgtacaagaaacatttttccagtgatggaaagattcttacctatacccagtgagaggaaagagagcatttgaagacctttgactttgagagtttatgaaagaatgaaatcactgtctgactggcagtggagctggcatttgcaccgcttcatgtaatttgtgagtctgcctatatcttggttcaaaataatctaccctgtttctgattctaatagcagcaattcacagctggatggtagcagtatttccataaggaattgttcatatttctctgcagaagagttgataggttatgctcttggaccatttccacatgtgagcaagtcaatgtaattacattagttagaatgtggctttgatagtatctttctaattttgttcattttgaggataatcttgtcttgccagtgatattctacacatcttcctttcatcctagggccacaactttttcacagtgtctcataactttctagtgaatgatgactgtagtattttcattctataaacatagagactaagagtcaggcatatgccttaccagacatctcagttacaagactgtgcctagcctaccaggttttcttcttcccagaagtagcctttctctaaaccacattgcattgccttccttaaaaacggtaataattgggaccagtcatctccttgcatctgcataacagtgctgaaaagatctgccctgtagacctgattctacctgattttgaagagattcccttagttatgatgtgtcaaggccactgcattctcaagacactagggataaagatatgcaaaatttgtcactagaattggatatgttggatgttgacaatcccctcgtaaaactcaaacttctttttttttttttctaatgatcctgggcagtatctattccaagtcttctcttgtgaactaaaaagtaaagttaaattcatgacttgaattatgcgttgggtgactgccatcatatttgcctttaaatacttcccgtatagcatatatgtgcttgggaatgtgcagcaattgaagtctagaagtcattctccaagtctaatcccgcatccacagaggtaaagaaattaagcagaaacagaaattagcacgtttgtatgtctattataacttattttcaaatatatagataaaacgaggatttttttgttagctttaatcttaccgatttcttttctcatgtttgaaaatcttagaacgtgaaaaaagcatttgtatgaaagaccctttctgtatgttacgttgtattttagtattcttttactacttttgctactttgagctgggcttgaagtcagaacaacgtagtatggaccacaaaatattttcagttaatttaggcctgtctgtggtcaaatcttggctaaccatcttaattcctcggtatttgcaatatatcttatgtgagaaaagggactggccaaaagcaaaaccaaccaaccaaacaatagcaaagaggtgtcattcaagagagacttctgagggaaatctttagggttgtaattagggcccccaaacattgcttgttggaattggtaccatatagcttattgccaacagagtaattgtacaagttaaaaaattattttacataaataagctttcagaagcattgctgaatttttggccaggattaccaactgttttatgcaagtattgagtaacttccctatgacacaatatcatatcagccagtaaacccaaaaccatttaatattgacaattacttcagaataatatattgggtaaatgaaacgaaattgaccatcttaaaatgagcttttcccatcattttgcatggatttgctgttagtgaaagtagtacatatttaactcacaactacataatttacacgaagctttcttgtgaatgtgaaaagctttctttaacatatattctttaacatatattcagtattaaaatctagtaagataagctttatttttccattcacttaatttcaatttgcttttaaaagaaactccaggctttatatcaattaaacataaaccaaatgaatttaaaatgtagtcagtaatgattttttaaactaaggattttgttgtttagagaaaatacagaacaaaaacttcttcataacactttataattgaagcttttaaaatatgctatattttgtattaaatatttcatttttctgccctcctttggtgtgtctcatcattagagataatgttactaaatagttgtaactttacagctgctttgattaatgatggcttgaactaaggtttcatggggtaggattaactacgtttcaagatggcaaactgccattataacattaatgccagaatttaatgagaaccagaagttagctttaaggacctttataatttaatatgggggcatgatcatgttctcattgttttaatgcaatgtcctattaaacataagttattcttttaaatctttttttcttgtgataaaaagatgtaaaaacatttgctcagcaaatgtttattgactatcgactaagtgccagtcactgtgctagggtcttgaagagtaagcctgttttccatccttaaaacagatcctttctgatcagaaagaacagaaataagaaacatctaccttatttagaaatctcatggccttccttaaccttgtatgactctggtttcctaattcatgtatctccctagactctggtctgtttccttttcatttttgacatcagccctccttctccataggctagattgaaaaattggcctgctatatgcctggaatgaaagggtctgggttatgtaattttacaggtatgggaaggatgaagagcacaaaactgaatgtcctgttccctattcgtagtactgattactgtgctgtcaaatagctacaccttacaggaagagaaaagttaagctttatagaattacaagataaaatttgaagtagggaaagtaagagaggaagaacagccaacaggattctttcttgttcattgagacaaaagtcttcctgtactgaaggtgtgtaggggtgacttactttctgtaaaatgcaggagacctttaaagcccttttctgttctaaaaatcctctgatttctgtgtgtttagaactcaaagaggtgatggacctaagacagatgtctcatgttctttattcttttttctcaaaatcttatgtgtacaaaggttgagaccttataaagtaagactgtaaaactataaccacagatggaggaagtaaaatatagcagaggcaaagaaaaaaacagcatttaaaaaattcctgatggaggaaaacctcaactagttagcttgtagcctgggcttcctagtggctaaggcaaagaagagaaatacttggtatgatcgtctggtagttagacacataccaccagtttatcaaaacaaataagcattcttcttgctctccattaataacaacaacttgtccaggggatttggataagaagccataaggtatataatgaatgatgtctccatgaatttttatagaaaataaaggattgcacatatgtcattttatacattggtatttggaatatggaggaaataatgttaaaagcaagactctttttcccccatggggaaagggagagaggagtttgaaacttctggtatgtttgctatagatagatgcttattttcttttgacccactgacacgtggagcagtagtaagatgtaaagatgtgtagaaaagggtagcattgttagaagtaggagggaataaatggaatttttgtggcaggatgatatttgaaagacggatcaggccactgggaggtttttcaatatgccagttccctgtaacaggaaaatcagtctctgttttagacagcatatctaatttagtaaattattattattctgtcaaaattaatgtgaacaattttctctttgaggctttttccataggtgatgttttccagatgggctttgtgcaaaactcccaatatttttgtgttttctttcctagagaaagagccatttctgacatctcttcttttctttccttcattgcagggaagagaacaccaaaggcgaaggagaagaggaacaagaaaaagaaaaggaagctgatagaaagggcccaggagcaacacagcgtcttcctagctacagacagagctaaccaataaaacaagagatccggtagatttttaggggtttttgtttttgcaaatgtgcacaaagctactctccactcctgcacactggtgtgcagcctttgtgctgctctgcccagtatctgttcccagtaacatggtgaaaggaagcaccaccagcatggcccctgtgttatttatgctttgatttgaatctggagactgtgaaggcaggagtaagtgcacagcccgtgacttggctcagtgtgtgctgagagaatccgtccccggcaccatggacatgctagaggtgtgaggctgcagaacaccgctggaggacggacttgtgcctatttatgtgaaagaagatgcttggcaggcaatgcgctactcactcgtgacctttatttctcacattgtgcattttcaaggatatgtttgtgtggatatctgcttagtgttaccacatggtattctcagcatgttaccttcacactgttgtgcgatgaaactgcttttagctgaggatatgctctggaaattcctgctcagtttcactgcagccctaatatgtacatatactgcaggagctacatataaagctcttatttactgtatatttatgctttcttgtgggtaacaagtcatacctgattaatatgatgccactttgtttctagtggttcctaacccattgtctgataaatgacttttctagtttggggaattgacacttgttttgttgcctcttgaaactttttttttttcccctcattgtgggcttatttctcattgtaagggtaggataaactagtttttgtatatagagtcaaatgaccagtgtcaaagagtttgcatattgggtagaccttctccactccacatgtcccacacatatagataaagcagcaggcggcatctggcaatcagaagcccaaactgcctttgagtctaagatgtgatgactttgatgaaacacaactgaaaacatgagggactatatccagtcacttgtagccagtttcacaggccagctacagaattgtccaaacaaacattatttctgactgcaatttttttcccccaaatttaaagcaatccctggctttaaatgacaaggcacctaccaatgttcttgggtcactgaagaagctactaccatgagcctgtgcatagaattttaggagataaaaggatgaatttctgtgactgccagtcagatcttaacaggtttctgttgagccagaatctgtttcagatccaagatggagaggaacactatggaaacttcccaggtgactttcagagcagttgtttcaaacacatcattgtccttttaggggaaccagtttttagaaggttgtgaattggctttttcacaaagcatgattatcttcctggctgatccaggagaaaattagaacagaaaaataatggttgtggattttgaaacaaagcaaggtaaagccttttttttttcaccttgcattggcaaaactacctcttcagtgtttttaacttttgattcaaaagcatcttaccaataaggataaatatcatatacatcgttatgaaaatattgctatgagataataagccacatatgaatgttgtatacaactttagggtttacatttaatcctgaagtgttacctcctttcatgtctatttacactattttcccatttactaagtggggagggggtctccttatatagtgcttcatcgttaataagtcaatacctgttgttcctgggatgttcttttttgtgcattaaaaacttcaaaattattttttgtggagatttcttttttactttagagatacatttagaaataactcagtactttgttctacccccaaaataacagccctttaaaaaagacaggcaaatctttaaaaacctatattggtaactacatctagaacactaactaactagtttatagataaactagataactgtaaactagagtccaagtgcccgagttctaatccagactgagagtggcctgtgaaaattacttaatccctccactctcagtttccttatctgtgaaatggggatcacattatcatctgcctctaggggctgtgttttaaggaccaaatgaaaatatatacagggaaatatatacagggttgtactttaaggatataattaggtaaaatgtgtaaagtatggtcaccacggcattctatatactaagtactatacaagttggtcacctattacatctttcaatggctatttagattcttttaaaaaatattgatttctccttattaacaaaatagaacatttatgaaaagtatcaatctaatctattgcttggtgcctgggcattatttgctaaaacatttacatctgcttgatttctgactctccctgatataagcagcatacacacacagatacacacaaaactgaattctttcctctatcaatcagtacgggtgcaatcaaggaaataaactagtcggggtgtttcaaatggggaatttaacaccagaaattggttatacaggtgataaaggagacacgaagccaaaatatgttgccaagatgacccagagattagcaacagcaggaggcactattttacccctaatgcaagaggaattacaagaagaggtggagtttccaaaatctagaagccacaggtgcccagctagacttagaaccatagctgaggctagagctataaccacagaaggagctggaactgaggacagaaagcttgtttggtaggagctgaaatattgtagatgatcttgttgctgtgagaaatgctgcttgaggcaaattcatagaggaggaaatagcctggcttctccctatctcccaacctccagtcttccaccagtgcccgctattgcccaaagctgcccagaagccagtaggcaagggagtctgggtaacacagttttctgtggttcagaagagcctgagggaagggcagcgggtagatctaagagcaaccaaatgatcggcataatcactgataactgccttcaactgttccccttcctgcttttcctattggacagttaattatttacctagttgattaaaggctcttgtattcgtcatttacttcctttgttccctacatctagtcagttactaatgagtttaccttggaaatatctcttgattttctccgtacccctttactttctttgcccaaggctggtcctctttgtctctttttctggactgttccactcttcctagacatcattcttgcccccaccttcactcactccaattattcctttgtatttctatcacttatttttctattaacaattttttactgctttttaaaaaaatactttcccattccctatagaataaaattttgcaattcttcagtgcccttttaatgtcatcttcacccatgtatcttacagagatcaacaaaagactgaatggggtggaagactgtggtaaaatcttcaagggttccttgatggtaaacttggacatgctcactgtattagttgataccccttgaatcacaaagacagaaatgcaagggcagacatggctttaaaagtagatgatattagcatgtgttggtttctgataaaaatgtaggtgataaacattaaatcttgaaatctccaattcttgttttacttcttattaaaacaaaatggatctttattttaggcccaaacctaaagtgaaatattgaacattcaaaaagcaaatgttttttctacatacagtttctctttctaggttcatttacatgggtagcaccactaccttctagcattcccttgactgagaggttgaagaagctgaaaaatgtgtgatgaataaagattttgatggatttccatattcatctctgatgaatcattacagcaaactgccatgtgccattttctcctgctctagcagacattgttactcactgtctctctacctctgagcaagacatgtagattcagaatccttcccaacaaaagtgttccaagaaaacattaccaatatattggaattgacaggggagttacaactttttgctttccgggttcaacttaatgccctagagagtgacttcacccagacaccctctttggagcactccatgacttatttttcaaacatttccgctaatacccttacaggcagagaagaacaaattcataactctggaattataacctgaagcagcctcattttaatcctgattttaaaataattcacgtgaatattgcattctactcaataaaatgcctatttttaaatgcaaaattattcccctatcctttgacattccctccgaaaaccttggagcaaaatcacatttcaggaagatgttctatgtttattcagtcctaggttttacatactccttggcaagtagttccttgtccctggaaaaatacatatcttcatttaagaatctgaagagtagttctttggtagtgttcacaaatggctttaccaactaactcctccttgggttttatgacctcaggctccccaggtgcacattcaactttaatttgattctttttctactggcttcctttctcctcttttctactttagttatgattcagccacaagctgccttccctctgtttttgagaaaagaggtagcaatctttttctgtaaagggccagagagtaaatattttaggctttgtggaccacactatctcagtggcagctactcagctgttatagcagaaaagcagccatattcagtatgtaaatgaatggggatgactatgttgcaatacaactttatctaaacttaaatgtgaatttcatagttctcacatgtcataatatattcttttgtgttgcaggaagtcagggactctgaacagagggactggctgaagccatggctgaagaacataaattgtgaagatttcatggacatttattagttccccaaattaatacatttataatttcttatgcctgtctttactgcaatctctgaacacaaattgtgaagatttcatggacatttatcacttccccaatcaatactcttgtgatttcctatgcctgtctttactttaatctcttaatcccatcatctttgtaagatgaggatgtatgtcatctcagaaccctgtgatgattgcattaactgcacaaattgtttatagagcatgtgtgtttgaacaatatgaaatatgggcaccttaagaacaggataggagggaggagccaagatggccgaataggaacagctccggtctacagctcccagcgtgagcaatgcagaagacaggtgatttctgcatttccatctgaggtaccaggttcatctcactagggagtgccagacagtgggcgcaggtcagtgggtgtgcgcactgggcacgagctgaagcagggtgaggcattgcctcactcgggaagcacaaggggtcagggagttccctctcccagtcaaagaaaggggagacagacggcacctggaaaattgggtcactcccaccctaatactgcgcttttccaacgggcttaaaaaacggcgcacctggagattatatcccgcacctggctcagagggtcctacgcccacggagtctcgctgattgctagcacagcagtctgagatcaaactgcaaggcggcagcgaggctgggggaggggcgcctgccattgcccaggcttgcttaggtaaacaaaacagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctggagatctgagaatgaacgggcagactgcctcctcaagtcggtccctgacccctgacccccgagcagcctaactgggaggcactccccagcaggggcagactgacacctcacactgccgggtactccaacagacctgcagctgagggtcctgtctgttagaaggaaaactaacaaacagaaaggacatccacaccaaaaacccatctgtacatcaccatgatcaaagaccaaaagtagataaaaccacaaagatggggaaaaaacagagcagaaaaactggaatctctaaaaagcagagcgcctctcctccaaaggaatgcagttcctcaccagcaacggaacaaatctggacggagaatgactttgacgagctgagagaagaaggcttcagacgatcaaattactccgagctacgggaggacattcaaaccaaaggcaaagaagttgaaaactttgaaaaaaatttagaagaatgtataactagaataaccaatacagagaagtgcttaaaggagctgatggagctgaaaaccaaggctccagaactacgtgaagaatgcagaagcctcaggagccgatgcgatcaactggaagaaagggtatcagctatggaagatgaaatgaatgaaatgaagcgagaagggaagtttagagaaaaaagaataaaaagaaacgagcaaagcctccaagaaatatgggattatgtgaaaagaccaaatctacgtcggattggtgtacctgaaaatgacagggagaatggaaccaagttggaaaacactctgcaggatattatccaggagaacttccccaatctagcaaggcaggccaacattcaaattcaggaaatacagagaatgccacaaagatactcctcaagaagagcaactccaaaacacataattgtcagattcaccaaagttgaaatgaaggaaaaaatgttaagggcagccagagagaaaggtcgggttaccctcaaagggaagcccatcagactaacagcagatgtctcggcagaaaccctacaagccagaagacagtgggggccaatattcaacattcttaaagaaaagaattttcaacccagaatttcatatccagccaaactaagcttcataagtgaaggaggaataaaatactttacagacaagcaaatgctgagagattctgtcaccaccaggcctgccctaaaagagctcctgaaggaagctctaaacatggaaaggaacaaccggtaccagctgctgcaaaatcatgccaaaatgtaaagaccatcgagactaggaagaaactacatgaactaatgagcaaaataaccagctaacatcataatgacaggatcaaattcacacataacaatattaactttaaatgtaaatggactaaatgctccaattaaaagacacagactggcaaattggataaagagtcaaaacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagagctaactatcctaaatatatatgcacccaatacaggagcacccagatacataaagcaagtcctgagtgacttacaaagagacttagactcccacacattaataatgggagactttaacaccccactgtcaacattagacagatcaatgagacagaaagtcaacaaggatatccaggaattgaactcagctctgcaccaagcggacctaatagacatctacagaactctccaccccaaatcaacagaatatacattttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaactgctcaactacatggaaactgaacaacctgctcctgaatgactactgggtacataacaaaatgaaggcagaaataaagatgttctttgaaaccaacgagaacaaagacacaacataccagaatctctgggacacattcaaaacagtgtgtagagggaaatttatagcattaaatgcccacaagagaaagcaggaaatatctaaaattgacaccctaacatcacaattaaaagaactagaaaagcaagagcaaacacattcaaaagctagcagaaggcaacaaataactaaaatcagagcagaactgaaggaaatagagacacaaaaaacccttcaaaaaattaatgaatccaggagctgcttttttgaaaggatcaacaaaattgataaaccgctagcaagactaataaagaaaaaaagagagaagaatcaaatagatgcaataaaaaatgataaaggggatatcaccaccaatcccacagaaatacaaactaccatcagagaatactacaaacacctctacgtaaataaactagaaaatctagaagaaaggaataaatttctcgacacatacactctcccaagactaaaccaggaagaagttgaatctctgaatagaccaataacaggctctgaaattgtggcaagaatcaatagcttaccaaccaaaaagagtccaggaccagatggattcacagccgaattctaccagaggtaccaggaggaactggtactattccttctgaaactattccaatcaatagaaaaagagggaatcctccctaactcattttatgaggccagcatcatcctgataccaaagccgggcagagacacaccaaaaaagagaattttagaccaatatccttgatgaacattgatgcaaaaatcctcaataaaatactggcaaacagaatccagcagcacatcaaaaagcttatccaccatgatcaagtgggcttcatccctgggatgcaaggctggttcaatatacgcaaatcaataaatgtaatccagcatataaacagaaccaaagacaaaaatcacatgattttctcaatagatggagaaaaggcctttgacaaaattcaacaactcttcatgctaaaaattctcaataaattaggtattgatgggacatatttcaaaataatgagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatagagggtattcaattaggaaaagaggaagtcaaattgtccctgtttgcagacgacatgattttatatctagaaaaccctattgtctcagcccaaaaatctccttaagctgataagcaacttcagcaaagtctcaggatacaaaatcaatgtacaaaaatcacaagcattatacaccaacaacagacaaacagagagccaaatcatgagtgaactcccattcacaattgcttcaaagagaataaaatacctaggaatccaacttacaagtgatgtgaaggacctcttcaaggagaactacaaaccactgctcaaggaaataaaagaggatacaaacaaatggaagaacattccatgctcatgggtaggaagaatcaatatagtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggagacatcacactacctgacttcaaactatactacaaggctacagtaaccaaaacagcatggtactggtaccaaaacagagatatagatcaatggaacagaacagagccctcagaaataatgccacatatctacaactatctgatctttgacatacctgagaaaaacaagcaatggggaaaggattccctatttaataaatggtgctgggaaaactggctagccatatgtagaaagctgaaactggatcccttacttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattatacgaaagagcttctgcacagcaaaagaaactaccatcagagtgaacaggtaacctacaaaatgggagaaaatttttgcaacctactcatccgacaaagggctaatatccagaatctacaatgaactcaaacaaatttacaagaaaaaaataaacaaccccatcaaaaagtgggcaaaggacatgaacagacacttctcaagagaagatatttatgcagccaaaaaacacatgaaaaaatgctcaccatcactggccatcagagaaatgcaaatcaaaaccacaatgagataccatctcacaccatttagaatggcaatcattaaaaagtcaggaaacaacaggtgctggagaggatgtggagaaataggaacagttttacactgttggtgggactgtaaactagttcaaccattgtggaagtcagtgtggcgattcctcagggatctag

SEQ ID NO: 875 - DNA, 1129 bp, Homo sapiens
gttcgtggcggagagatgctgatcgcgctgaactgaccgctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggggaagagaacaccaaaggcgaaggagaagaggaacaagaaaaagaaaaggaagctgatagaaagggcccaggagcaacacagcgtcttcctagctacagacagagctaaccaataaaacaagagatccggtagatttttaggggtttttgtttttgcaaatgtgcacaaagctactctccactcctgcacactggtgtgcagcctttgtgctgctctgcccagtatctgttcccagtaacatggtgaaaggaagcaccaccagcatggcccctgtgttatttatgctttgatttgaatctggagactgtgaaggcaggagtaagtgcacagcccgtgacttggctcagtgtgtgctgagagaatccgtccccggcaccatggacatgctagaggtgtgaggctgcagaacaccgctggaggacggacttgtgcctatttatgtgaaagaagatgcttggcaggcaatgcgctactcactcgtgacctttatttctcacattgtgcattttcaaggatatgtttgtgtggatatctgcttagtgttaccacatggtattctcagcatgttaccttcacactgttgtgcgatgaaactgcttttagctgaggatatgctctggaaattcctgctcagtttcactgcagccctaatatgtacatatactgcaggagctacatataaagctcttatttactgtatatttatgctttcttgtgggtaacaagtcatacctgattaatatgatgccactttgt

SEQ ID NO: 876 - protein, 161 aa, Homo sapiens
SWRRDADRAELTASYVSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLEETMECVGKRTPKAKEKRNKKKKRKLIERAQEQHSVFLATDRANQ

SEQ ID NO: 877 - DNA, 51664 bp, Mus musculus
  misc_feature (1)...(51664): n = A,T,C or G
tacagtctgaggtcccacctccatgccttccaagataggaacaacagagctggcaagatggctcagcaggaaaaggcatttgccaccatgcctggcaagttcagttcctgggagttacatggtagaagtagagaaccaagtccagagagttctctacttatgtgtgtggtagtgtgtgtctacacacgtacatagcacaataaataagtcaacataagcttaaaagcacaacttagttatttgggaaacatgtatatattatctaaagacataaatgctattcgcttgtcttattacttctgtctggtgtttgtgaggctggggattgaacccagtactgactggtgctaggcaagccgcagcctcagcctctggccttcttcagtgctagaatattgtctaataataactcacaaaaaataataagccagacagttgtggtcattagttctagtcctcagaaagcagaggaagaaagatctctgagttcgaggccagcctggtctacagagaaagttccaggacagccaagactacatagagaaaccctgtctcaaaaaacctaaaacaaacaaacaacacttggaatgatataacagaatgtggaagagcctgggcagatggtcagttggtaatatacacgccacaaaagcatgaggacctaagttgaatccctccctcccaatgttaaggccaggcacggccgagtgcacctgtagccccagtaccagggaaggcactcatgggaatcccagagctcaacactggccagccattctagcccaatcagtgagctcactgtctcaaaagataaagtggagggcgacttctgaccttcacacacgcacacacgtacgtatgagcacatacacagacccatgtacacatccaccacacatgaacacacctacacgcacacacagcaacagggtatgaatgtaatattaaatatagaaaatatccaactagcgtgttctgtgaagacgggcctgtcccacgtttgtgctacgtgacacggtggttactaatcctgtgaagaaactgcaaacttgaggtcctgagcagctgaggaactgacgtttgcttttgatttgatttctatgagagcaaactcgaggctagtggctcccgcactggttgctttagcagagggcgagttgggggaggggaagcttgcagaatggaagtcacaaggttgctcgtggttagcaggagagctatatagttataacctgtgaatggacaagagtgactgacaggaacccaaaccagggatctgagcacattgggaagagaagttggtggagacagtaacaagtaagaagactcctccactatcaagggagggatctctgtagagaatgttctctatcgaaggaagtatgcgagcctgttacttaatatggaataccaagaggaaatagttgtggaggagtgtttaccttggtaaataccaaggaaaaagtggtttactactgaaaaaggaagaagcagggtgtgtgtgtgtgtgtctgtgctttttatataaacctttctgtacagtttgatttttacttaaacaccttttatttcttttttaaaatattatttatttatttatttatttatttctatttatatgagtacactgtagttgtcttcagacacacaccagtagagtatgcatcagctcccattacagatggttgtgagccaccatgtgattgctgggaattgaactcaggtcctatgagagagcagtcagtactcttaacctctgagccatctctccagctccaccttttatttcttattgtgtgtttgtatggacgtggacggtaggaaggcacatgtgtcagatgacaactttgcaaagtctatcctctccctcgcctttgtgaggattcctttactcactgagccatctcccaatcccctaattgatttttaaaggcatgtgtgtgtgtgtgtgtgtgtgtgtgtgtgtgtgtgtgttttgtccacatgtatgcttgcaaacaatactgcatgtgtgtgtgtgcacacatacactcctgaagaaggctagggtggtaagtaggttagtaaggtatttgtcatacaaacacaaggactagacaatccccaaaacctatacagtccatcccagtgctaaggaagcacagacagatccatgggacccactgactagccagccccgcccacttggcaagcttcaggccagcatgaggcctacctcctctagcaccatcttcctctctctctctctcttctctatgtctagtcagacttctggatagtttgtgagttcttttttcttccaccttttcaaacctctaacactagataggagagaagaaaaaaaaaaaagaggggagaggaggtgtcgccatcattagactacttcctgctgattaggggcgtggagttccttgggggcaagtttgatcatggctgtcaggatatctaatttcttcttgttgtttcaaaatcatgcccttgctagaacacaaggcaaatttatagtcagctgctgtgggcaatcagaagcagccccacatcccacacctgggattaaaacgaaaacccattcttataataattctgtgtttttaaagaaaccaaaattctcactacatctatgtctccccctccacgtgatccaatagtgagaaggaccttcagtggcagagactccagcagctgtctactgtggcccctggacactgcataggctgcaacaaggtcttcaggcgtctgtctcggcggtatccttgcaggtaatggaaaggcacagaagctggaacaactcacaggccctttgacccaggaaaggaaagaccaggggaactgcctggttttgtttgatttgtttggtttttaaggactttctctttgacatctctttcagcatgtatgtgtacgtgtgtgacacacttgcatgcacatgtgtgctgtctcacatatgtgaaagccagagaaaaacttgcagaagctggttccctcctaccttgtgggtttcagggatcaaactcaggtcacctggtttggtggcaagtgcccttaccccctgagccctctcaccaactgttgtttaattagttattttgagaccatgtaccccaggctgacattaaactcactatgtgacccaggtagaactcaaatgtatgatcctccagtttcaatcactcctgcatgctgacattatcaatgctcatcaccacgctagggtgtgggaaatgggtatttgtaaagagccacttgagcctggccctacatgtcaccccatctggctactgctgctaagcagaatcctaaaatagaacagtgggcaggaccacaaaggaaggaaggtaggtcttggaagacgaggctggtaatctcccagcatgcactgctgggttcctgtctggggagagggtccctgcacctctgtacaaaaagaacactctcttccctcccactgacttcatggggaagatgaacgggagggggaaacaagccatcaggagaagctgccacctcaattagagactctggagtgaggtagggaaagaggagcatcctgacctagccaaaggctgccctgctggaccacgaggataggcagatcgtcccctagaaaccagcccagacttccctgtctctgtttccaggctctgtggaggcctggtttgccacgcctgctctgtagactacaagaagagagagcgttgctgcccaacctgtgcccagcaggaagaaatccaggacacctgacagcacaaggcaactaagaccagccgccccaccagttcactctccctgtttctcttcccagccctgatgtctgactactcttttcttctgcaagctggggccccagcaccgctgtggagggccagagggaacagctggcagtccacagataggcctagctctgcgttcctgtggaagggactgaggggaacatgccaaagctctagaagcattgtgtctgatgaggaagacatgccataacctctctgtaaagtcccttgaagcacagtgagtcgtgaccatgaataagagcagcccagggcccagatgtttcctagccaccctccccctcccccatcacccataagaagcgaagcccaaatacactgggctcttcaggaacctcccctccgatctccttcagagatcattgccttatcttgtgtttcacagatttactgagtcgttgttgacatagaataaacattgtgtaagtgtgatgggttttcactctaacacacatctgtcacgccatctctagacacaggcatcagatccaaggcttctgcaccgtcctccagctgctacctccatgctgaggtaaccactgaccctgcctcatatcaccttcgagcacaggcacttcctagagatttgtctagatattacatacacctctggttctttcctactctgtgtacatgtgcgtgttcgtgtgcatgtgtgtaagacatgcatgcactcaacattcatgattcatgcagaggccagaggataacttgttggagccaactctttccttccatcataccatctgtaaggaactggctgtaagaatccatgcaggtaccaaactcccggacactcaaggctcttagatatataaccaatgcatggtttcacacatgcttaaaccaattccagattactgaaaattctggatatgttataaatgctatgtaaacactgttctttctgctgtgttgtttgggggaacgattaccagaaaaagtctgaacatgtccagtgtagatataatttttcaaatatattttcaacctgcattcaaccgtttgaatctgtgaatgcagaaatcatgaatgcacacatggagggactcgtggctccaggtgcatatgtagcagaggatggcctagtcaatcatcaatgggagaagaggcccttggtcctgtgaaggttctatgccccagtatagggaaatgccagggccaggaagcaggagtggatgggttgaggagcagggggaggggggaggggataggggattttgggaggagaaattaggaaaggggataagatttgaaatgtaaataaagaaaacatataattaagaaagaaagaaatcatgaaagcataccccatgtatacaaggggccaactctatgttcccaagaggtctgtgttctactgtcccatatgtcccatatgtcaacatatgagagttccggctactcttccggacagctggctgtgctgtgcagaagaggcatggggcatagtgctctctgtcctttcctttccgttgttatgatggcttaggtacactgtgagtacctggaactcagtcccggtgactcagcattggagctcgattagtcagattctgataaagacaggagatgagttgttcttgagtaagatcatttcccctgcagtctctgagaaggcttgtgcaaactgtggtgttcatttactaactgcagtgcttctgagaaacctgttctagaagacacataggctcactctataacaaggcaattagctgccctacccagcctctagagaacattataaaccctagacagacaggaatccacactgtccccatccacgctgctggagcctctacaatgcttgggcaatgtcgtgccgccaagcagagtctggagacagcctttaagggtcttggccacctagcattgcatcctattgcttgcatggagtaagagtttagaaaacaggagcttctgccctggagcactggtaagaagttgccctcagcaaatgcaatcacaaggtgatggacaaaggagctccccccctcaaacaactggggtccagaatcatcctcaaagagagtattccttcctggggattggcttaacccatgtaattttaccagagtggagtttgtaacctattagcaggaatcccagcatggattctggccttctttgtaaacagaaggaagtgagagtaataatagaagccatttttctaagagaaagagggatgatcaggaaaagaactctcacaggaaggatttggaggcaaggaatggggagcttgctagagctcccttgtttggacaaacgaagaatcatgctgagttccagcctttaggccagctctgtttctgagtagcctctaccaatctgttcaacaaaccagctgaagagaaactagaaagtcttcctagactttgggaaccctttaaaggggagttccacagtagtcaccatcgaccaccccagagcctgtccctgcaaggatagcaggcttccagcagtggctttaaggaccatacggaatcacaacagcttctacaggggcacatgggagacacctccagtgagtgtccccagtagcactctgaagaggctggagccctgcttgagcatgcagggtctgagccaatgaggtcagcattgtcacaacttcatttgtactgccaggctggagaggctctgagaggtttgtatcacatcacattgttcttcaagctgtgggatgctctcaagtccatcaacgccccccccccaacacacacacacacacacacacacacaaatgttaccagtttagcagtgttcgccaaagaagcatgaattgctcatgacactcatcacactggggttcatttgggaagacagacggactcacagctgaaatccctgcttcaagatgcaaagggacaaacagccagatgactgattacaaaacctggactgaacatggaagcaaaaagaagaatccaaccagagggcagaaagagtatcccaagaaaagggagtacactcgagccccgcccctgactggaaaaacctctagggatccgcacagggttctcagaggttgaacagttcaaggtatggccagaagtaaaagaggtcaactacaagaataccatgtgaccacatcaggactgacttcacctgaggctgttgagggtccttaaaggtcttaaaggggaatatggagtaagcatatttatattttaggaagatcttcctctctgcagaatatatgataggttgaagggaaagacttgaggctgcaattgtgggaggcgcaagaggagggagaggcagaggatgaagaggaggaggaggaggaggaggatcattctaaatgcttcacagagacttgtttgtccctgtaacaactatgggcagtagctgttcactctttgcccattatatgaacggtgaacctaagacccagtgagaacagattgcttgctgtaggtttataacccaaaagtgaattctaactgagccaaccctgctcaggaacccacgagcattgcataacatctccatgtttaggagagagaggatgaagtgttgcctaacactgtctgggaaggtggtatagagaagataagcaagaggagaggagaggaagagtgggggtgggggagagaagggaatgcaagtatccagctggggtggaggaggagagaggaaaggactgtcaggagggacaacacaggtggcaggagtggatgtggcttgacgctcaagcaaaggttctcaacgtgtgggtcacaagtcctttgggagtcaaatgactctttcacaggggttgcacatcaaatatcctgcatatcaaacatttacgttacaattcataagagtagcaaaattacagttatgaggtggcaacaaaaataattttgtggttggggtcatcacagcatgaggaactgtggtaaagggttgcagcattagggaggttgagaaccgctgatctagactgttgttcaaattgagtccgctctggggagcttaagggagactgcaggtgatcagtacatatgatgttggggcttaggaaggaagctggggacaacaggtgctaaagacactggccagagggctggagagatggctcagcagttaagagcactgactgctcttccagaggtcctgagttcaattcccagcaaccacatggtagctcacaactatctgtaatgggaatctgatgctctctcttttggtgtgtctgaagatagcgacagtgtactcacatacataaaataaataaatcttaaaaaaaaaaaaagacactgaccagtggtcctacctaaagccacagaggccattggactcaccatgaagaactagtagactgagaagaccaaggtaaaacctgaaggcaaatgacacccagagaaaataatggtaaatgcaaagaaaacaagccagcaggactcagtgatgtagacatgaaagataaggctttcaccaccataaaatttaaaagcatccagtagactcagtaatgcagctcagcggcagagtacctgagtatgcgaggctctgacttctgtccccagcatcaaactaagcaggactgctgagacactcagccagcggaagcacccgcagccaagcctgacctcctaggttcgatccccggatcacgcctagtcgaagaagaaaatcaactcccacaatttgtcctctgactcccacacatgtgctgtgggacatgcatgggcctctcacacaaaaacaaataaatgtaaaatgatttaaataaataaaccaaaagcacagcaagctgagaggaaacatgttagcacgactgagagatgttcaaaatattatactcccaagttaggtagcatttccacaaagcaatgacaaaagaatcataatccagtgcaaaaggaagatagatcagaataagtaattcacggaggaaactacaagtagagcatacagtttcagggaaagagactcagccctacctgcctacaggcaaacaggtagatagatgggcaaacagcagtcaagtagactgcatcaatagctagcgggggaacctagccactgagttgaaaactcagggagagtccagaagtctctgtttttcagcacttgacatatacgagcgtcagatgaccggttgatggagtcagcattgcaggatcagagtctaccactttccgaggtccagatacaatcttgggtctagcttccttgatttcattttaatatgcccaagtctctctacagtctcaattcatccccaacaaatttgtaggataacaccgtttttattcccaggaatgtcattcatcaatctatgctatatgggtggtgccaggcagatggtgatacttgagagtccacgtggggggcataatcaaaatagggtcaaaaagtgcctcttagggcaaaagatgtctcaggacaaaacacagcctgaaaacccactggttcttttataacacggagtaccttagaatagggcgtagcctgatctcaacaatgtggatgatggttatcactgggaaagatttgagtgaagagaaacttctaggttctacgtttgtgcttttgtcttccttgtctcatctccaatctgcttgtacttagatattattttgctaataacaattcaactgaagaaaaaaggttggccgggatacctgcactgcccagcccaggcatctctagtcacctttgcagagtaggaaaggagcccctttgtagcgtgttgttgagcaggaaataagaggcaggtaaggaagaacatagcaactgagaacagaggcaaagggtttctgagacagagggagaagggctaagttcaggctgactttgaagagtcaattgtggcagatcctcacccggaagagaggcagaggcccccagcaggggcaggggctcacaagaagcggaagctctcttgctgaccctgagaggaagaaaggaagtgctaacgcaagttcagccaggtccatctgcagggtctgggacatccacatcttccttgttaaaaaggaggcataggctgggaaggaagctgacctctaccttcagattggcaggctcctctagaagccatcagaaggcatgaaaatcccaagagctcacttcagaatcaccaggtgaacctgagcctggagccagagtcccagaacagcctagccgttcctctataggacacctcccttgggggtgggacatttggtccagagggcctccaggacttccccatcggtagcccaggtcagtagtttcctcatcacggctgcctcactttcttccagttcaaccagccctgacagctcccaagccttgagtcacagagagttgggagccactctgctcacaaacagcgtcgtagaactactgcaggtaggagagctgattggtcacggactagggaatatatttctggtaaaagggaccagggaactctgcctttcctggagccctgggaagcggcatgacgcattgtagaacctcagagctgaggtctgcatcttcagatagctggtgctatatcaaagcactttttataataagcatgctctatatctgcatggtctaatatggaagtcactggtcacctgtggccactgagcccttgaaatgtagcagcgacagccactttagtaaatttatttgtttgtttgtttgtttgtttgtttttgtgtgtatgtgtgtgtgccgtgggatactagtgaaggtcagaggatagtttcatggagtcagttcttcacctgggatctgaggatccaacccaggtcacctgatgaacagcaagtgcttttgccaacaaaaccatctccccagcttccaatgaagtgaattctagtctatctcagctgcttttcatttagagagttaagtggcctgaagctacaattctgggcaggaaagacctgaaacaaaccagtgtcttccaggagagcaacaaggtccggagagagacggtgcctttaccctgacccccgagggcaggaccgagattagaactcttttttttttttaaagaaacaaaactatgcggcataggctacataataagacaaaacaaaatttaaaagaaagaaagaaagaaagaaagaaagaaagaaagaaagaaagaaagaaagaaagaaagaaaagcagaagtgggtgattgagaaatgcccaatctgggttcatttcccatcccagtggtattttgtctgggtacagtagcagttacctatggagctaggaaacctgaggctggctgaggccaggaccctgctcctcccagcatttgataaatgaaaacataaggagcagactttaatatccattttaaaacgtcgaccgcccagttcagctgcgtctctcaaggtaagttgcctaacccccagggactccgtttcctcatccagaacatggcgacttcattgatgtgagggttgaaagacaaaatagatggtagatcccctttgcctgtgaggcggcaagccagtcagccatccagattacaaccagatgacaactaataagacagccattatccaggtcagagcatgtgaaggtgcctacaggagttggccctgaaaactaggtaggctttcttctctccctgactcattctcagtctggggatgtgatgggagaggccagtcacctgtagatacactacttcagttctaagaatcacagtataagctatctctgtggtatgtgtgtgcatgtgtatgtgtgtgacatgtagctaccacacaacccatgggttgtgatcctttctataaaaatctcatcgggtcacttcccagtacgaactctctaaatccataagatgactccatccgtgggcggtgggctgagaattcatacttaaaacatcaaactcatctcacgccctcgggagctcctccccctcttgagcaatctaacccatccctcacttcctcttaagaatttcactgctcttcatgggtcacagctgcctaccttaggtgtcccacaggtgaaaagccagcatcctggtgagtctggaacaccccctaccaccacctagaatcttctctctgtgtcactcaacacaggacctgaccatgagtcatcatgcccctccttcctggcttgactcctaaacattatgcctccttagcacagaggaagggcttctgacctcctttctgtcacctggcaaaaactgcttagaactacttgcaattcagcccctacacttggcctgccatctttccaagtctgcctaccctccttgcctaggctgcagttgggtctggagatagatgtaccaggcactgaggactctcaaacctgtggggcatttatgggctgtatttctaaagagaatgagaattggggtcagggtacaatgacttagttttctgttgttgaaatgtttcccagccctggagcttctggactaatgcaaattccaaggagttggtacttccattcaatccaggagctcctacttcatcacagaggacatgacagggccctcagttgaagatgtttcctttgccatcccagcaatagctatttggttcatttgcagcctaagggatagcaaaaagatggtggtgtccaagcttgcatgcttgactgaaaggtgattcaagatcttagatctatggggctgtgactctgtggcagagcgggtacttagcgtgtgcagggccaatcttcgggaagcatgataaagcgaaatgcttaggagtgatcatatctaatataacagggacgatcctccatcagtaaactaaaggcagcgcgtggcgtggacaaactaatgacgtgaaatcccgctgcaccacaacagccctgtggtcgcagactgtttactgggccttctgggtctcatcgtccgtcccgccagcaatgagctaattatagcacttgtgatgactgagggaaatcttgcacaaagcagatctcaactgtcatccattccttccctctgtgccttcagccatgaatgcattcctttcagagattagtatgttaaaatgcaaacaccaactcttgtcccctcgcctgtggctgtgcatttgctggtccctcctggccctctcctcagagtccaccttccatcctggcctgcatggtctccctgtagaacactgaacctgcctttgctgcctggacagccctcacagtcctgcattttatctgaattccacaatctagctacctgccgaattcaagtgcacaagttaggggagcaagcttttatccaaccagccactttcctaacttcattgttttggttttcaaatgtgttgttgttgttattgttgttgttttattgttattgctgctgctgatggtgatggtgatgttttgaatgaggtctcatataggtcaagatagacttgaactgctttgtagctaaagatgactttaaagtcctgatcttccttcctctacccccagtatactgagtgcggggattgccagcagatgccatcatacctcgtttattcagttctgggagccctacctaggactttgagaatctcaggcaagcattctatcacctgagctccacctctgcccatttttgtcattttctttacaattatttttaactttttatgtacatgggtgtttcacctgcaagtatgtaggtttaccctgtgcatgcctggtacctgagggggacagaagatcccttggaactggggttcctgggagttgttagctgctgggtgtgtgttgagaaaccaagcctgagtacactacaagtgcagccaatgctcataaccactaagtcatctctccagccccattttttttgttattattattattattgttttaatatttgtatttgtttgtaagattgtacacctttttaatgttttactagcatattttagctatgcatatgagtttaattataaaaatttcatatatatgtatatatacatatttacatatgtgtatgtatacatgcatatttatatgtgtgtacatatatacatatttatatatgtatatgtgtatatatactgtgtatagcatatatgatatattatatacacatatataaatcatatataaacatatgttttttttgaaacagggtcttagttgtcctcaaacatgctatgtagccaaggatgtacaaattatgtatatatcatatatacaaattatatctatacatatatagaagcagagttgtatatatgtatataatatattcaaattatatatgtcatatacaaatatttgtatatatgtatattatatatacaaattatatatatataaattatatatatacatatgcatatataaatgtgtgcatgtataaaatttgtacagccttggctactagcatgtttgagcccagccaagtccctgtttcaaaaaacaatcttgaagagaactgtagtttttatgccccacaaatatctcacttattatttattactattttgcctcaaatgtttactgctatcatttacaaacttgaaggaaatagtgtcttccttgcaatatacaagccaatggaaaaatcctcacgccccagtttcttggggggggcggggtaagacaagaatcagggtggctttgccgtgcaataaccttcatctctcctctattgacaggattaagtttacctcaaagatgggagaattcaaggtggataagttcaacattgaagatttcttcagtggagatcttgatattttcaattatagctctggcatgccctctattctgccagatgctgtcccatgccactcagagaacctggaaatcaacagttatgctgtggttgtaatatacgtcctggtgactctgctgagccttgtggggaactccttggtgatgctggtcatcttatacaaccggagcacctgctctgtcaccgatgtctacctgctgaacctggccattgctgacctgttctttgccctgaccttgcctgtctgggctgcatctaaagtaaatggatggacttttggctcaaccctgtgcaagatattctcatacgtgaaggaggttaccttctacagcagtgttctgctactagcctgcatcagcatggaccgctacctggccattgtacatgccacaagtacactgatccagaagagacacttggtcaagtttgtgtgcatagccatgtggttactatcagtaattctggccctgcccatcttaattctacgaaatcctgttaaggtaaacctttctaccttagtctgctatgaggatgtaggtaacaatacatcccgtttgagggtcgtactgcgtatcctgcctcagacttttggcttcctcgtgccgctgctcatcatgctgttctgctacgggttcacactgcgcaccctctttaaggcccacatggggcagaagcaccgggccatgcgggtcatcttcgctgtcgtccttgtcttcctgctctgctggctgccctacaacctggttctgttcacagacaccctcatgagaaccaagctgatcaaggagacctgtgagcgccgcgatgacattgacaaggccttgaatgctacggagattcttggcttcctccacagctgccttaaccccatcatctatgcctttattggccagaaatttcgccatggacttctcaagatcatggctacttatggccttgtcagcaaggagttcttagccaaggagggaaggccttcttttgttagctcgtcttcagcaaacacctctactaccctctaaagactgttcacctaaacggtggcccctcggggttccttcttgtctttcagcatggctcattaccagagactgtggtatttgaattgatgcagcccctcctctacaattacagggagaaagaggtcacgttcttagcagagcccccagagtttagaaccccctatattggctgtctgctcccttccatcttggtatgcctactgatagagttgatccatcctaacactagaccccaaacactcttttctaagaagcacacgttacaattacagtgagatactgcctcctacccatcagaacagttagcagtaaaaggaagaggtggaggagagaaaatggcaagtgacaatgaggaagtagaaaaagggaactcttcaccttaccagtagacgagtaccagagtcccctcacacaggaacatagcatagcagttttccatttaaaaaaaaattaaatatagaattggcacgtaatccagcaagtccatctctaagtagggtacctaaaaaaattgaaagccagggttcagacatttgtatgctgatactcacaacagcattattcatcatgaaaatgatggccaacagatgaatgggtaagttaaacaaggtgtctctacacaacaaaagagcgtccacaatgagaagtgccaaaaataatcaaatagtgttgactggaggctgggtgaggaagggtggggagttcgtgtagaagacacagctccagttagggatgatgggaaagccctgaaggtgggccctgatccctgtgtagtagtgtgaatgcactcattaccactgtaacaaaagtgttaaaatgaaagctgagtattgctccctgggagagtgcttatttaacatttctaagaactcaggctcaaatcctagcacctcgacaaacaaacaaacaaacaaacaaaaaagctaaaatggttatttttgttatgtgtgttttacctcactttaccaaaaatataaaaatctaagtctaaaaaatgttcaccatcccataaacaaccaccaaacccagacactaggcagatgccaacaagaacctgctgacaggaggctgatatagctgtctcctgaggagctctgccagtgcctggaaaatacagaagtggatgctcacaatcatccattggatagaggacaaggtcccaaatgaagaagctagcgaaggtatccaaggagctaaaggggtctgaagccccagaggaggaacatcagtatgaactagccagtaccccctcagagctccttggaactaaaccaccaatcaaagaaaacacatggtggaacttgtggctctagctgtatatgtagcagaggatggcctagtcagtcatcaatgggaggagaggcccttggtcctgtgaaggctctatgcctcaatataggggaatgccaggaccaggaatgggagtaggtggattggggagcagggggagagggaagggaataggggatatttggaggggaaactaggaaaggggataacatttgaaatgtaaataaagaaaatatctaataaaaaaatgttctttaaccactgaaccaatgcagaactatctaccttataatttcttgtaaagtgtgactattaaatgtcgttttaaaaaatatatagaccacttgtagttgggtatttatttcagtacttccaagtagacaggcaatggcaagcagaagtcctggataagagtttgtgttgttttaattggttggtttttttttagcattcacacacacacacacacacacacacacacatacacgcaccatgttaccacatgtatgtaggtcagaggacatcccgatggcaagggtccttacttgctgaaccatttcactgtccccagagtgagatgaggacagagccctgcctgtccctgcctgtctgcccacttcatgcccagcccatgtccccttcaactgaacatggatcatttggaagaaatgtgtgctggatccctctggtattcccacattcttgcactcaaaagcatcaggagcaggcttagaaggcacagaagttcagctgctcagctccttggagaagcgcggaggcagcagatcccagggagagttcttctcccctccattctcctcttcccaacaaccatcctcattcaagatgtggcaagcaggcacgagtggggaagtgatttgtaacctgtcagaggagacaaaggacttaattcattcttggttttgcagggaggggtgggtttgagtgtgggctgggttcagtttaagtctcatgtttgccaggttggcctgaaacttgctatataactggggatgaacttgatcaagagatcctcctgcctccacctcccaagcactgggattacagatgtgtaccaccatgtccggtttacatgatcctgggatggaacccagggctctgtgtgtgctaggcaaatattctaccaactgaggtataaccctagcttctggatgatcttttcggtatacaatgactgacagatcttccgagggatcgggacacagcaatgccctaaacaaacaaggtttgtctctgaagggtctttgtcaagaggggccctggttctgagcagcctgctatggctcttgctctaagagggactgaaccctatagttccacaggtttgagcaagagggcagaatgaggttctagggtagacagctttcactcgcaatttatgaaactgttcagctaaaaggattaagtcagtatacagcccctgtttaaggagcattcaatgccctgcactgagctcagaatcaggaatcaggatcaagtgtgactcagctatacctctgattcagcaggacggaaatgttgaagaacacggagagttgccagagggaactgttactcttcttcctgagctccgcacctgaccagcttgctcctcaagatgactgtcagagggaggaggccaagttaaggttcacctttgttccaggtctctgctctctgctcctcaaacaaagcctgggaatgccactgtccacagaaaatcaggaagatacaagagcccagagcaaaagcagctgaggtttggttgttctgatgtgaacactgttgattgcccacacacacttgctctctctcatatgaacagtcttgacacaagtccctcaccagttagagcatcaccaggaaagggcaaatgcagcttcctttgagctgttgattcttcttccttgccacgttctagacccgagtcccacggtctaaggccccagatctacttagatctgtctgttttgaacctgcttttcttgcttctgaactatgttcctctccttccaataacaccttctgtcctgatcctgagccatctccctctgagttgatgatgcatgcctctccacgcacattcccagtctctgcaggatggcctcttccctttattgagcaaaaccaagaggctcccagtctacttgaggggcatttaaaagagtccctctgggggagtagggatgtagctctatggcagagtgttagcctggcatgcatgaagccctaggttcaatccttagcacactataaaccaggcatgatggcacacacccatcatcctagctgctaggaagtaaaagggagaatagaggttcgatgtcatcctcagctacacagcaaattcaagagcagcctgacctgcataagatcctgtggcaaataaataaataaacaaataaatgcccaggaatgtttcctagggttggggatgaagctaagaagtgagggatgtagcttacctagcatgctagaggctctgggtttgatctccagccaacaacagtaacgacaacaaccaataatgataatagtaataatgatcacttccttgtttatatgctccactcatgtacatggcacacagactcccgtggaccaccttcaggaccaatgaggtcagcaggttcccaacccataggtactgaggaaactgaaagcaagctgggtaaagcaaccaagtgctgcctcatggctagatggtctacaactcacataaatactcagctcagagtatttatgccaacttttgccagatattttgcctttgtgaccacaaggtcacatactatcacccagcataccctcccccagactgacctagaactcaatatgcaggtcaaaatggcctgaagctcctgagtgttagaactataggtataaatattacaagggaatccttgtctcatttccagcccttgaaatatagtgagaaattgtgcaggtaacttccccaggggtctcacacatcctggtaatgtctatccattttgtctgtgcctagactcatgaatgcagtaaaatagctttgctgagtatccgtggtgatgacagagatgagagccagctgagaagtggggatattaaagtggcattgctgattgtccatgatgataacagagaggagagccagaggaggagtggggacacagctgtgggaccaggcttggactgatagatgtgtactgctctgtactggtagatgggcaaggaggtcatcagagcacaagataaaacttaaagacaggcaaagtagatccatcaattgaggacccctgctatgtgagtcagggttcaaccagaggcacagaaccacaaggagacacctgaggtatgacttcatatcatggtgggagctgtgaggtagtctgtgtcaggcccttggcgttgtttgtttgtggaatgagaccagaatctcgcaggacaaccttgaagaaaaaaacagacatgaagtagggtacacagagagagaggggcacgagcgaatgcacacacacatatacacgcatgcatagtggatcctgttaggacacattgacacctacgttggtgcaagcttacatgagtgactgactgcagatgccggtgacctgcatcatgaagaaaaacgtttaaacactgagagactgtggatgcagctgctgttccacaccagcacaacaaccagcagataaagagcatgttacaggccgtgggctgaccttccaaagcattaacaagcatactgccagtgttcactttacagcttccagatctcacacaaaggtccctgccggcttgtgctcttctggtctgaaaggaagaaaatgtgggaaacagtcccatctgaactaagttggctcaacataactctcaaaaacaaatgcaactaaaacgctaagcaaaggaaaggtgaccacaaacattagggagcctacactcaagggtaagagcggggtgctccaagaaagcaggtaaagaaggttcttaatctaaatgatgagtacctgagagtccttgagttattgtgttctttaagctatacgttttctgtagccacttgtacatgagctattatgatgaaaaatgtttcagccattaaagccagtagagtcagtaaggagaaagagataagaagggcagcttgggccattttgagggtcattgcagggagtcagatccaagctttacagcctacaatttgaggttacctccctgatcataatatcctacctccccattgctgataggacagtgaaccaggtatcttcagagaaagcaattaaagaatgcctttttaataatgtgtttgttttgtttttgagacaggatctcattacataacctaggccagtcttgaattcacaatcttctacctcagcctcttgagtgctgggttagcaagtctgcacttccatggctggctgatgaattctctctcagtgtgcacgctctttaatgaagaaattgcacttctaggaccctgacctacagccgtgctcacttagctcacatggagagggtagactgcagctctatgtgtaaaagccaaagcttgaagacaaccaaaatatccatccctagagatatggtgagaaaaacaatgaaattatgcccacgctgtgggattccttgaatgttctggtttaggaacaagactgaaagcagtatggtggttcatacctacagtcctaacacgcaagagtttagggtcattttgacctacatagtgacttctaggtcagtctggaagagggtatgctaagctaaagactctagaacagaagataatgtactatgtggtactttgtgaagcaaatgcccagaaaaggtaaatttatggaacggaaagtagataggtgtctgtttgtgactgggggtaagacttgggaacaagattgactgcaaacacgaatgaggagtctcctctcttcttttttgtggtgctgagaatcaaacctattctagtcactgtcctggtgctaacgtgccctgacgaaagcagctcgaaaagaaaaagattattgtatcttacagtttggtggcacaatcgatcaataggggaaaggcatggttgtgggaacttgaaggagttggtcacattgcatccccggtcagaagcaaagagcaaagaaagaaagctcctagctttctctttcatatgaggtccagattccaagcccagagaatggtgccaccaactttcatgatgagtttttccatctcaattaacctaatcaacatagcataatctctataggcatacccagaggtttgtcctctactggttcttggtctatcaagttgacaatatcagccatcatgggtcctcggctggtcatcacagtcatcacacctgatgacctgagattgatctccagaacctacatggtgaaaagagagaaattactgctgcaagttgtcctctgacctccacgaatacaatacaacctggacaaacaccaactgtacatggtgttgttgagtgtgcatcatgttgttgagcacacacatagacacacatgcgcacacacacacacacacacaaataaatgaatgaatgaatgaatgaatgaatgaatgaatgaatgaatagaaaatgtaatgaagagagtcctgaaactctaggatctaaactcaagtttaaaactcactgaccaaaagcaatgaaaaaaagcactagttttgctaaaaagcctccctgagggaagcataagcaatttctccaccttcttctagggtctcagtgacagagttagattccaccaaagctcactctgggggttcattacttatagagcaatgggtgaagggttgtgggcaggaacatagatgaccttaaggcagccacactggaggacctacaagcagcactggtgaaggttccctgaactgtgtagatgaagcttcctgccttagtccttccctgcctgtatcttctagcccctctctgaggctctgttcagttagggcagagttgcatacaactgattgagaggtgtgcctggatacttaggtaaaggtcccacaagcatccttctgtgaaggaaggctcaacagtcaacaaacacagatgagttgatggtgatgttggctggttagcttgaaggaaatcctatgcaacagcaactacctaagtgggaaatgagaaacatcctcttagaatgtatgtggggatggcactgtcacgttcaagaatgtgtcctataccctccctcattgcaatcctccagtctccagcacccccaagctctagccaaaggaaggtggcctggcatgaggagcttccctgatcactctggctgcccgagggcgagcagctgtggaaggggacagtgttaaggagaagtcattatggcctcaactcaaggcccttcccccagcaactcagcaaaagacacctttccagagaaaaaggaggccggatacagtactgatttctcaacagggccttgcaaagtgtgatgtcaaacatgttcccctggccatcaacagcagggccagcttcccctccgtgctggctctgtgccatgctgacccagtgggaggctgaaaccttggctcctaccaggtggcttgtcctccgtttggcctcttttctgctctatctttctgccagtccatctccaaattctcctaattcaggagtaagtaaggatctagaaagggtctaggggaatgcaaacggccaagaaacatataaaaagttgccctgccacactaggaacttcggagataggaataaaataaaataattgtagtttttcaaagggagaggtagggcatagtcgcacatagctttaatcctagcactctgagggcagaggcaggagtgtctccttgagtttgagttcagcttggtcctcatagtctatgagtagtctctatgagtagtccagcttgatctacacagccagttctaggccaatcaggattacatactaagagcctgtctcaaaaaaaaaaaaaaaaagaaagaaaagaaaagaaagaaaaaaagaaagaaagaaaaaagaaaaaaaaaggaaaaatctaaatgagcaatttaaattaaagggaagatggggttaactatagtagcagatgtcagtaatggaattccagtgaggtgggggcagggagaaaaggaacataggtcactcttagctacatagtgaactcaagcccagcctaggctaatgagactctggctcataaaaacaaacagcaacagaagcacaaaactaaaagaggttggtggggaatagctttgagttatgtttggccacctccctccactgttccaaaaggacttggagaactgtgtggacatgatcctgcatccaatggttctggcagaacacaaaacgtgcccagtcctccttattcaacatgcatagcaacaccaaggctgtggtggaccccagccaggaacagatggatcttgagagccaactcagaccagcctcggaaactgaccatctcaaaaggacctcagaatggagatcagggctccgcccctacgctgcttcctggtctctttcttgatctttaacttcaaatcagaccaggatggtgttggggaaacaaacaaatccaaggagtgctaaaggaaactgcatggccagttaaaattagttaagacctcagagcgacgaggtagctcagcaggtaaaagtattggctacacaagcctggtggcctgggtttgattctgggtctcccaatctctgtctctgtctctcccttccccacttctctcctttactcctctccttcccttcctccctcccttcttctttcttttcttgcccaacacagtggctcctgtcttcagtccactaaattccaatagtgaacagggaagcgacaagccagaagcttgaatacttatcacaggagcagaaacaaataaggccttagctcataatcaaggtaaaagggaagggctgaagagatgactcactggttaagagcactgactgctctgccagagattctgagtttgattctcagtacccacattctggcatacaaccatctgtaatgggattgaatgtcctcttctggtgtatgtgaagacagctacggtgtacttatataaataaaaatgaataaataagtatttttttttaagtggaaggagagaactgactactgaaaattgacctctgacctccaaaaacaaatctgtgcacatacaaataaacaaatattttttaaaaattagccagacattaatttgctgtcctacaaatccagacccagagttcaacattaaccaactagacttgacattatttatatatctagaaccaaaccaaagagggtagctgttgtttgaaaggagatctaatgatgtaacccaaggtattcattcatccattcattcatttttaaaaatataacaaaattaatataataagataaaacaaaaactaccacatcaaagttggacaagacagaccgacagaaggaaacaagcccaagggaaagcacaagagtcagagacccacttgttcatactctcagaaaccccataaagccgggcatgggtggtgcacgtctttaatcccagcacttgggaggcagaggcaggcggatttctgagttcgaggccaacctggtctacagagtgagttccaggacagccagggctatacagagagaccctgtctcagaaaaaaaagaaaaaagaaaaaaaagaaaagaaaagaagagaagagaagagaagagaagagaagagaagagaagagaagagaagagaagagaaaagaaaagaaaagaaaagaaaagaaaagaaaagaaaagaaaagaaaagaaaagaaaagaaaaaaagaaaccccataaaaacactaaactggaaagatgtgatgtatacacagaggaccctgcagacccacgcagatcctgtgcttgctgcttcaggccctgtgagtccatatgagctctgctcatgttgacttagagggccttgtttccttggtgtcctctgtccaccctggcttttacactctttctgtctccctgacctctgaggggagggatttgacggagacatcccatttagtgttgcaagatctctcgctctctgcatactgtctggctgtgggtctctgtactgttcccatctgctgctggaggaagcttcctgatgatggctgaacaaggcactgatcaatgggtatgacagaatgtctttaggagtcattttatcactacatttttttcttctttttaaaaaaccagtattatttggttttatgccaggtccctgggctatctagtctcagattcttggtcaccaaagcaatgtcagatatgggttccatctcctggagtgggctttaaatcaattagttattggttggttgctcccacaagctttgagccaccactgccctagcatatcttacaggcaggacaccacggtagataaaggatttgtggctggttggtgcttatgttcttttgagagcctgcggagtacattcctgtagcagagatcctggaatggagaagtgaaggctttatatcatcatcagcttgacttctccttcttcaatgagttgtataggtgtcgtcttcggcagaccttgctgtcagtttgcagagagcaacctagagtcttggcaacagccggggttgcttgggaattcccatggggccccactggctaataagtcaattccatgtaaccataccagtactaggggcttcatatggtgacaagagatggcccccattatttggcaatttcagttagattgtctttatatgtgtatatattttaggaagtttctactgtattaggtttccatggctaccccttaaataccccttaaccttggctgtctctccctgtattctcccacatccttccctcaactctccttctccacatgacccccccattccagttcctcacatccgttcacaactgtcttttccatttctctttcctaaagatatctatctgttctttctagactcttattctatacctacccgctgtggttctatatattgtggcttggttatcaatgactacacagctagtatccacatataagtgaataggtaccatattcattttttctgggttacctcactccggaagatttttccccctagttccatgtattttcttgcaaatttcacgatatcgttttctaacggctgagaagtgctccattgtgtaaatgtaccacattttcttcatccattcttctgatgagagatagctaggttgtttccaatttctgggtatcctgaatacagcagcaatgaacacggttgagtaattatttttgtggtaaagaatcccttgggtatatgccccaaaatggtatagctggatcttgaagtaggtcaattcccatcttcctgaagaactgatgcactgatttccagagtagatgtacaagtttatactcgcaccagcagtgaaggagtgttcttgctattccacacccttaccagcatgggctgtcactgacaggagtaagatgaaatctcattttgatttgcatttccctgatgctcatcaagttgaacatttttttgtttcttagccatttaaatttcttctattgagaattctctgtttagatctgtatcccatttttaattaggttatttgttttgtcgatacctgtgttcttgagttcgttatatattttggatattagccttctatcaaaatctggcaaaaattttttctcattctgtaggctgacactttgtccaaatgacagtgtcattttcatgagatctcatttattaatggttgatcttgctttctgctctgacggtgttctctctacccatgagttcaaaactatcattcaatttctcttctttccagctcagtggatctgggttatgtttaggtagttggcccatttggagtttagttttttgcaaggtgataactgtggatctacttgggttcttctgcatgctgccatccagtttaaccagcaccatttgttgaagatggtgtatttctggattcttaataaaaatcagatgtccatacgtgtgtgcgtttatatctgggtcttcgatttgattccactgatcaacaagcctgtttatatgtcaataccttgcggtttttattactataactccgaaattcaacttgaaattgagaatggtgataccactagcagttcgtttattgttcaggattgttttagctatcctgagctttttgtgtttccatagaaagctgaaaattgttctttcatggtctatgaagaattgcattggaatttttatggggattgcactgaatctgtagattgcttttggtaaaattaggctaattctactttattaatcctaccgacccatgagcatgggcaatcctctgacatcttcatttgtcaatgacttgatgtttttatcattcaggcctttcacttgcttggttagagttaccctaaggtactttatattatgtgaggctatcgtgaaaggtgctgcttccctcatttctttctcagtccatttgtcatttgtatatagggaggctactgggttttgtgagttaattttgtatccagctatgtgctgaaagtgtttatcagccatagaagtttcttgacagaatttctcgtatattatatgtacgagaaattaatttaatgtatattatcatatgtaatgagaattttgcttcctttgaaaacatagaaatgttctgggaataagctttaatcccaggatacggagatgcttcaaattgtccacagcagctgatcatgacttacctcatgctctggcaggggcatgagtttgccagttgcagagagtttcagcatgtatgtgacttttggaattctagggacacttgagaggaatataaatgcaagaatcctgagaggtgtgcagctgctgctgttgctatttgctgttgctgccactggttgctggttggagacatcctgacagcaaagatcaaaattgccccaaggaacttggtgcccttaatcggcaggaagcaacctagtgatatcaatgccactccacccctgcttcccctctggtcttggtgcccttaatcagcaggaagtagcctaatgatatcgacgctacccccctattcccactccccaccccacccacacccccaattcccctctggtctttttttttttctcctacctagagttaggagattgaaatgaataagagtagagaaggatcatagaacagaaataagaacccataaaataaccaaaagtctggatacggtcataatctgcaataaagatattttgacgtcttcctttctaatctgtatgtttttcatctccttccattgtctcattgctttagctaagacttcagaactcgtcttgttcctgcttttactagaattgctttgagtttctctccatttaagttgatgttgactatggacttgctgtaaactgcctttattgagatacatcccttgtgtttctaatctctctaggacttttatcgtgagaggctgttagattttgttaaaggtcctttctgcatctaatagatgatcatatggtttcattccgtctttcggtttgcttatatggtagatgacacttatcagtttatctgtgctgcctacttcatcatgggagctgatctttttgatgtgttcttgaatttgatttgctaatattttattgagtatttttgcctgtataagagaaactggtctgtaattttctttctttgttggatctttatgtaggtttgggtatcagggtaactgtgaccctataaaatgaattggaaaatgtcccttttgtttttattctgtgcaataacttgagtattggcattaactcgtctttgaaagtttaatagaaatctgcccccaaatcatcaggagctgggcttttttgattggggaactattaatgactgcttctctttcagtatgggttataggtctgcttaaatttgcttatctttcttttttttttttttaaagatttatttattcattatatgtaagtacattgtagctgtcttcagacactccagaagagggagtcagatctcgttacggatggttgtgagccaccatgtggttgctgggatttgaactccggaccttcggaagagcagtcgggtgctctaacccactgagccatctcaccagccccattgcttatctttcttaatcttgatttaatttaataaagattaatttaataataaattaaattaataataattaaataataaataaaataaatataaaataaatagtaaaataataatataataaataataattaaataataatttttaaaaagatttatttattgattatacataagtacactgtagctgccttcagacactccagaagagggagtcagatctcgttacggatggttttgagccgccatgtggttgctgggatttgaactccagacctctggaagagcagtcgggtgctcttacccactgagccatctcaccagcccataataataataattaatttaataatgaagatttaatttagtaaagattaatatctttattaatcttgatttaattttggtaagtggtatgtatcaacaaaagtatccatttatttcatagttcccacttgggtagggtgcacattttaaagcctgtcctgaggagcctctggattccctcagtttgtgtggcctccttctcgcttctaattttgttaatttggatatttgctctccatcctttagttaacttggtttggggatttgttagacttattgattttgtcaaagagtcaactctttgctttattgattctttgtaaatatgttttgtttctattttattgatttcagtactgagcttgatgatttcttgaattctactccttgtaggcataatttattcttttgtcctagagctttcaggagtgcttttaaattgctactctgagatctctgcaattttctttatctgggcacttagtgctatgagcttgcctctttgaacagcctccattgtgccacatacattatgttgtactggctggttttatatcaacttgacacagctggagttatcacagagaaaggagcttcaggtgaggaaatgcctccatgagatccagctgtaaggcattttctcaattagtgatcaaggatgggagggcccattgtgggtgggaccatctctgggctggtagtcttgggttctataagaaagcaagttgagcaagccaggggaagcaagccaataagtcacatcccttcatggcctctgctccagcttcctgacctgcttgagttccagtcctggcttcctttagttatgaacagcaatgtggaaatgtaagctgaataaaccctttccaccccaacttgcttcttgatcatgatgtttgtgcaggaatagaaaccctgacgatatatggtgtatttattttcattcaataaattctcctttttatttttaaataaactattgttgagctgtgaaattacttttacgggagtggggagtgagaaggggtgtgtgtgtgtgtatgtgtgtgtgtttttgtgtgtttgccttggctgtcctagaattcactctatagaccaggctgatatacagagattcacctgcctctgcctcctgagtactgggattaaaggaatgtgccaccacacgtgaaatgacctctgataaaagccaacagtcctctatccctagcccccatatcattgataaagatactgaactcaaaaaattcttttatctaatagtggtccatacatttttcaataccatatttcaatattccagcatattacacacgcactgaagactttgctattgactacctagattggcaaccaggagaattacagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctttacaaaaaaaggcttcactgtttggggatacccagttttcataggtatgttgtcaaacttattttgaagttttgagggtgctactgtaaagacattttgaagttttgagggtgctactgtaaagacattttgaagttttgagggtgctactgtaaagacattttgctaaagttattttttccagatttttgttattgatatatagaaaaattattgactgcagtgtgaggccatataaattcatttgttggttttagtggagtttcttaaatatcattttgaagttcatatgcacacgatcctgtgatctgagaaaaaagacagaattagtccttgaatttcttcatgcatccacttcttttccagtcttacttccctgaggagaagaaagctgggcacaatgctgaagaaatgagatcagacagcctgactttttttgttgttgttgttttagttttggtttttcgagacagggtttctctgtatagccctggctgtcctggaactcactttgtagaccaggctggcctcaaactcagaaattcgcctacctctacctcctgagtgctgggattaaaggtgtgtgccaccacacccagctgacagcctgccttattgacagcttccccacccccagagtctagctatgtaatacaggctggcctccacctctccatcttctgcctcagcctcccaagtgctggaatcacaggcttgtgccgccagttccagctctgtgtgagtcttgatcttaatcttcattaaataagatgctaacactggagtttttcagggtagttttttttttttttttttttttttttttttgaggggactgaggaagttcattacgagtcctagcttgctgaaaatgttaaattttcaaatcacaagtggatgttgattctctctttctctgaaaggacttgatctctgggagtagggagcctggttcttgctgttcacaagcgattctaccacttccaatgttctgacgaaaggcaccaatgaacttccctctctctccttgagccatgtggccaggaataaatcccagctgattttatgagcactaaaacaaatgactatgtgtccacaggcacgaacagacagtattgaaaggaatgctactaacatacagaggttctattcaaccccatctcccatcatgccttaactctactctcatgtttcactgggtttgctgagaaagggttatataagcaatgacttttgaaacctttcatttccaaaactgactttactctacattgacactgggctggggtttgtctggattctaagttctcattagaatttgtgttctgagaatcctgcaaggtaagtcatcctgatttctttcactaaccgctcttacagtccaggctttgacccttgtctactattgattcttggtgggagactaaattttctgttaaggtgttttggagtgttctctccatctttaagtggtatacacaattatgttctttgttgagaaactggtgtgctaggcaccatattctacattctaatctagaagtctgggttctataaaaagatatctagcactcgagaggcaaaaagcaggggagttgctaattccaaaccatcaggaccctatctagaaaaataagtaaatacaaattaaaagacatttggaactggagctagcccccacaactagctagccctgaactgcctgcagttcagggaaagctgggattgtttgtttctcagcgggaaagaatttcaggatgagtcagtccaaagcagagctggggttttttaagcaaagactctttttaaacaaagattcaaacacagggggcaaacggaggagaaagttttaggaagaatccatagcatagggtttgtgagaaagaactgttctcaggtgtctttatagtaactacacacaggacttcagcagcttctacagttccatctcaaagactgctaaaacttctacgagatcctagggtagttccagggtgcactggacagacttacagctgatcacataaaagtatgaggcttgcacaagggagttgaggtggactcttactgtaaatgaagtccttgctatggggttcccagaaaattcgggtttatacctgggaaaggagttggggcaaacttgttcatatttttaaatgtgcatcatttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagaatttgagcactggcttgcagaggacctggattcaattcccagcacctgcaaggcaccttacaaccacttataactctggcttcatggaaactaaacaacttcgccaagcagtggtgatgcaggcctgaaatcccagcacccaggaggcagaggcaggcgtatctctgtgaattcaggccagcttggtctgcatagtgagttccaggacagccagggctattatattacacagaggaactctgtctcagaaaaactaaaaaacagagcaaaatgaataagagtcgattggctgcatatttgtataacaaaggcctacatgcacccgtgctgtgtgtggtcctcacaaaggcagccagccctatgggaatgaagtttaggaggacaaaggaatctgaccagtggaggacacatgaagaaccacgaaactccctgcagggtgacaagaacaggggcatctgtttatgagtccttgtgcattaccatctgtacctggaggtttgggaaaacacatctaactcaataaaagagaatgaacagccttagttagctgttgcttaactgttcacttaaacctttggaaatcggttttctcctccatgaactgcagtctgatcagatgggctctcctccagttctagggagatgtcagctcaaaagctgagactgcacagacgcaccaatagaaaaagccgcagtgccttgtgcacttgagaagaaacatctgtctttgctcggatgttggttgtcagtggctaggtgctccagggagggacgccagttctcagtatgtggtttccaggcaaatctgccatgagttttttccattcccaacccttttctctctccctccctcctccattcatgtggtctgatcttccccatctgtcagaagtttcttcttttaagatagagaggcccccaagggaagggaaagcgcccctaggttggggaaacatttgtctttgagtcattaagcaaggaaagaggtaatttttagataaggtctcactctttagcccgagctaccttttatgtaacctaagctatcctcaagttcataaccattttcctgcctcaaggcaggaaaattgggattttcaaatgggagtccctctaccacacccatcggagaacgggcttttgaaatttttctcttgcataaaagatcctctttttctgaaactaacaatgttacttaccaccaacccagaagcaccgtgaaaaccactttttaatctcatttgatcctcaccaagaccttatgacaggagttactgttgccctgttttactgaggaaaaaaataaaaatcaaaaccattgaagattgcacctacagtaacacagcatcacactagctgccagcagggcctaagctctgactgccctgtggtggaggtctcagtggcgttgtgggatgtcctgttttcctctgtccccactgagaccattgattaagttattcagttgtctccttaaaacgtagtaacatgagaagcatctctcaagactgggagcaagtacagcagcagaagagatgttcagcaggtgtgagcactgcctgcacctgcaggggacccaacttctgtcgtcagtacctacttggcagctaacgataaatgatgtctgaatccaacgtcctttctggtctcctcagacagtgcatggtacatccatgcaggcaaaatgactatatacatgatagatagatagatagatagatagatagatagatagatagatagatagaaagaaagaaagaaagaaagaaagaaagaaagaaagaaagaaagaaagaaagaaagacttgagacaggcaggttagatggttcagtgggtaaagctctattttttttttttcttaaatcacacatgagttctatcaagttctctcatgggacctatatggtaggagacaactcctgaaagctgtcctctggcctccacatagatgccatattacatgtacactcatacacacacacacacacatacacacacacccctcagagaacttgctctccctcctaccaccagaaactggaatcaaatttcctatcaggttctggaagccaggagtgtcccgggttctgctgccacacccccagggcacttgacacttctaggaggttccaggaatcaggaagtatgaaatagaaactcagacacagtctccacctggggccctccacaacctgcaaggggaggggtcacaaggagagaggggaagagggactatggagaggaagaacaggaaacagggggttggggggagcagagtacaccccaagggcatccgctgaagccagtgccttagtgacctaacaaatcagacatggccacttgtccaaataaaccaattaaaagagtcatactaggtgctggacagatggctcagaagttgagggtattgactgctcttccagaggatcccatcacccacagtacagctcgcaactgtctgtaactacaagatctgagacctccacatagacatgcatgcaagcgaaataccaatgcacataagacagaaatattttttaaagagccatactaatagcacaaagtatatgtattcagtgtggttacactagaaagaaaaagagacacagtgacggccactccccatccatcatggttctgaaataaggtttcagtagaagagagattcataacttagccagcgtttgggtctgcctaccatggtctcaatccagtctctactacaaggtgaactgataaatttaaatcttccacagacacaaatttcttctcttttggattccaagagtcttctcttctttttcctcttcccagcatagattcccaatgaaactccaatctcttaagagcccttatttgaatagtctgtaaggggacagactgtaatgtctctggaatgttctgatgtctgccaagcagaccacataagaccactaaagaagctacctatgcctcacacacacacaggtctttggttctctctttctttcttcctttctttatttttgagatagggtttctctatgtagccatcactgtcctggaactcactgtgtgtgtaggtttggagtttttgcctgcctctgccttttgtttttaattaatttatttatttattttatgtaagtacactgtagctgttttcagttacaccccagaagagagcatcagatctcattatggatggttgtgagcccccatatgattgctgagatttgaactcaggacctttggaagagcagttggtgcttttaaccggtgagccatctttccagccctcctgaggacttcttttttttttttttttttttttttttttttttttttttttttttttttggttttttgagacagggtttctctgtatagacttggctgtcctggagctcactttgtagaccaggctggcctcgaactcataaatccacctgcctctgcctcccgagtgctgggattaaaggcgtgcgccaccacgcccggctctgagtacttcttaaggaagtaaactaagaagacaatactttgtagcctggcctctctctcctctctctctctctctctctctctctctctctctctctctctctctctctctcgttttaatctttttactaattaacacatatgtgtgattgtgtaaatgcatgccagatgtgttcaagtgcctaagaaaaccagaagagggcactagatcccccagagctgaagttgcaggaggttgtcagacaggcatggctgtctgccatggaccctgggagcttgggtcctctgcaagaacatcaagtgctcttaacctctgagccatctcacccatccctcaaactctctgtgtgacaaagaatggtcttaaacttctggtcctttgccttcatctcctgaactgtgggaaaacaggcacactaattgaaacaacgttaaaatagagaattggtggttggttggttggttggttttgtattttgtttgttttttgtttttttcagtacagtctattttgttgtaatgtcctgttactccttagaaattttgctatatcaaaattgtctttaaacagagaggaagatctatagtccatacagctcaaatgcataacaacattggttatactctaggaacattctcagtcataattttttaaatagttaagactacaatactctaaatattactaagagaatcagtacttgcctaggtctaaattttgtccaaaagaatagtttatgtctttttttttttttcagtgctgatggaactcaaggcttcactcgtgttaggtaaactttccatggctaccttacagctccagcccccactgccccccccccacacacacacgaaggcctcaaattcagagatctgcctgcctctgcctccccagtgctggcattaaagttgtgtgccaccactgacagtcttgatatatctttatttactacctttggctggcagtggtgtgaagggtggattttgagatagcatttctagtagcccaagctggcctcaaaattactctgtggtgagcctgatcctctgcctccacctcccaatgctaagactacaggtgtgtactaccctgcatccttatgtcttgtgtttgtttgagacaaggccttatgtggcacacgctagcctatagtttggaatcttcttatgttaacctcctaagtgcctggatggcagtgtctggcttcctctcacttttagtacccatcctgaagaagagtgacgattccaagaggatgaaacatttactagtgacatcctgggacaccaattctctattttaaccttgtttcaattaacagtaatccttaaactggccacggtggagtgtggccagttcaggaagtgaaggcaaaagggctagaagtttaagaccatccttagtcgcacagagagtttgaggccatcctgggctgcatgctatctgtctcaaaataacataaggaaacaaaattaagcaaagtaatctataaagtgttccctacatggaagctccctgcaggaacatatgttagatgagctagaagacatgtggcctatccaactaccagcacttgggaggcagaggcaggcagatttctgagttggaggccagcctggtctacaaagagagttccaggacagccagggctacagagaaaccctgtcccaaaacccaaaaaaaaaaaaaaaaaaaaaaaaaaatatgaagacctcaagctgtgtggtcatggcacgtgcctttaatcccagcactcaggaggcagaggcaggcagaggcaggcagatctgtgagttcaaggccagcctggtctacagagtgagttccaggacagccagagctacacagagggaaaaaaaaaagagttgaagactttgtaaagatcagacatgtaattctgattgccagggctacaggcatgtgtcactatgtgttgtttatgtgatactatgcatgaaactgaaggctttgctcatgttagacacatactctacccactgagcaacagtctggattgtttcgtcaggatacatagaagtggaatccggatgaaaaggtataaaattcgggttgagaccgtgtcatggctgagcgtggttgtcaacttgactatgtctggaatgaaatcaaagcagccatgcacacctatgagggagtcttttgattgaatcatttgaggtgggaaaacccaccctaaatctgagccacgttttctggtggcaacccacgtaaaagcacatggaagaggccacttggaagttcatcttccctgttgcagaggcatttctttgctggtgttagtatctaggtctctgggattccagtgtagactgtagagcagcagctctctaggacctcactaggactcccgcaccagattgagactgcgaagacatccagtctcttggcctttctgtcaggagacaccctataagctactctaataaatctaaaatgtaactatataacaatgtgtgtgtgtgtgtgtgtgtgtgtgtgtgtgaatcattcaaaccttccattcaaaccattcaaacaccaatttcagtcaaacaaagatgtttactgaatgccacaccccaagactgatcaaacaaggccacgttccaggctcaacaactgaactatgacattgagttaaggtcttagaaggtttttaaacctaaaaccacaaacatctttgacaagttattccaccagtcaggatttgtgaataggtgatttccttagggacatgtctttgttgtacacttatcctgctccccttggttggggtattcaactgtagcaggggacttgcctggcctaacactcatgtctgaacttgccaaccaggatatcagttactcacatacatgtctctttctgccaagtaggatgtcagttcccagcgaggtcttgggaacttaaactttactcgacccctactcaaaatggaagtcttaattcaaaatgtttcttatattggtgcaggtgtctctcttatgttggggttcatacccaggggcagtttacaaaatcaaataccgaagaagtttatagacttgtgcaggaagtgctgctgcgtggttggttcacgtccaggcttattgtagataactatacaaagtagtcctactgacttttatcgtaattggtctccaagggcacagaatatgtaatcaacttagacatgagaaagttttctagtaacagaaaaaataacatatgagaaagtttccttactaacagcacaaagtgggtggctagtcaagtaacaattacctaggccttaacattccatctagaccttaatattctaccccataaatcgaaaggcagcctcttcctgcagacatgtcctcattcttttttttcctttctctgtctttctttaaaaaaataaaataagggggctggcgagatggctcagtggttaagagcagtgactgctcttccaaaggtcccaagttcaaatcccagcaaccacatggtggctcacaaccatccgtaacgaaatctgatgccctcttctggagtgtctgaggacagctacagtgtacttacatataataaataaataaatctttaaaaaaaaaaataaaataaaaaaaataaaataaaataaaataaatattattcattatgtatacagtgctctgcctgcaggccagaagagggcaccagatctcattatagatggttaggaactaccatgtggttgcggggagttgaactccagaccttacttgaagagcagcctgtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctatgcccagctcttccttttctcctcttaacctctttgtcctcagccacacccctgggttcagatgcagtcaccaggttgttcttacactcagggtaagagccagcacacagcaaacggaaggaggcaaggtgtatctgggcgtcccctccaaccttatgtcttatgtatgccccctcattattgtttgcaatttttgtaaagacatattatttttcattgcttttatttatgtatatgtgcatacggacttgtctgtgtgtctatatgtagaggtcagaagaaggcacctgatcccttggaactggagctaccaggagtagcgagctgcccaaagtgggtcctaggaaccaaatcctcaggagcactccatgctcctaaccactgagctatctccccagccccttgtttgcctttcttaaaacctacctggagaaagaggtgataacttcagattacattacactgtactctgcgccttgtcttctgatgagattgtctccagctttcacagttgtaaacatcgcgtcaaaagcacacagaagaggccaaagcaatgattcagtgaggtgcctgcgtgctgccaagccgaaaacctgaacttgatccccagagcccacatggtagaaggaaagaactacctcatgtaggttattctctggcctccacacctaagctcacacacacattaagcgtgaaatagaaaaattttaaatgcatgtcaagggttggtgagatacctcggcagagcttgtcacacaagcctgacaccttgagtttgctcccagaatctatgatggaagaaggaaaccagctccttaaaattgtcctctagcctctggcctctgtatatagtcctgcacacttgcacacacacacacacacacacacacacacacacacacacacttgagacatgagaacacgtgtgcacctctacccaacaccagggctctgtaatctggaagtatttagaagttaactgagtttaagatgaggatacagttacctaatgcccactctcaatggctaccttacctggggcctttaatccccaaagatttccacttatcaactgcagattgtgggaagatagggagctctcccagcttccaggccttggattctatggcaagggcaaccacatccctaccccttgggatgctctctcagtgccagagtttgcatcttcacagaagatgaaggttagagagaagcaatcaacactgagccaggaaactgttcactgcagccacataacaggaaagcaataaaaagcaatggctgaggggaggggggctgtgaccgtaagcacctaggaagtcagagttgcgtacctagacacagtgaggggacaagaaaccatttatcagaaatcccttagtcccacagaaaccagtgtgttttctaaaataaagttggaccaagccttcctaccccaacatgtggactgacacacagctgacacaggcgtcctacctgaggcaccagctgggtccgttccttgtgtgcgggaggagcctgcagctcaggaaacagaatgatcaaacaaccgaagggactggatgaataaaagaaagagggagaaaccacacctccccctagagccccgcccacatctgcatttgggtacagatgaagtcatggggcccggcagtatcagagattctgagttccgtaggcttagcagggtgaccctgcagttaagggtgttctctctaactccttccctccatagatgatcacttctaccatcttcagtttcttgaatttacctgcacgtgccacccctaagtttcctaatagattaccttgagaagtttctaacttcccaaggggaataagaaagggggcagtacagacttcctataacagaagtttcagaagtccacggtgggaaagacttagggagtctaaaggagaacttagcggaaagctggtggtagggtctacacttaagctgtgtttggacagcacgcagacatttatgttggtgctggaatagaacccaggacccagtgcatgctgggacaagtatcctaccgctgagctacacctgcaaccccaatgcttgctgttttgttttgttttgttttgttttgttttgagacagagtctctcatagcccatgctgaccttaagtccataaaccttcatctctctcccaaatattggcattacaagtatacaccactatgcccagctataagcacgccattttcacttatatttataggcatctttagggtcatgtggtagagattttggaaggaaaacctttcctttacactctcttttacttccaattattgcttggttacagtagagctgaggtttggggcatggccactccttccctgaagtctatcagaagatcatgagggctgggaaaacagtgaaagaccatctgggggtgatgccattactgctccccatttggtactgaaggacagcttctttaggaagctgcctgagaagtccctgagcaactcacagctgacccctgactttattcctagggttcagtggactggttagtttgaactatcaactaaacacaacctagagtcatctgagaagggaatcccaattgagggatttctcagatcagactggcctgtgggcatatctgtggaagattgtcttgatctctaattgatgtaggagggcccagcccactgtgggaggcaccatccccaagcaggtggccctggtctgtataagaaaacttggtagggatggaaaaatggctgactgggttaagagcacagactgtgggctggagagatggctcggcagttaagagcactgactgttcttccaattcccagttcaattcccagcaaccagatgatggctcacagccatctgtaatgggatccgatgtcctcttctggtgtgtctgaagacagcgacagtgtgctcataaacattatacaaacaaataaaagaacatggcctgctcttctggaggactcaaggttggtccccaacatccacatggtagcttcaaaaggtctgtagctccagtctcaggggaaatctgatgccctctgctggcttctgagggcagcacatgcacacggtgctcagatgtccgtgcaggcacaacacccacgtacacaaaattgcctattctatgcatgtcaagatgaacttttcctgcaagtggtttacaaagaattgcgtttaaaatttaacattttcacgcttattgcctgttataattttatgcttataattcccacggtaaaaatgccctctattatcttgtgtacatttcaataccataatccttcttttccaaataaaaatgaaaccttcagtttcagaaactaaagaatgtttaatgaaagccagccagccacggccctgtgagtgagccaacaagaagtgttcctctgtggtttctgcctcaaacccctgttcaagatcctgccctgaatcccctcagggttggaccaggacctgtacgcaaaataaatcctttcctcccctgggttgcttttagtcacaatcttctctcagagaaacagcgatgaagcgggaactctcctaaaccttttcccactacactgtgagttccactatgctgtgacaatgcgtttgcaggggaggctcctgctttgcgctgtctgcagctagagagcaaaggtcccctttccaattcgcctttggacctgtcctctgccaggaaacacagcatgtgactgccaagggttgtcaacgaaatggtgtttctctcgaaactcatggagtacacctcacactgcaccactctaaaagggtcctaactaagacaggggtcaaggtctgtctaagactcagattttaaaccacatatagtagtgcacacctataatcccagaactcaggagcgaaggcgggacgttatcataaatttgaggccaccctgagctacatagtaaattccaggtcagccagggctacctagaaagactctgtctcaaaagaccaaacagtagataaataaacaaacaaataggggttggagagatggctcagcagatgctcactagatgctcttgccgaagacccgggctcggtaccaagcacccacactgagcagatcacaacagcttgtaaatccaacgtcaggaaatccggcccctaagtgctactcgtgcatagggcacacatacaggtaaaatacacacagcaaaatacctacacacgtgacatcataaaatttaaaatttaacccagtggtggcacatgcctttaatcccagcccttgggaggcagaggcagatggatctctgagttcaacaccagcttagactacaaagtgagttccaggacagccaggactacacagaaaaaccctgacttgaaaaataaaaataaaagattttcttttcaaaacattttttaaaaattaaaatttaaactagacaaagatctactagctcaagttctttgaatatagttatcacttgcttttcctaagtcccctgttgaggcagttcacaacttttgtgaatttttatgaatcttggagcaattgggaagggctggatcagccctgcagcccaggagcaaaggggaaacagcccctcgggatgagcgtggtagagacagcagccttttcagaaagatagagctggagaatgaaggttagaagcatctctcagctcaaggtcaggtaaagcatttcgctggaggaagggaaaggcacaaagatatagagagaaacaaagcattcccggttgaaagggcaagccagcctcccaatgcatcttctgctctccatttcccacccacaaccgctcccaagcataccaggcacagtgttcccaacagggatgaacactcagtgccacaaagatgactgtgacagacgcagcctggatgccaggcaaccagcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccaagcatgtatatacttcacaggcatgcatgcaggcggaacacccatatgcataaaatttaaaaataaaaagtatatagaaaatataattttaaaaaaagccagatgtgagctgggcatggcggcgcagcctttaatcccagcacttgggaggcagaggcaggcagatttctgagttcgaggccagcctggtctacaaagtgagttccaggacagccaggactacacagagaaaccctgtctccaaaaaacaaaaaacaaaaaacaaacaaacaaacaaaaccaaccaaaaaaaaaaaaaaagccagatgtagtagcacacacttttaatcccagccattggaaggcataggcaggtgtaagatttgtggcagctcaaaatgaccactgttgtaaaaagttaagtaaatgtcaagatgttcttttcccagaacttgcctccagtccttaagtttacctgctaagacatagtcctctgattgtttagaaaggtccacacaacgtctccggcccctaagtctgcccccttatgcagttaatggttaaccaatgataaactgccagccctaaactgtgactgagaactgctctaaaaattgtataaaaggtgtgtgccttagctcctcggggtcacttccatccagagtttaggacgacccagcatgctcttgcattttgcatcaatctctgtctccgcatctctgtgagtgggacatccaggatgtaaggcttttcgggtgttacacaggcagagttcaaggccaccctggtctgcagagatatatggtctacataaacaaagctatgtagtgagatcctgtcttgaaaaaaaattaaactaaagtaaaataaaaaacaaacaaaaaggcattcctcacttggagctcttcctgccctagggcgttctttctctgcagtcttgctaagacttagtagccaccagccaccccatgcttctctccccttcccttccctcttctcaacacccagactcctagctttcaggacctcaatgttggggctttctccctggactccatatgagtgagatctgaagtattcatcatttggtgcctgacgtaacttcattcactacagtgttctcctgctccatccgtgtcattgtcacaaaggacaggatcccattgtgctctctgatgactgaactgtatcccatggtgcacatatgctagattttcatctccacaccccaatctacttccatttcttggctattgtgaacggagcagcagtgagtgtggaagcttagacacttcaccaacaggctgatttcatttcctgtgatatagacacagacagaagactgaatcacatgacagttctgtttttaatttcccaaggaacctccccggtgctttctgtaagggctacaccaatttgcattcccacaacagtgtgaaaggttccctttcccctcactctgaccaatacttactgtcttatctttttaccaagagccactctaacaactgt

SEQ ID NO: 878 - DNA, 1849 bp, Mus musculus
cctcatcacggctgcctcactttcttccagttcaaccagccctgacagctcccaagccttgagtcacagagagttgggagccactctgctcacaaacagcgtcgtagaactactgcaggattaagtttacctcaaagatgggagaattcaaggtggataagttcaacattgaagatttcttcagtggagatcttgatattttcaattatagctctggcatgccctctattctgccagatgctgtcccatgccactcagagaacctggaaatcaacagttatgctgtggttgtaatatacgtcctggtgactctgctgagccttgtggggaactccttggtgatgctggtcatcttatacaaccggagcacctgctctgtcaccgatgtctacctgctgaacctggccattgctgacctgttctttgccctgaccttgcctgtctgggctgcatctaaagtaaatggatggacttttggctcaaccctgtgcaagatattctcatacgtgaaggaggttaccttctacagcagtgttctgctactagcctgcatcagcatggaccgctacctggccattgtacatgccacaagtacactgatccagaagagacacttggtcaagtttgtgtgcatagccatgtggttactatcagtaattctggccctgcccatcttaattctacgaaatcctgttaaggtaaacctttctaccttagtctgctatgaggatgtaggtaacaatacatcccgtttgagggtcgtactgcgtatcctgcctcagacttttggcttcctcgtgccgctgctcatcatgctgttctgctacgggttcacactgcgcaccctctttaaggcccacatggggcagaagcaccgggccatgcgggtcatcttcgctgtcgtccttgtcttcctgctctgctggctgccctacaacctggttctgttcacagacaccctcatgagaaccaagctgatcaaggagacctgtgagcgccgcgatgacattgacaaggccttgaatgctacggagattcttggcttcctccacagctgccttaaccccatcatctatgcctttattggccagaaatttcgccatggacttctcaagatcatggctacttatggccttgtcagcaaggagttcttagccaaggagggaaggccttcttttgttagctcgtcttcagcaaacacctctactaccctctaaagactgttcacctaaacggtggcccctcggggttccttcttgtctttcagcatggctcattaccagagactgtggtatttgaattgatgcagcccctcctctacaattacagggagaaagaggtcacgttcttagcagagcccccagagtttagaaccccctatattggctgtctgctcccttccatcttggtatgcctactgatagagttgatccatcctaacactagaccccaaacactcttttctaagaagcacacgttacaattacagtgagatactgcctcctacccatcagaacagttagcagtaaaaggaagaggtggaggagagaaaatggcaagtgacaatgaggaagtagaaaaagggaactcttcaccttaccagtagacgagtaccagagtcccctcacacaggaacatagcatagcagttttccatttaaaaaaaaattaaggggctggcgagatggctcagtggttaagagcagtgactgctcttccaaaggtcccaagttcaaatcccagcaaccacatggtggctcacaaccatccgtaacgaaatctgatgccctcttctggagtgtctgaggacagctacagtgtacttacatataataaataaataaatcttt

SEQ ID NO: 879 - protein, 369 aa, Mus musculus
NYCRIKFTSKMGEFKVDKFNIEDFFSGDLDIFNYSSGMPSILPDAVPCHSENLEINSYAVVVIYVLVTLLSLVGNSLVMLVILYNRSTCSVTDVYLLNLAIADLFFALTLPVWAASKVNGWTFGSTLCKIFSYVKEVTFYSSVLLLACISMDRYLAIVHATSTLIQKRHLVKFVCIAMWLLSVILALPILILRNPVKVNLSTLVCYEDVGNNTSRLRVVLRILPQTFGFLVPLLIMLFCYGFTLRTLFKAHMGQKHRAMRVIFAVVLVFLLCWLPYNLVLFTDTLMRTKLIKETCERRDDIDKALNATEILGFLHSCLNPIIYAFIGQKFRHGLLKIMATYGLVSKEFLAKEGRPSFVSSSSANTSTTL

SEQ ID NO: 880 - DNA, 31231 bp, Homo sapiens
  misc_feature (1)...(31231): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcttggtttggatttattgctggaaagttagtgtgatcttttgggggtgttacagaaccctgttttgtcatattgccagaattacttttctggttccttctcatttgggtagactatttcttcaagttattcttgaatttatttttgatttgacttttttttttttttttgagatggagtttcgctcttgttacccaggctggagtgcaatgtctgatctcggctcactgtgacctccacctccccgattcgagtgattctcctgtctcagcctcccgagtagctgggattacaggcatgtaccagcacacccggctaattttgtatttttagtagagacaggatttctccatgttggtcaatctggtcttgaactcctgaccttaggtgatctgccagcctcagcttcccaaaatgctgggattacaggcgtgagccaccacgcccagcaactatgttttttttttatttctttttcttccctcttaaggatctgactttaatatttatagtttattttagcctaatttgatccttggtttttaggggtgaagacttttggattttaggagtgaagactctgtatgagttcgttagttagagacagtccttgtgtgctggctttcccagatcctggttgtagcagttacgtacttggtgtgtgggaaggtttactgtctcctacagggttggaatggcaggaatctctttaagcttacctcattctctcgtggggtactctttatttatttatttaatttttccccagtattttacttactgagttgatgattcaggctttggaccagtaggggaagtatccctgggtaggcaccagatgtagctaaagtaggtgggtaggcaccggttgtagctaaagcaggtgggcagagatcccagccttgatgagagtgcctgggagagctctcaattagatgtgctgaggttttgtcagggtgaagggtaggagctacctcaggtcccccactaggccagctggaaagctatccacctcccagcttcactcctttcccagtgttccagctattcagatcagacaggcagttattttcatctgtagaaatgttgatgttccaagtagagaggaattgtgactgcctgtcatgcaaacctgaatctggggagtgctcctcccgtggggatgcaatcaccctgatttgttccaggaaggctgtctataggtgcatcaatgctgcgttcctttgggagaagccccagctctgtctgcagtggcgtaccagggggaacaaggatcccttctctaagacccttcacaataccagaggctgcctgcctattgggtagaggtgcaaactttcccccactctgcccagcacagcaattgtctctgcaataggaaacttcccaccagtgaaaagatctgggactcaagccctgccattcagattcttttgttccacagggtattcccttgatgtgatgttcttccccttcctctaggaatgggacttcctggaagccagactacagtgctcttctgggtctagccacccagtgggcctaccagactctgggctggtgctagggaatgtctgcaagggatccagtggtgttacctgtcttcaagactcccagcagtgaataccagcaccatctctgacagaagtgggaggggagtgatgcaaactctgcaagattccttggttgtagatagacttagagtattgactttctcaaatgctggttataattatagtgaacttatcacgtggacagacgcaggacttctggttagccagggtgttgtaagcagtggtgatagctgagaatatgcagccgttttctccttcctgggtacagtgctattctgcctagaggtgagtttttgcctgtctcacagagtaggctgcagcctgccacttctttcaaaagttctgtggattctttcagctttcctgttcagttcctgcattcgttcctggagaaaaaaaaattatagtgtgaatctctacacgctattctgtccttccagatgggagaggcatgctaatgctgcctccaatctgttgtcttggggggaaagaaaacaatttgttttgttttttttttaatggatttgctgggtttagtaacccagaggtcattgggaaccttggcgaaagttatttcagtggagcagtaggaaggaagccagttgcagtgtctttgttgagcagcagaggggaggtgaggaagtggagagagcagctgtggtggctgaagggtgctaggacagagggagcatgataaagccataagtaagatgtggtagaagggaaagagccaggacagaggggagagaaagcaggatcctcaaggaccagagaggcagtgggtcctacagtcaggtgcggggattcaacagaaacagaaggagggacgcttctcactctgaccccggaaagaaggaagaaactgcgtgcgagttcagacaagtccgttggcgggggctgggatgcctgcatcttccttgttaaaaaaggaagtgcaggttcaaaacattcagagacagaaggtggatagacaaatctccaccttcagactggtaggctcctccagaagccatcagacaggaagatgtgaaaatccccagcactcatcccagaatcactaagtggcacctgtcctgggccaaagtcccaggacagacctcattgttcctctgtgggaatacctccccaggagggcatcctggatttcccccttgcaacccaggtcagaagtttcatcgtcaaggttgtttcatcttttttttcctgtctaacagctctgactaccacccaaccttgaggcacagtgaagacatcggtggccactccaataacagcaggtaggtgacttgttcagtctgagatgctggcaacatatttctaatggaagagatctggaaacttcagcctcctctgaggccctgagaactggggtgatgaagtgtagaagcttagagctaaagacaactaagtcttcacctagacagtgttgcacaaaagaattttctgcaataatagaaatgtcctagacctgccctgcccagtatggtagccactagtcacacgtggccacggagcacttgaaatgtgactagtgtgactgcggatctcaatttttatttcattttattttattttattttttcttttttgagacaggctctcactccaatgcccaggctggagtgctgtggcatgatcttggctcattgcaacctcaacctacaggtctaggtgattctcccacctcagcctcccaagtagctgcagctacaggcatgtgccgctacactcagctaattttttgggttttgtttgtttgtttgtttgttttgtttttgtttttgtaaagacagggtttcgtcatgttgcccaggctgatctcaaactcctgggctcaagcgatccgcccacctcggcctcccaaagtgctgggattacaggcatgggccaccttgcctggcctttattttaattaattttaatttaaatagctacacatggctagtagctagcatgctgaacagaatagaattagaagaagctcccgttttccaaaggcacacaacaaggcccagaaagaatgacttctccaagcaggattagaagccaggtttttgttttgtttttgtttgagacagggttttgctctgtcgcccaggctggaatgcaatggcacaatctcggctcactgcaacttctgcctcccgagttcaagcaattcttatgcctcagcctctggagtagctgggattacaggcgtgcgctgccacgcctggctaatttttgcatttttaatagaggcggggtttcaccatgttggccaggctgttctgtaactcctggcctcgagtgatccactcacctcagcctcccaaagtgctgggattacaggcatgagccaccgcaccagaagccagttttttaattcactccaccctgcatataaccgcagtgatctccatggaaatgaaattgacctaaggagcatgaagaaggaggctgactgggaaatgtcaaatctgggctcccctctctacatcctttgtatctgactttctgggacacagggaggtacctaatggagctcagaaactttaggctgggatcctgctccttattacagtgaacaggagataggatttgagagcagatttttagaagttttttaaactgaaaacctagttcagctgtgtcactctaggtatgttgcttaacctctcagagtcttcatttcctcttccagaaagtgcctgcttcgtgaggttatcctgaggattaattgatacaaattctggaaagcactttgcccagaagctagaacctggtagacactcaacattacagctaatatgacaattaatatccaggtcaaagtaaattagatgtcatcaaagtcagccttgaaagcagacccactgccgactgctttcccttgactggggatgtagtgagagaggcagcatgttatcagtgaataaactattccagtaataatgatcacaacaataaaggttaacattgtactttatgtatgttttacgtgatttacaagcaatccctcatttcatcctcaccacaaccccatgagttggattctgtattggccccattttacagatgagtaaactgagactcagaaaggaaaagtcacttgcccagaattgctcagctagccctggtgtcatctgcctctctccatatgtaataagcctctatctggttttagcatcaactggccaggtggcattgcattcttccccagcttgggaaagagaggtgacaaagactaagaaacatttgctgaacagttggactcaaagattctttctttggggtaggcaggcaatttaagtgcgtctgccacagggattgagtcccctctgggccctgggatgcatggagcaagagatagggtaaggaataatggaggggattgaggtgttgttcactggggtgggcacttgtgagacagcagaattagtgttcatggctctgcctggattaattcattcatttgtaatcaatagcaaattgataaaatacattcttagggtcacttaacattgtttttaaaaatgcatttggactttggtggaatcttcccttttaccaaaaggctttctttccaaattagagggtcttggctccaagggtggtaagctgctgcagagttggtgtcctcagacccaatgccaagtgtgcgaaacaagaaagaatatcaatacccagagatggacttgtggtcagagcagatggttggggagtgaggggaaagacaagaggcaggagtggggccaagaagtagaggcatcaggtccagggaggaacgccaccagactcaccagaagctttagtccatctctgtcattttaatgcactgctccctttgacatgtgaaagacattgaaggctatagtactgccaatggtatgatggggaagcctgaggcagctggaatgccaggagactcagacaaggcagctgaaggagccagcggctctgagatacagcaaagatgaaagaaatccatgcaatcctgggcaagccatttcctttgggcttcagtttccccatctgtaaaatggaaagactaggtagaaaacccctcaggtcccttcccaatataaactctacgagtctatgaaatgactatgcatccgagagctgatctgggaactaattattcaaagttatcaaaatcacccgcaccctcaggagctccacccctgaattgcattgagcaatctaatctaccactcacttcctccactgtgttctcaccaccacctccctttcataggtcacagctgctcttctggaggtgtcctacaggtgaaaagcccagcgacccagtaagtcttggaacacccacccttcccaccagctagaatgtctctgttctctgtttcccttgatacccagcctacatttatcctaagcatctctccccacccttggtgggcccctcaccctcaccccttggcctcttcattttctccctttggggctctccatccccaaaggaagaacttctgttcctcctccctcacaaccctctccaaccactcagggccacttgctgcccatgcttttcccttggcctggcagccttccaagactcagccagccctcctggcctgggctaggactgggtctgaggatgggccgaacactgttcgcttcccacttcccgacactaaatgcaaatatttgtggattatatttatagagagaaagaatactggaactgtactaaaatgactcttttgttgttaaaaagattgccttagatgtttgagatcttgtaaatgtctctcgttctatagcattttcatgtaataaattagaattcatgccatcatctatggagtttccaaactaccatgagtcactaaggggctggcattttccctaagtcaaggaagctccctttttatcctggaatatatgactgtgtggtcagccggacccagccagttcaagggtgtttggtttatcatccctgcaagagctgtttctttcattctgggccaaagaaacggcaaaagaaaacaatgcataaaacatgaaagaatgtgagtggaccatatacaggttgatttaatgatatctcaagaacttagctttgctgggcacggtggcttacacctgtaatctcagcactttgggaggctaaggtgggcggatcacctgaggtcaggagttcgagaccagcccgaccaacatagtgaaaccccgtctctactaaaatacaaaaattggccgggtgcagtggcaggcgcctgtaatctcagctacttgggaagctgaggcaggagaatcacttgaacccgggaggtggaggttgcagtgagccgagatcacgccattgcactccagcctggcagcagagcgagactgcatcaaaaaaagaaaaaaagaaagaaaaagagaacttagcttacaaatatgtttaatagatgaggtgcactttttttaagaggaagggctatagactacaaataaggcaagtgtagtcctttatacctcactggaactggtttcaccacttctccaccctgtgatcgcaggctggttactgagcctccctgttaggtcagctgatcctccttgtgcctcagtcttctagaaacagggcctaattgtatctatttgtaatgagccatggagatcatgtacctgtgaggcacaaagcagacctcagatgtgtcatctccttcccttagtttgtccctctaactgccaagtcatcctctgtagagattggtaaactaaaaaacaacaccaacaacaaacacccctctccctaccctaggagctggaggtcactggcctgacctggttctccttgctgagttctctaccttctgtcctgacttgcatgctctccctctggaacctgaagctgacccataatgcctgggagcatgagctcacccatacacctccagcccacccccagcacagctgagcactggattatccacagtgaggatttacctgtgaaacatgctctgccactgctgcctgtgctgacatggcagtttctgcagcagcctcagtcctggcttctcacagccaatattcatacatacaaggccctgctctctaagagcacaagctctctgcacccaatatgccctacatctactctcaaagatgggtcttctgttgggtcatttgttcccttaagagcatctgtaatcatctgctcccagaagtgatccacccttgacctcttgacttcattggacataccctgggcctctcagcaaacttgctctcaaccatgggactgaggagctggtgacttctttcaggtcttgctgaccatactggtccagcaagctgtattcccagccctctcaatacctccccagccttctggccaggcagggccagaaatgagggattgcttataaattacgtaagacatacataaagtacaatgttaactttttttttttttttttttgagacggagtctcctctgtcgcccaggctggagtgcagtggcgccatctcggctcactgcaagcttcgcttcccgggttcacaccgttctcctgcctcagcctcccgagtagctgggaccacaggcgcccgccaccacgcccagctaattttttgtatttttagtagagacggggtttcactgcattagccaggatggtctcgatctcctgacctcatgatccgcccatctcggcctcccaaagtgctgggagccaccacgcccggcccaaatgttaacttttattgttgtgatctagtatagtacattacaactgattgaatcttctccatcagttgcctcggcatgctgggaaggcaatgtatctggcccctaactcttaaaagagaaactaaaaacttgtcaggaaggtgatggctaagaattccatcactcttgggggaaaagtggcattatttttccagttttgcttaatcttcttcagctttcttctttgctacatatgattgatgacaacagagacttcctttctgctaaaaagaaatcctccctgggacttttgttgttatttttgtaatatttgtatttgctttgcaaggccgtgtaccctttgattaatcttttttttaattaagacataagtcacataccccaaaagtcacccatttaaagtttttagcatattctacaaccattgccactaattccagaacacttttatcactcaaaagaaaaactccgtagtcattaacattcctctcccagctccccttgaccctggaaaccaccaatctactttctgtctctaccaattctacccatttgcctattttggtcatttcacatatatggaatcacacaataagaaaacttttgtgtctgccttttttcacctagactaacattttcaaggttcatccatgttgtattgtgtatcagtacctcattccttctcatggctgaataatattctgttgtacataatacagtcataagttgcttaacaatgcggatgcattctgagaaatatgtcatgtgaacatggtagagtatacgatgctatagcctactacacacatgggctatatggtagagtactgctcctaggctacaaacctactcagcatgttactgtactaaatactgtaggtaattataacacaatggtattcttatatataaacataggaaaagaacactaaaaatacagtattataatcttatgggaccactgtggtatttgtgatgtgtcattgaccaaaaagtctttcagttgctcatgactgttcctcaatttgtctgtccgttcatcagttgatggatatttggtttgtttccactttttggccttaatgatgaatgctactacgaacattagctttcaattctcttgggtgtatacctaggttggggtttgctggttcatgtggtaactctatgtttaacttttttgagcaactgctaagctgttttccaaagcagctgcaccatcttacattcccacctgcaatgtgggagagttctgacttttccacttcctcacccacattgttcttgggcatctttttctgagtgtgcccagcctggtgagtgtgaagtgggttctgggacctttaacttcctggtttttctctcacactgggttccattttgggggtagattacggacttggacatggttggtggtagggtggtcatcccttactctaaggcaatggccggagggtgatctattttgtggttcagaaagaagctaattagggagctggattgctttagttgactgctttgagaaactgggattttttttttttttttttttttttgaggcagagtctcgctctgttgcccaggctggagtgcagtgatgtgatttcggctcactgcaacctccacctcctgggttcaagcaattcttgtgcctcagcctcccaagtagctgggattacaggtgcacgtcaccatacctggctaatttttgtattattagtagagacagtgtttcaccatgttagccaggctgctctcaaactcctgacctcaagtgatctgccacctcagcctcccaaagtgctgggattacaggtgtgagccaccactgggataatatttttgaataactgcagcccaccctccacacccaggcttccccagagcaggatctgtgctgtccctgtggcaagggcagagccccaggagctagactaaatctgagaggaacaggggagtcaaggctagatggaggcacacacatgcaggacaggaagggtctccagcagggctggaaagccaccaagcaagggtagtgcaaaccctgtcttctctgcttcctgctgcccctctcttattgggtagcagactggctgtgtctgcttatcccgcatggtggcacatggctgcccagagctccccaaataacctgttacgtttccacccacagggagaatcaggcagcccgcttgcttattgtttttaatatacttttccaaactacacagacattcccaaagcgggtctccttctacccaaaagagaaacgctgggccttactaattaactgaagactctgctagctcgagccttccaaaactccatgccacaattgttcaaaccattttccagaatacatcttttaaaataacttttagaaaattgaacaaagggattcatgtctcagctttatagtcaaaccatgatcttttctgagggtatagcccatttggagttcctgcttaatcccctgattaaaaactgaatggggctgagtgcagtggctcatgcctatattcccagcactttgggagacagaggcaggagaattacttaaggtcaggagtttaagaccatcctgagcaacataacaagtccccatctctaagacaaaaaaaaaagaactgagtgacatctcacatctcacatttctgaacattaaacccagccttgatagccaaagatgctcgccactgaaggatccaggtagtattgagggttctgtggggattatccaaagagaactttctacaaagttttaggtgatggcaatgctaaaagaaatgctaagaatttctctcttatattaaagagaactatggtcctctcataaaatgtaccatttatcaccaaatttatctcataacctaagagctaccacttacaaatttgaagggaaaaattactacattgtaatactcaagccaacacaaagaatcctatcccagtttcttgagtggatgggcaagaatatggggaatttattatgcagtaaccttcatctctcttctataggtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctttgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagcagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacgggatgaaaccctgtctctactaaaaatacaaaaaaaaaaaaaaaattagccgggcgtggtggtgagtgcctgtaatcacagctacttgggaggctgagatgggagaatcacttgaacccgggaggcagaggttgcagtgagccgagattgtgcccctgcactccagcctgagcgacagtgagactctgtctcagtccatgaagatgtagaggagaaactggaactctcgagcgttgctgggggggattgtaaaatggtgtgaccactgcagaagacagtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactcatacatgttacaacacggacgaaccttgaaaactttatgctaagtgaaataagccagacatcaacagataaatagtttatgattccacctacatgaggtactgagagtgaacaaatttacagagacagaaagcagaacagtgattaccagggactgaggggaggggagcatgggaagtgacggtttaatgggcacagggtttatgtttaggatgttgaaaaagttctgcagataaacagtagtgatagttgtaccgcaatgtgacttaatgccactaaattgacacttaaaaatggtttaaatggtcaattttgttatgtatattttatatcaatttaaaaaaaaacctgagccccaaaaggtattttaatcaccaaggctgattaaaccaaggctagaaccacctgcctatattttttgttaaatgatttcattcaatatcttttttttaataaaccatttttacttgggtgtttatattactgcttccaaattgctacagagtggtggggcaagggtgagtggaggtcttgggtgagagtctttacaagaagtaaatctctttgttatttgctgtgtcatagagaaaaggatggaatagagatggagcccagccttgccatcccctcacccccaacccaagcttcctgctgtagaccacacatcatggaaagaaatgcattctgggatgctctagggcgtctcgtgtcgttgggtgaggcagtagtcaggagtgtcaggggtgagacttagagttagaaggtgcagagggttgagtaagtttaccaaatccccctgatcaggtagcaggaaggcagagagctctcccagctcaaccagcagcacccactgtgagtgccctatcctcttccctctctcccacccaaacacacacccatcattccaggtttgacaggacagcccaaatgcagaatggggaagtggtttataatctgtcattaggagaaaacaaaagattcgaatcatgcctccaacagcatggagtgctgactgttcggagagtggggggatacagcagagaccacgacagacagtgccttgccctgggggagctcacattcctagggcttgtctctgcagggtctttgtcaagaggggctctgggtctgagcagcctgagaaggaaggaaggaggcaagaggaactgaacgtccgcagttcccaaacaacccccttcaggttaacaactaaatctaggggaaaacagggaggcaggagcacacctctgagtgggagggcttgaggggcagagaacttccactcaaaagccacagaagtgcctttcctattgcattcagcaacaacaatcccttctttcctgctcattctatgctgggtacttgctaaactcgggaccaagcacgactcaactgctctggctgagtcttcggaacagcttctgattcagtagcagggaaatgcaggggaacgtgtatttaccaaggacctgacttgccagaggaaccaatggtgctctgcctggacaaggctgatggaccaggtggctccctgagatgactcccagagggaagaggccaaattacacctcactctggtttcaggactctgctctttcctctcacaaggactggaggaaacatggttctccaagggataataaaagggatacccattcagcctagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacataaacgaggaaactgaggctttaccaaagcaacctggccaaaatctcatggctagacagtagtggagctgaaataagattcctagtcagttcgttttttaccaaatatttcgcttttcggttcgagcacctgacagacaagatggaaaattacatgtagacatgaccttttcagaccatttcactcacacgggtaagaccagtctacattttctgcacctgcactcatctgtgcctggagctggggttgctggagtctcagtcagcgaggcccagaggaggctcaggggcacaggtgtgggagcagcctcaggctgggttctcctattcttggctggcaggcagcacagttaaagacacaatcgtggccaggcacagttggtcacacctgtaatcccagcactttgggaggccaaggagagcagatcacctgaggtcaggagtttgagaccaacctggccaacatggtgaaactcagtctctaattaaaaacacaaaaattagttaggtgtggtggtgggcacctgtaatcccagctacatggaaggctgaggcaggagaatcacttgaacctgggaggcggaggttgcagtgagccgagatcatgccattgcactccagcatgggcaacaagagtgaaactccgtctcataaataaataaataaagacgcaatcagagcccaaaacaaaattcagagacaggcacaactaacccctctacagaggacacatatcttatcaggcaggggccaattaaagaagcaaaaccactgggaggaggaatttgtgacaggcatttgaccctaggcaactgtgggagctggctaaaccattagtgtcaggctgttggctttgtttcttggctgggatcttaagctggtaggatggacagcctggaaggaaagatggatgtaaagtgggaatagtgaggaggagctggaacctaccaggacaggctgatacctgcgttggtccaagttcagtatgtgaatggcctgtggagaagctggcacctgcaccaagcaggtaaacccacacctgaggggctgcaggccagctcaggccccatgcctacaggagccggcagataagtgacatcatatggtggtgtctggtgccttccactgaccttcctgagctgaaacagaatgtagatgctgctccacttccaccttccagatctcacatacaaggtcccttctggcccctcactgacctggaaatgtgaaaggaagagaatttggggaaatacagttctatcctatctatgctgactcaatacaaatcctctgcacaaacttatgtgcgaactctaaagaaaaagaacggttcccacaaaggttcaggtgatatttattaaagggtcgggaaagggaggaacacatgggggctttagggggcactgataatgtcctctctcttatcctatgtgatagatgcttaagagccattatattattattttttaagctataaatgttagttttctgtaatctgtgctatgtatgctattcacaagaaaagtctttttaatcattaaaatgaagggaaaaaatacagaaacagtgatcagaacaaaaggacaacctgggtcatttcaaggaaccaccacagggagtggactgcaagcttttgtgttgtatagtttggggatcagaattcaccagactagaagatattatcatccactgccagtaggagaggaattaggaacgatccttcaagagggcaattttgtgatatatactttaatgcatacaatctccaatccaggaattatacactgctacaaatctatcctatagaaatacacatctaggcggacaaacgtgtacaggatattcatcacagcattttttataaaagtcaaagctcagaaacaacctaaatatccatcagtggggaattggttagaaacactttgaaggtgcagccacactgtggaatactgtgaatgcagtggtttgaacatgatgtttaaaacatgcaaagtacggccaggtgtgggctcacgcctgtaatcccagcactttgggaagctgaggtgggtggatcacctgaggtcaggagtttgagaccagcctggccaacatggtgaaaccccgtctctgctaaaaatacaaaaatcagccaggcgtggtggtgcacacctgtaatcccagctactcgggaggctgaggcaagagaatcacttgaaccagagaggcggaagttgcagtgagccaagattgtgccattgcactcccgcctgggcaacagatcaagactccgtatcaaaaaataaataaataaaataaaaataaaacatgcaaagtggaagccgctgatcagtatgattctatttacataaaatgtccagaaaagacaaatctatacagacagaaagcagatgagcagttgcctggggttgagggtgggaaaagggattgactacaaacaggcaccaaggttccctttggagtgatagaaatatcctaaacctggattatggtgatggttgcacaactctgtaaatttactaaaattcactggatggcattcttaggacagactgatctgataataggttagtgatatctcagcaaactgttctttaaaagaatctttaaaaataatgaagtagggctgggcgtagcggctcacgtctataatcccagcactttgagagaccaaggcaggtggatcatttgagctcaggagtttgagaccaggctggccaacaaggtgaaaccccatctctactaaaaatacaaaaattcgccgggcatggtggcaggtgcctgtaattccagctactcaggaggctgagacacaataatcgcttaagcccaggaggcggaggttgcagtgagctgagatcacgtcactgcactccagcccgggtaacagagggagactctgtctcaaaaaaaaaaaaaattaaatataatataatataaaaataatgaagtcgttctatgactggacatggaaagatcttcaacaaataatgttgaatggaaaaggaaggcagatgattcatgaattgctgtttgctcaaatacagtgtttaaaattgcaacgacaaaaaagaaaaaggaaggtagaacagcatgtgtagtaaatggcttacctgcctgtgtaaaaaacactctagtctatatgtgggtttgtaaatgttcagaaaaatgtctgagagaacatataccaagctgtcaataggagttatggctggagagagctggaggatggggtagcattcatcactggtttgtacaattttgcattgtttccatttatttggttggggctggatttttccaaaaatgaaggagctgaagctgattttggaggggtctgcacaggccttcttatagacaagggggctgggctttgtggacatgaccatttctgtgttttatattctttcttgaacaatattcatattcttttttttacttgatttcctggtgaagttgctttttgaaaaacatcttcttagtcccaaatgagttaagcaataaagagacttgttgatatttgaccaaaaaagaactaggcaccactgatggccatgggacagcatttctaaaatgctccatgcttaaaatgggcttcttgtccaggtggttcctgcctgtaattcctacactttgggaggccaaggcaggaggaggattgctagagctcaggagttcgagaccaccctgagcatcagtgagaccccatctctacaaaaaatgtttaaaattagccagacatggtggcatacacatctagtcctagctactcaggaggctgagatgggaggatcatttaagcccaggaggtggaggctgcagtgagctgtgatcatgccactgcactccagctgggacaacagagcaagaccctgtcttaaaataaaataaaatataataaaatgggcatcttcttcaaaatatagatttatggataatccccagtttcctggcagaaactaggcagtgcacttgagctaggcaaggagagagagttttatccacttcagtaagagttgaataaagggacctggaacaacagtgtgggaaggatttggggaaaataatgtgaaattcagtaccctaaggactgtgacagtggggagcaatcactatccctaggcctaaagcagcaaggtgaggaaccatgacaggagcccaagagagagcagtatgatgtgggctgcctgacaggtgtcaaccccagcaaccagcagggacagggttgagcaaagaaatgcccctgacttgacactgctcctgtttagggttcctgaagcctctcttaccagggttcccattggctgaactcagtcccgtctcccacttggatccccctgatactgggttgagctcaacccaatctcctaccagtgaaagaggaggagttcccttatccccctcatgaggcatacaacaggggtgtgtctcgcttcttcagtgccccaccactcaaaccttgagggggagcatgcaggtgggcaggtcgtggggagcatttttgggctccgacaccacgacagcacctagggttgagtgtttacagctcccaaaaccccagtgggcatgtgttacactgtgctctttcagttttgccatctgcaggtggcttgtgttaatcagctcaattagatcctctgccttatcacaaggacagagggctttctgtaacccaagttcttgccctagtgtaccagaaaaatcagatcacacatgggcttggaggatgggtgcaaggttttattgagtggtggaggtagctctcagagaggtggatggggagccagaaggaggatggagtgggaaggtggtcttcccctggagtcaggctgcccagcagccagactttcctcctaccacccccaactgaattccatgttgtcccaccgtcaatggcctgccggtgttcgctggtgtctgttggtgtgttgttctgctcctcttgatgtcctgctacttgtgtgtgtacccgctaaggtctctcgggtttatatgggcacaggatgggggacgtagggggccagagtgggcttggaaaatgcaacaggaatggctctcctcatttaggtccatggacacaggcccagtgtggagccctcaccagggaccccacccttctctacccagcacttccctgccccactcccatatcaccaggattcccattggttgagctcagaaaccagaggacaagggagtgccctgagacagtccatgtaggtcagcatcccagggcacagaattcagtaaagaaaggtagagagtgtatctggaggaaaacatagatgatatccaactcaccacccaagcttcaagttaagagtaatggttccatttctaccaaatctgtatggctgagagtggatcctgggaatctggagccccagtgactctgatcatgactcaagtttaaaacctaccagcccagaagtaatagcagcagagctctcaaactggagatgagaaatgccctcttggaatcagaattgtttctgagggtgatccttttttttttttttttttttttgagggggagtctcactcttgcccaggctgaatgtggtggtatgatcttggctcactgcagcctctgcctcccaagttcaagtgattctcctgcctcagcctcccaagtagctgggattacaggtgcctgccaccaggcctagctaatttttgtatttttagtagagacagggtttcaccatgttggccaggttggtctcgaactcctgatctcaggtgatcttccctctttggcctcccaaagtgctgggattacaggcgtgacccaccacacccggctgttgggaacaggcccctcaaaatctggccataaactggccccaaaactggccttaaacaaaatctctgcagcactgtgacatgttcttgatggccataacgcccacactggaaggttgtgggtttaccagaatgagggcaaggaacacctggaccacccagggcagaaaacagcttaaaggcattcttaaaccacaacaatagcatgagcaatctgtgcttaagggcatgttcctgctgcagataactagccagacccacccctttatttcagcccatcccttcctttcccataagggatacttttaattaatctaatatctatagaaacaatgctaatgactggcttgctgttaataaatacctgggtaaatctctgttcagggctctcagctctgaaggctgtgagacccctgatttcccacttcacacctctatatttctgtgtgtgtctttaattcctctagcgccactgggttagggtctccccgaccgagctggtctcagcatccagccatgattttggcctagccaaaaagaagatggccttgcattggagcctcttgtggtcattctgtcttccctaggtggagcagctatgggagtccagagggaaaacagagaggagcagaaatcatggccccaactcaagggccctcccctaaggacagcttcagagacataaacaaaggagcaccttccgggagaagacaaacacaccactgatttctcaacagggccttgctaggtctgatgtcagacatgttccctgctcataaacagaagagccagcttcccatcaacactggctctgtgccaggcagacccagagacagggctaaagtcctggttcccatgaggtggtcagtgttttttctctattctgctacagttatgatcccagcgggcatttctagaggactttcttagaagtccagcaccatgctaagggatttgctctactggactgcacagctgtctatggcacttggaatacctcgcttccccatgcttaattccatgcttgcccaacagtccaacccaattgccaaaaatccataagcaggggagacagggagcttctgcaaggctcaggggtctcaatatcatagtagttcccagggaccatggtcaggggtgcccagaaaccctctgtttatggaaagattctactcattcagtttaggacatatacacagaagtgtgttattcatatcatactctccactctccactcatcacttgtgtgagtggtggccttgaactgctttacctaaatccacactgtctgggtggaaggaatctcgaagatccacttctgaactgacctccacttttgacaggtgaatgactggaggcccagagtaggtggacacttgcaagagatctcaaactacaagtgacagaagcagcactggacactggtctccagattccccattcattaccctcctcactaccaggatgccactctcaagttactgagaaaatgattcttatgggactggtggcaagactcataagattattcccatggcctttttcttccagtacctgtagataaagattcagagaaaaagaagacccaggaatagagacacagagtacagtcctaaagctactccttcacttattcatttttttcctgttcatcatgcaagtcaagtaaacatttggatctggtttagtggtaaacattggcatgatgacagcttcttgcaagagcttttaatgacaagatgccttgtattcaaacagagagatatttctttttttttacccaaaaacataaacatgaaagaagtgttaaaagaaaaactcttttaaagtatggtgaaacaagacataactgaaataacaaccattaatgaataagtattggaagaaaggtaccaaactgtgtcttgaggcagtctagcagagtggttaagggtgtaggccctggggccagaatgctaaatgcacatcccaactctagttacctaaacttttgtgcttcagtttcctcctgcataaaatgggcttattatagaactagccctacaaggtaattttaaggattaggttagttaggaaatacatatataaagcacttagcccagggcctagaacatggtaagctctaataaatgttagctattgatctttatttaaatctttaattttgtttcaagttcacagataaaataatttgggctaaattttgtaaatagaaattttgatataaagttcaaacaagatcctagctatagtattaatacaaaatacacatagccatcatcaactagcctgtcatataaaggtagtgacttttttttttttttgagacagagtctcactatgtcgaccaggctggagtgtagtagcgcaatctcagctcattgcaacctccacctcccaggctcaatcgagtctcctgcctcaacctctcgagtagctgggattacagatgtctgccaccacaccaggctaattgttgtatttttagtagagatggggttttgtcatgttggccaggctggtcttaaactcctgaca

SEQ ID NO: 881 - DNA, 2860 bp, Homo sapiens
cattcagagacagaaggtggatagacaaatctccaccttcagactggtaggctcctccagaagccatcagacaggaagatgtgaaaatccccagcactcatcccagaatcactaagtggcacctgtcctgggccaaagtcccaggacagacctcattgttcctctgtgggaatacctccccaggagggcatcctggatttcccccttgcaacccaggtcagaagtttcatcgtcaaggttgtttcatcttttttttcctgtctaacagctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctttgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagcagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacgggatgaaaccctgtctctactaaaaatacaaaaaaaaaaaaaaaattagccgggcgtggtggtgagtgcctgtaatcacagctacttgggaggctgagatgggagaatcacttgaacccgggaggcagaggttgcagtgagccgagattgtgcccctgcactccagcctgagcgacagtgagactctgtctcagtccatgaagatgtagaggagaaactggaactctcgagcgttgctgggggggattgtaaaatggtgtgaccactgcagaagacagtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactcatacatgttacaacacggacgaaccttgaaaactttatgctaagtgaaataagccagacatcaacagataaatagtttatgattccacctacatgaggtactgagagtgaacaaatttacagagacagaaagcagaacagtgattaccagggactgaggggaggggagcatgggaagtgacggtttaatgggcacagggtttatgtttaggatgttgaaaaagttctgcagataaacagtagtgatagttgtaccgcaatgtgacttaatgccactaaattgacacttaaaaatggtttaaatggtcaattttgttatgtatattttatatcaatttaaaaaaaaacctgagccccaaaaggtattttaatcaccaaggctgattaaaccaaggctagaaccacctgcctatattttttgttaaatgatttcattcaatatcttttttttaataaaccatttttacttgggtgtttat

SEQ ID NO: 882 - protein, 360 aa, Homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 883 - DNA, 42566 bp, Mus musculus
  misc_feature (1)...(42566): n = A,T,C or G
gtgtcatcttcttcagtgtcagcccagcacccagggcagggcctgcacctggcagacttactgtgtgtgcccagtgccttcatggctctacaggacaggacttaccgacataggaatcttgttccccagaagtctcctgtgcctccagtctctggctccaagattctttattggggccttagtgactgtcctgcatgtgtgctctgagttctttatctgctgatatgggaaccacatagtttggggattttgcttgtttggttggttggttggttttggttttgggggcattgttttgttttgggattggtatatatgtatatatgtatgtgtgtgtatttttgtatgtattttggagactaagcacacaggtgcacacacacgcacatgcacccacatatgctgaatacagataaactaaaaacagcttgtctgttttaaaaatgtttatgtgtaattaattataattaataatacattaacattttactttatattcatactttatattaacacattaatatttttacttctgccatcttaacttgcattattatcttacattttaatatcctggcttcttttttcctcccttcccttgcttcctgttgcagtggtaaagtttttcacctttaagtttggaacctctgatggtatctccctctctctctttctggtttttctagacagggtttctcagtgtagttctggctgtcctggaactcactctgtagattaggctggccccaaactcagaaatccacctgcctctgcccttcaagtgctgggactaaaggtgtgtgccaccaccaccttggctggtatctctgttctcatggaacaactactactactcctgccactgccactgccactacctcctcttcttcctcttcctcttcttttcttctccttctctttcttctcctacttcttctttcttcttcctcctcctcttccttaatatttatttatttatttatttatttatttatttatttatttatttaatgtatgctgtcttcagacacaccagaagagggcatcggatcccattacatatggttgtgagccaccatgtgattgctgggaattgaacttaggacctctggaagagcagtcagtgctcttaaccgctgagccatctctccagctggaagtttttcttaaactttaatgtgcatatataaccatagtttttcaaagaaatttgcatattttcacatgtaaatttctcccaaaagacaggatttttcttcttcttcttctttacatttcgttcttttatttgctgtgtgtgtgtgtgtgtgtgtgtgtgtgtgtgtgttgtgtgtgtgtgttttgcctgtgtgtgtctgtgtactaggtctgttcttagtgcctccagagctgagacgaacgcggcagcccttgaaactggcattacagacgcttgtgatgctctgtgtggcgctgggacctgaacccgggtcctctggacgagcagccagtcctctgaacctgagccgcctctccagccccttgggatgatttttttcttttacactcaattgttaattaagttgaccaacatattacaccaattcctgtgcctattattatttcttacattccacatccctttttctggtttaattttcctcctttccaaagcatatcctataattgttcttttagtaaagacagtgcctgttacctgaggttcttgtatgtgtgtatatgtcatgtagagattgttaagcatctttaaaaggaaaatgaaggggcctattaaaactcatcagcttcataacataaaaatcataccaccagcagcaggtggcagtgctactggattagaagtctgacttgtttcttgatgattcagcacttactgacagactggggacccctctccccccattcttaattcttgggcttcctgcctacaaggactgagaaatgctaccaaattcaaatagaaataggaccagtcttgtagctagttaatatggctcagttcctggattcaacaagatctgccgatccttgagtgccagggacacggactaagaatattgtcgtctgagttctaggcccacatcaggttctctagttgtctctgtttagtctcatttgctccagcagctgacttatctctcagcctttgtttcttcatctgtcaaatgggaataaggataataacctcgcagtaaccgtcaggtgcatctacaatacagaaaaagcacctagcaccgtgcccagactggtgtagccccttatgcggagtggtcagtcgccaaatgaatgcaggaggccaatgtaaatggcttcccaggaggaagggtagggcagatcgggataagcgctctgtacagaagagagaggagcagggagagtaaaggagactcaggcttgcccatggccacccagctccacagggtaaagggaccattctggctagctgggtgccagggaaggcaggggggcaaacagggcagaaagggaagtcaggacagagcaggtgtggggcacaactggctgaagagccatttgcaagggcagctcgttctcgcaggcacttgccctaggttctccctggctctgctgtccctcctttctgttaggctgaagcttagctgggctggcctggtggctaggccagccataggcagaaaagaggaagcatcaggacgacactggtttcaaccagtatcttattaaggaagtcgaggcaccctgcttctgctatttatccctctgggcattcagaggatgagttctcatttccagatgaaatcgtttgagagggctttgctctggcccttcggtggacatttttgagatggcctgagagaggttttgatttctcttttgaggagggtgaagggaatatggaatgccttaggtgaggctgtggacaccctgtttacacgaagcagaaacacaagagggccccagctttactcacagcctgctaaagcacaacgggacaaaaatggatttggcatcttctgtcagctagactagctccagcagggtgctctctactcaaaagaagtcgggactctgacttccagagagaagtcagaaaacacaaggttcctgaggcaggggccaagatcaccaacacctctagctgggtaaccttttaggcatgctggggacttcttatttttcacaactgaagaggttaaataatgctaggtgcttagtaaatactagaggctattgttctgcattggagtcgcccggcccttaatcctgacctggtgtgttctgggagctcagagaacctcagagcttacctaactctttccatggtgacctggggttttctgcagaggtcctggcttgagggaaggaaggccagagtgggtggggcgtcctgtccacctccattcgcgagggcagctgtttctgacaggagttacatgaggttgcatgctactagcttccataagataatgagtatgatttcatttgacaaaaataccccccccattttttttaataaagctagaagctatagcttctggttcccaccctggcgttctcagggtaagtgtacttactaaaagagggaagtgaaatatgatatattttacaaaggttattttctccaaaggccaacatttaaagtgttactgtggtacctttcagcgaatcacagactcatttagcctaaatcttatttctgtccgaggatcttgctttccatctgcgttctccagtgtgtaccagaggaactgaatctgcatcgtattacattgtaattaaatgtcctgctggctattagtaatatagagaggggtcaaatggcagacctgaccccaaaagctttgtcagaatacagattctaagaggctagagatggtttcatggctaaagagcacaggctgttcttctagagaacgcagatttgatgtccagttacagatgctcgctcacaaccatctgtaactctggttccagggaatcggatgccctcctcaggcctccacaggcaccagacacggtgctcagacatacgtggaagcaaagcatccacgcataagaaataaaagtagaaggacaggtcctgggacaggagggatggctcagccattgagggcatttgctggtctctcaaaggacctgagtttggttctctgctcccgggtgagggggctcacaactgtcctgtgactctagcaccagcagaccccaccgcctcttctgaccaccacagcatccccgatgtgtgtgcagataaaattaattcattactttttaaaggttcagatttgtagccagacgtggatggcacatggttgctgccgtgcagggggcgaagacagggaggcagacttccaagagtcaagaccctcaaccatatcttagagtaaaatgatttcttgtcacatagcgcgtgcacacacacacaacatggtgcagatgctgaggtcagagggtaactgtggcaattggttctctttctctacgctgtgggttccaggaatcaaactcaagttctcaggcttggcagcccctccccaaaaaaatgttttcctgaaaaggtctgggaatgtaacatgcctcggagagagagtgcttgcctgatccgtgtgaaaccctggtttcagtccccacactaagagacaagcagattcttggcctgcagcccggttcctcttgagtggatctagcagaagtgctttgtaagaagtcatctggggctgtaaccaactcctgcatgggaaagctcactgtgggagggatgcagaggtatggctcaagcatggagccctggccctgccctggcacactggagcaacaccctgtgccccgtatacacttgagcagctggctgagcaccatgaccctttccctggaaaaatacaaactgtgtcttgcttgctcttgtggctcccagacctccttgagcccaaaccaagaactgctctttttttaaaaaatcatggaaatatatataatatatatatatgtatatatattatatatataattatttacatcctgaatgctgtccccccttcccagtctcccctccccttcgcctctgagagagggcagtcccctcccccatatccccctactctgttgcatcaagtctctgcaggattaagtgcatcctctctcactgaggccagacaaggcagccctctgctacatatgtgccaggggccttggaccagcccaggtacactccgagaactgcttatggttgatatagtagcacccagtcacttctgcccctagactcctgcagacccattgggcacagcaagagggcatcaggttaggtgtatgcatcaggcctgaaagggtgctgtgtgaacccctgccttttctttgtgtgggctctgggtgtggctcttgccgtttctgtcatccttggcttccatacagtgaagacagcaggcggctgcgtgcactagaggctgaggtggagctggaggggggggggttgggttgagtgatactgtacagccttgacctcattttgtcccaactctccaggcactgcaggggagacagaaaggacaagtttcaggcctgggagatagggatgagcctgtaccaaagcccagggttctgggaagaacacctagctaccagtcctggaattgggactgaaatgagttttatgggccagacccacatagaagtagagagggagagaggaagcaggcctgtctatatttgtgggagagctgccattaggccagcgaacctggaagctgtcagagaggggctgagtcacgattatgtggcatgggaagccagctgcaggagaagctttgctgctgcgtgctggaactgtctgcctcggggagagtgagggtcagccactcttgggtccagctgccatctgctgggtcagcttctcagtaggtcctccttgttgtcctggctgccaggctgggcatgagtcactgtggagtacacaggaggcttcaacctcaagttctccccagaggaagcagcttgtgtttgtcgtgtgtgcatgggggtgggagcgccagggcccctggcctgctgcctggctagccaccatcttaatggagctatagcccagggtgaactttaaacattaggtaggagcaggctatctgagcagggtgcagctccacccatcttcctcgctcatcagcgaagttctttatctctggtgctcaggattgtcctgtcccaaagtctagaagtgtgcctttgcttgttcagtgcccttgtttagcccgtgtttgaccaacatgagcggtgttgagtttgccttgctgttctctatactaagatacctagggtccccctctgctcttagaccacagaggaccacaactttcgtttcacgtttgcctgtgacctgggaaacttgcgtgtgggtccagcctgaagagcccgggtcctctgcctgcctctgctctgattcacatgggcggagcgactttgagcagggacccacttgggtaggcttcaggtttctcacaaaaaaatgaggagattgaagcatccctgaggtccctttaaacatacagcaacttctgttacatttgggggatttttctgattggtttttaaatttaattttccctgatttttgtttttttttttaaagctaagaaaggtcagttttcttataggctttaagtcaatattcagcacgttgtgggattcagggaggagagtagagaaatgaaaaagaaaaattacaataatagcctacctggaggtttttgcctatttggctatttggaagtcagaattcccccatagacttcttagagtgaccaagtgacagattgtcttttttttttttttagatattttcttcatttacatttcaaatgatatccccaaagccccttatacccccccccactccccagtccacccactcccgcttcctggccctggcattcccctgtactggggcataggatcttcaaaataccaagggcccctcctcccattgatggccgaccaggccatcctctgctacatatgcaactagagacacagctctgggggttactggttagttcatattgttgttcctcctatatggttgcagacccctctgactgtcttttgtagcctccagaatcaggcagtcccctctaggttgagcgggctatgcttcagtagcaatggggatggaaggagagtgaggcggctttaggaagaagcttgagccaagtatccctcggatcaccactatctcattaacttccaggcatggttgggcagaaggccagggcccatagagcattggcttcatttggtctgcatttctgccccaagagcaaataagtatgagctgagcgtaatggcgtacagcagggaagacagcatctgtgagagatcagcctgccaccccagagcaattcttacagacctgtctgcatgtggcaccttctcaggctttgtctgaagcaagtcataccctgctcttcagtaagtcccagtctttggaccagaatgatggcttaatgtccttgtgcaattgctactctcccagaggaactgtaccatatggtggcttcacaactgtctataaatgcaattccaaggactcagacatcctttcctagcctctgagagtaccaggcacacatgtggtccacagagatatgtgcaggcaaaacaccaatgaacgtatttttttaggtcttgttttgactgagggtgtaattcagtggtagagcgcacatcgaatacgctggaggtccttggctcaacccctagcatcacacgaggacagaaacattcctgcctttgacaagctaggcatggtgacacgtgtctaatcccagcactcaggaggcaggaggctgatctctcagttggaggccagcctggtctagagagtgagctccaggacagccgggaccacagagaaagtagtcctggaaaaaaagaaaaagaaaagtcttccaatattgatgggcagggattgcccctgttcttttctaagtgactcaaacatctctgttatggacatgctatcccggcagtttatggctgcactctgttcagcttcctgggaaggctcagcatggtccatgtggaacccagagaaaggtgggatttcatgtttgtggcagggtactggatggtattaaggcctccagcatgaacgctcctcctaccatcgcctggaaggaaaatgtctcctagaagttttcagcaaatcagttttggacatctgaggaggaagccattttctaaagagccacagacagttgcatcatgggaaaggagccaagtgttcagcccattgttaggctgaatggtaggctttgtgacatttcctacacacatattcacatcaagccatgcatttcatgacagggtgtcaaccaacaatggactgcatgtacccctggtcccataagactcccccccccccatgatgtcataatgcactctgtgatactcacacaatgctaaaatcttctggcaacacatttgcaaaatgtatccccatcatgacataactgtgcatatattattcctgctaagaacaaaaccaaaccttgattttctcctttggagaaaagccaccatggacagtgtagatgtgcttgctctctgcgaaggcagggtgtccatggggtctgtgaggtgacgtttctgggggatgagatttacctccctgtcccagggaaatgaagttttccacacaacaggaagaggtttagtcattgtagggacaagaaaagtccaattccatgttgctgctgtctgcaggggaaggaaagactgactcttctttaaaacatttttatttgctctttgattttgtatatatgtataatttatttctataacactccattaccttcttttttaaaagttatttatttttaggccaggtggtggtagcacacacctttgatcccagcactcagaaagcagaaataggcagatctttgagtttgaagctagactggtctacagactgagatccaagacagccagggatatgcctatctcagaaagccaaaaaacatataataataatttaaaattatttaaaatgtgtaatttaaattatttaaagttgtttaaaacggttttcctttatatatgatgtgcagcacatgtgtgcagtacccatggagggcagaagagggcattggatctctggaactggagttatagatggctgcgtggatacaaggaaccaaatccatgtcctctgcataagcagccagtgccctaactgctgagccatctgtcacctcttatctccctctcattcccctccccacacccttcctacttgcctggcagtgtgtgtgcacacgtgtgtgcgtgtattacattgagtttaactagggtcatttgcatgagtatggatgtgaggttatttactggagcacgggcaatttaccagtggctacactctgaagaaaataactcctgtctctctgaaagcccagcagaggaatcctttcttttaaaaaatgacttattttatgtgcactggtgtcttgccttcgtgtatatatgtgtaagggtcccctggaactggagttacagacagttgtgagccaccatgtgggttctgggaattgaacctgggtcctctggaaaagtagcagtgcttttcatcactgagccacctctccagcccccagaggcatccatttatactacagtgccagtagagcaaggttcccacaaaatggaatgtttgtgataaatgtttcaaggttggcttccctaccactcagggtgtctagaggatgagaacactagacagaaagagccaagaacctctcacgtgacccccatacacacacacacacacacacacacacatacacatgcaccacacacatgcaccacacacacacacacatgcaccacacacacaccacacacacacacacacacacgcaggcaagcactcatttcccctccaagcatgcttaatctatgctgactacatagggcctgggacttgaccaagtctgtgtttggcccgtcaaggtgagcacgagcctgggagatggccgtgatggaagtggcctgcccgggcactcctgggtcagcagtcgggcagcagaaggagcttgccaaagccaaggagaagacacagtcactggggaagaagcagagctgcatcttcaagcttgaggccgtggagaagagccccgtgttctgtgggaagtgggagatcctaaacgacgtgatcaccaaaggcacagccaaggacggctctgagggaggaccaccggccatctccatcatcgcccaggctgaatgtaaggacctggggttgctatggatacagtggcaaatgagtgggctcacagatgggtggctgggcacaagaggccagcctgggagtccccatggagagcaaggtcagagtgactgttctagaagcatctcccagacacaattgagggtctagccacccacttaggagctgtaaatatgctagggtggatcatggaggccagagcaaatagaggctgtgccactgtgacccaaacagggagcagccaagagtcaggattgcttaaggactctacaagatcatcaagctggcccttaaccttccactgagcattgaacggtagcctgcagagaggctcagacaggaaaggccaagtctcctagaaagctcctctggcctacagacccttaccctgttcttatgcctgctgtgccagtctctgagctgctagcctcagcaggaggccaagcctggctttctccacttctactcctattgcctccagatggtagatattgatggctgcctgggaaacaagnnnnnnnnnnnnnnnnnnnnctatcctactgaaagcaatctacaggttaaatgcaatccccattagaattccaactcaattcttcaaggaattggaaagagtgattttcaaattcatctggcataacaaaaaacctaggatagcaaaacctcttctcagtgataaaagaacctctaatggaatcaccatgcctgacctaaagctgtactacagagcaattgtgataaaaactgcatggtgctggttatagcaacagacaagtagatgaatggaataaaattgaagacccagaaatgaaaccacatacctatggtcacttgatctttgacaagtggagcaaaaaccatccagtggaaaaaagacagcattttcaacaaatggtgctggctcaactagtggttatcatgtagaagaaaacaaattgatccattcttatttccttgtactaagtttaagtctaagtgggtcaagaaactccacataaaacaagagacactgaaacttataaaggagaaaataaggaaaagccaaaaagatatggtcacaggggaaaatcttccctctatcagtaccatcttccagtccaggtgtcttgggctagaacccagagaacctggcatctctctccatgtatatgcaacctctgcctcacttcccgaggcttttcctaaccaggaaagaacactgaaaatgagctcaaatgagctgagtgcacatacagtgacatgcgtgtaaacagaaatacgtgccagcttgtttatcaagggggcaactgtgtgccctgtggcatgtgggtgttctaggaggcgtcactggtaagctggggcacagggtagccccaacagtgagagaagattgtggcggggaggtgagccaccagacagaggaatatgacagggaaaggaagtggccactggggccctgtctgtaaaacgctctctcctaaatgctttgtctttgttcctatccctgctaatctgacccttttccctggatcacaggtgagaatagccaagagttcagccccaccttctcagagcgcattttcatcgcggggtcacagcagtacaggtaaggaagccaactggagctgggaagaagggagcccaggccacgcccaccaggcctctggccccctgcttcagcacctgggctctgctcctggcagccacccagctttcctggcccagccactcgcagccaagtcagcgtttcagaagctgcccctggctccgtcaaacttgacattttatttttactctaccctgagtccttgagacacctctgctttcccctcagcagggagggttctgggaacagtagtgactctgaacttgtatatagccatgagcacagtccagaggggctactttcaccatcctttagggaagacacccctaggggtcagggtgggagcttctgtcctccttacggtctaggcaattccttgtgtagtttcaggcatctcttgaccctgaggatgaactcttcttttggctgctggagagaagtctggaggctcccagcatcccaggaagggctgtggctgtggccgtggtcagagccgatggctgttttcacagcacctccttcagacccttgcctgaaacaagttcccataataactaacatgggtgggagcctggcagatccttggtagctacaccagccagaaagggagtctatttgtcagcgtctcatgttcccatggcaattagatacgtctaagggctaaggggagagataacagaaactctgccctgtcagagctaagatgcctgccccaagagggctggcacctggagaaggactgagggtccaccccaggctgtgcaagcactttatagggcaacctgctgagcagccaggtgctaaggcttatgaactgctcccgtttcgacctcatcaccacctcagtgtggtataaatactttcataaatgaaaaaatttggtattcctggtggggggggtgtgggtaggaactagcccacactaagtacagaggtacaacagaccagtgttttggtcaacagtgggccacatacacagtagcagtcccataggctcacagcagctcttggtatacagctgtccgagtttgcgctagtatactctgtgatgcacaggcagactcacctgacaccgcgcttccccgcacgcgtcccctgtcattaagcatgcgtgactgcagtgacagagccggctttgtactaagagtctgtcttcccttgcactcagaatgtggttatgcccctcttttgacagccagtctgagagtctcgatcaaatccccaacaatgtggcccatgcaactgaaggcaaaatggcccgtgtgtgccggaggggaaaacgtcacggcaaagcccgaaaaaaacgtaggaagaagaggtcgaagtcactggcccaggcaggagtggccttagccaagcccctgcccagaacccctgagcaagagagctgtaccatcccagtacaggtgagatcctgcccgttgccctggtcccagctcatgggcgtttggactgggacttgtaatgcctgtatttttcctgcaggaagatgagtctccactaggcaacctctatgccagaaatgtctcccagttcaccaagcctctggggggaccaggccttggccacctgtgctttaagaaacaagatgaaggcctgcgaccggtactgcctcgaccagaactccacaaactgatcagccccttgcaatgtctaaaccacgtgtggaaactccaccacccccaggccacaggcccccggccccacccgactcaccccttcccctacagcggaatgccccatcctttcccattctaccccctggagccctggaaaccctatatgctggactctgccgtcctggacaaactagccggtgtcagcggccagcggcctctgcctggcccaccgcatctaagccaactggcccatggagacagtcagaagccgctgcctggcccacacctggagtccagctgcccgtctcggggtgccctagaaaaggttcccgtggaggaatacctggtgcatgcgctccaaggaagtgtgagctcaggccaggcccacagcctggccagcctggctaagacatggtcctcgggaagcgccaagctgcagaggctcggccccgaaactgaggacaacgagggggtcctgcttactgaggtaactaacctccctcaagcccagccaccacctcccagctgagagtccacagatggcgctccgggtggggcttgctatggaagcagagtgtgagcagaccctgagagagggtcccctgaataacagagtccctcacacccattgtaacaaatcagtttgctcattgcagattgcagcattggggactgtgtaatcggggattctgttgccatgacacaaggcataagtcagtgaatttgaagaaaggttagtttgagctgatagtccagagggcccagcactatggctgagtgtctggtggagaagatgcactgaccccatcagacctgaaagcagagagagatgaaggctgtaatcccaactttctcttgaagggcaactcgcacgcgcacacacacacacacacacacacacaccaccccagtagtattaggcataccttcccccattaggccacacctattaaaggttccgcacaatccatagctgcagggtgaggagcaaacctggcctttactgctttcgtggctttactgcttgtgtggcatctgtgtggccctccacccacagcctcacttcccacagccttgctagctgccgctttttttcagatcctcaggttgctggattgtgtgttgagtgaaaatgtcccgtgagcagaggatgccgtcctccctctccctccctcccacatctcccttttccttcagttctctgcctgaataactttggaacctgaagcgatttgttcaacttgagggattgattctattcacttttaataacggtgcttgcccctgtctcttcaaccttggagttactgagttatatgtcccattatcaaggttgttggcgactctgcttctcatcgcaggaattatctgcctaccccaccccccaggcagcctatggtggccacctttgccatttaagatttaagtatacagcactctgcctgcaggccagaagagggcaccagatctcattatacgtggttatgagccaccgcgtggttgctgggaattgaactcaggcgctccagaagagcaagcagtcagtgctcttaacctctgaggcatctccccagccccacctttgtcttcttattcccctaaaccccttttggcctgtcttccttatcatcgcgctgtagggctggtagtctctttagatgtggtggccatccagccaccagagccctagctattgactagagagccttccccactgcagtcctctgtccctctgctgcccaggtcactggtactgacctcctcctcctcctcttcaaccccagaaactcaagccagtggattatgagtatcgagaagaggtccactggatgacacaccagcctcgggtgggcagagctccttcggcgaggtccacagaatgaaggacaagcagacaggcttccagtgtgctgtcaaaaaggtatgccgaggtgatacaccactgggctggcacccaaatttccaacactggggaggctgaggcaggaggatgaccatggatcctaggccagctgggactatgctgtgagaccctgacttggaaaaaaaaattacatagtaggtagaactctggggagctgaaagggaagccacacaggggctgctgccttccacctcagctttctgtcagcaacagtcatggggtatccggggctctcccttgatggttggcaccctagctgctctcgggtcagctggagctggaagggagccgtctggtgtgtcacatggcctggcctgattgctgcccttggtatgcatgtctgagaggcagtacaggagcacgcagctcgggtctggatacagccccggccgctgaggacgccagggcctgtaggggcaagtccaggcctgggagatgtttgagttcacaggaagctcgcgctgaacaaaaaaaaaaaaaaaaaaaaaaaaaaccctcacaccacagagctaagcatggatgagtgattaagacagcaaccaccacctgtcaggtgtctccctccaggaggctaaacactggaagttaaacctgcctcctgttggtcaagtgcactgtgggcccagacaggcaggacgacaatgtggaaaggtgacccaggtagacactaagaacctgcactggtagctgaatcaagttcacccccaaatctgtcacagaccatagctttgaagagagaaaggaaaaggagactccttgtcctaaggtcttgacataccacaggaagtcacctcccctgtggcttgcccacggccacccagggagccccagagcctgactatcccaacccagatgggaacgggcagctgcagatccgcaagtctcggtagtgtcagctctgctcctcagcatctctcaaaccctgccctggaagtcccctctcctctactgggagccagcttgtccctaagcaaaaggactaaggaccggaatttatgtggatcgtcattttggggattttgtctgagttgggttgtgactttgttttgtttggggtttttgttgttgggggggctgcccactggttcaaataactggcttatatcctgatcaccaaggaaaaagaccaagtaattagatcacccaggtgcagcatgccctgggtggccgccatacagagcggaccctgcctctgccatcatggctgccctgagctttggggatgactccagctgggacgtgaataagcctgagttattgcctgggttcattcttgggccagacatcaaagctgagcctcagagtagaaggataagggaagaatctgtaagctttacctcagatttcatacaggctacttgaagggagcaagccccacccaccatcctcacccctccgcagcaggagcacacactgagttcttgccagcctgggtcatcttccactcggatgccaggacctcgtgcctaacctccttagccgcagttccccctccccagtccaccagggcaggctcagctgtcccttccgagaggagaggtggtgggaggcggtgagacggtgtgaagtgtcctacagatgggtgcccagtgatgggagcttagtcaccagcctctcagctgttcctcggctgacatcctccgagtcctaagcaacagggtaaacaaccctgatacatttctcttgtcctgtgtcccgggcagctggaacagctccaggcataaggcctggacttcccagggctctggctgtccaccctcagagctcctagcttcttcctccagctcgtggggtagcatcagcctctcctctctctcagtgcaagggttagggcttgaagtttgtcctgtacagtttttagctctaagaccacataagagctcactttagggcttttgccttgtgagtatgaggccctgggttctaattctgatactacatacacaaaaagttccctgagttcccggcagagaacagcagacagtctgggagtcaggctcaggctgcctgttcccgttccttgctcctgggaaggagcctgaggataagtggctgccccttggtcctccttccagaaacttctgtaggcttaggtcacatgcttatcggcctcagatctaggccttaatgcaaggctttgtcttgtttttacggttttaatcttttatgtatctttaattaattcttatgacatgtttctggtggggggggggggcacacatgtcatgatgcagttgtggaggccaggggttggcaggaagcaagcacctctacctgctgagccatctcaccagcccccttttcaattgtaaacaagtactggctcaccataaatgaagtcaaatgccaccaaacaaaggttttccttgtcctcaaaaatgccatctgtcgtctatttttttagactctttatgtttaaatttggcttatcttttatgaaaatgagatccagtcctaaagattattctacactgtggttcacacacacacacacacacacacacacacacacacacaccccacacacaccatgaaagacatgctaggcaggatttctccttggttcacatagaatggtcaggctttttaagcaaccaataaataagttctccttgttggagaatgtacttataggatctttaaattcttagaacatgatcctaaagttcatgtgagttgtatgtgtggtcatggacacagtttgatggcaaagaaaccgtatcactaagcagattctccaagaattactatctgccctcaacaagagtgagcaactgcttgctttaagccatctggcccaagcatagaattctgggagcctccttttggctctgtcactgatctggaatagagtgtcactggccaagtcaaaccagctgtcctggaatacctgctttgtgccaaacaccatacagggaccggggacaaagatgtggaatccaaaggaactagtgttttgaagccttgtgtgtatgtgtgtttactcagcacatctgtggaggccagaggcagcttatgcactgggtgtggggtgtgggtgtgggtagttttgtgtgtgtgagagagatctgtatttggtatgtggtgtgtgtgtgtgtgtgtgtgtgtgtgtgtgtgtgtgtgtgtgtgtagagtatgtgtgtatggtatgtgatgtatgtggtgtgtgtatggtatgtgatgtatgtggtgtgtgtatgggatgtgtggtctttgtggctctgtgtgtgtgtgttgtgtgtgtgacgtctcaggattgaactggggcctcacactcagtaggcaagtgtgttccagtgagctatattcccagcctcttgagcttccagccagtcctcccttcacactgtgagcatgctggcattacagatgtgcaggacgacactggctttttctgtgggtttcagagatcaaattgcgatcacatgctggctctgctgattttcacctgctgagccatctccctggccagggctagagttttaaacaaacccaggctgtgctggagaagtggcatcagccacaaacccttgtttgcaagcagggatcaaagggacaccgtctgaaggaggaggaggaaatggggaccctgacttcttaggcttccgtgtcccattctgtgttctccctcccatcatggatattcctgcaatcttcagaaacttgtgacgttacctataccccacttatgacagagaaagattactgtgctagaggaaataaggaggttggaggagggaaagttgcccccaggctcaagcgccctggcactgcagcggagggaagtgacttccgcacttgtgccgtgttggatgctgtctgcagcttcccgggaatgctgctcctgtggccaggagtccaagctaaacctggagtgcggcagcgatagggtcgggcctcccaaccaaggctgtggtactctgttttcagtgacttcagatgagtcctttgtgccagcctcagcttccccatcacacagagccacccctccagagtctgttgtatgaaaaccatcgtctagtgctgaacagcaccagacatttggtagtggattttaaatgtaaattcccactcacgtcccatcacagcctagcatgagaaccctgaggttcagagaggtgcttcaggtgctgtctggccatggagaaggggagccttctccatcggactttacatgcgctaactaaccaaacttaatattctttaagtaaccaaaagagagacattgtccactgagaggcaaatgtccaaacccccaacatggacagagcaagtctagaaacaaaagctgggccaaactagtctgttaccgctgtcgccccctggcggtgccactccagagaacccacagcagccaacaagttcgattgagttggcaggaggaagtgggaagccagctctgcccaagtgtcttagtcaccaagcatggagaaagaccccatctctctgaatcctcacaccaccctgagcaggcagctgtgtccccaccattctcttagacacatggctgatggcagcaagaggcctttctgtgaatggcctaaccaagaagctaagcacaagatgtttgtatccatggcctaatgcctcctgccatgccaagatgctggagcccacaaataggagtgaccccagacttccagattaggagaagcattggccagcccatccccaggagcctctgtgtacccagatgctagggaaatagctacagggcaaacagtaatataactgcaggcctgtctccatggacagtttggtcctttgggaaataagtaacgggctggggagagagttcagcggatgaactacatctcgaggactggggttctgatccccagaacccacagaaaagccagacaggcatggtggccacttggagacagggacatgagttccccaggcaagctctgtttcaacagagaccttgcttcagtacaatatcaacaaacacacgtaacacactatgaaaaatcaaagcagttgctatgagggggactggagagatggctcagcagatgtttggctcccacatggctactcacaacctcctggactctagttttaggagatctggaaccttctgccctcctcacacacacagaacacatgcatgcactctaaacacacatacacacaattaatttaatttggggggtttttggtttggtttggtttggttttttttgttgttgttgttggggtttttttgtttgtttgtttgggtttttttttttttgttttttttttgtttttcgagacagggtttctctgtgtagccctggctgtcctggaactcactctgtagaccaggctggcctcgaactcagaaatcctcctgtctctgcctcccgagtgctgggattaaaggcgtgcccacctccaatgctatggtcctttaatacagttcctcatgtgttgaccacccccaaccataaaattattttcatcattgtttcctaactgtaatttgatattatgaatcataataaattgacccctgtaaaagggtcactcagccctcaaaggggttgggacccacaggttgagaaccactggtgcagcgactcctcacagagtcaggcatcgcagcacatccttattatcccagcacttgctacgctgaggcggactggaagttcaaagccaacctaagatacatgatgaggcctgtagcaggtacagggtaggcagggttcacaagacctcgtggcctagagattttcccccagagagctggggtacagaatgtgtttgcagattgagggtggagagaattccaggagtctggaaagaaagaaatgtttctgtgtgactgtttttcatgcagtcagcactgtggccctgatacctgacaccaggggactatacatgggttatgctcatttcccaagggctggtcccactgggcctgggcaccaccactgagagcattgttagcttctatgcatagaattccaagggttccccagcccgcacccctcaccctgacacaggggcctctgggtctttcaggtacgactcgaggtgtttcgggtagaggaactagtggcctgtgctggtctgagctcgcccagaatcgtccctctctatggagctgtgagagaaggcccgtgggtgaacatcttcatggaactgctagaaggtgaggagacaggtcccgtctttatccctctcaaggttcaaggccaagaggtaacccccacttagacccttgcctctcaggccacgtcggacctcttagccctgctcccttacctcacctgcccttcgctcttgccctcggcctgcgtgtaggcctgggaaagccccactaagactgactgttctttccctaggtggctcgctgggtcagctcataaagcaaatgggctgtctgccagaagaccgagccctttactacctgggccaggccctggaggggctggagtacctccacacacgcaggattctgcatggcgatgtcaaaggtaaggccctagtcaccatgtcctgatcccagcaggcgccccctcagctgtggcctgcctgcttgtcttcagggtagacgcctgagtcagctgacagggccgtgcctcgtgggtcggggtgatctctctaggccctgcgtctagcactgtgagtctcctgcgctggtgctcacagaaaactgaaggctaaactcctgccaactgacgacctctgggagagggtggggcggcagagagagcactctgggaaagtggtgttctaagagatgctgctccagatgctgcctgctgtctgcctccagcctcagctagccaccaccaaaacacgcgcatgtgcgcgcgcgcacacacacacacacacacacacaaacacacacacacacacacacacaaaacacacacacgnnnnnnnnnnnnnnnnnnnncgcatgtgcgcgcgcgcacacacacacacacacaaacacacacacacacacacacacacacacacacgctcgcacacatgctcgcgcacacacactgctctccctaacaagaccaatgagaaacagcagtgtaggaccagccagaaagttgtctgactagaagccaggtcaagtcaagccaggcgagggtgggctggggcctggagcccggtgtggctgacctgttccccctcttgctctttgccccggggctgcctgcagctgacaacgtgctcctgtccagtgatggaagccgagcggccctctgcgactttggccacgccttgtgcctgcaacctgacggcctagggaaatccttgctcacaggtaacgcctcattctctacctcacaatcatagtaccggtagctgtcactcagcgttagcctcccaccacggtgctttccatgtggggtaaatgctgtggccactctccgtccccaggtagaactaatcatcctcacagccaccattacagggtcattacagggtcattacagggtgctcgctgtgcacagacacagcaacaggtgccagccaggtgccccatgaccatgtgaccttacacagcaaggcccaaaaggccaaaggtcctgcagtaggtccaggccttgtagtagtactggctgacctagaattccatatatagaccaggctgtcctcaaattcatgtagatcggccggcctctgcctccctgagtgctagggtttaaaagtatactatctccagctaaaattcattatttttttacttccttgttttttttatgcactttgttgttatttaaaaaacaaaaattatttattatgtatatagtattctgcctgcatgtatgactgaaggccagaagagggcaccagattccattacaaatggttgtgagccatcatgtggttgctgggaattggattcaggccctctggaagagcagccagtgctcttagcctgtgaaccactctcagccatttgttgttcattctttttttttttctttttctttttgtatgagacatggtctaactatgtggtacaggctggcttcagagacacaatcctcctgcttcagtgttagtattaaggctggtgttctgatcccttcttcattttgtctattaaacgactaggacatgtccaagcacgtgcacgcgcgcgtgcttttaccttgctctcacctatacctccactcccctccactcccctctgatcccctctgacccctgcctgccctgagtctcccctccactctcttaaccacctcaccatctctccagcccctcccttctttcatgtgacttatactgtgtaattaaatgtagaccctgcatatgagagaaaacatcacattttgttctctctactgcactccatgccccacttcccttcctctgggctttccctcctctttctttagcagtcacctcctcctaccaccatttctgtttgtctttcaacagggtttcactatgtagctctggaactctctatgtagaccaggttggcctcaaactcaaagagatcctcctgcctctccctcccacatgagctgggattaaaggcatgtgccaccacacccagctcaactgtaccttctattttcatgtcatatttatttatatttaaatctaggtttgaaggctgatgatatagcatagtccatagagtgcttaccaagcatgcatgaagtcttgactctccagaattctgtaaactgggcatgaagtcacatgcctgtagtccctgagcactctaaacccaggtggagacaggagtcaaacattcaaagtcagggcagtggtggcccacacctttgctcccagcactcaggaggcagaggcagccagatctcttgaggccagcctggtctacagagtgagttccaggacagccatgactacacagagaaaccttgtcttgaaaaaaattaataatcatcataaaacattattttatgattattaaaataatagtaatcctaagatgggggccccagctcagatgagaagcaaggtaggcctgggccaaggccaagcatgctttgggaagctgaggcaggcgaattgcaaattcaaggccagctttgacaacttagtgagaccctgtctcaaaataaagagtaaaaaggggatccgctgtagctgagtggtgaagtgcctgcctaacatgcatcgggcccaggattcaatccctaaatttggaaggaaaaaaagttgacatccacttaattgtatatgttggctcttgtttacctgtttaataattatatgcttttgtgcatatgaatttcctgaatttcattatggaggggcttggggttctgcttatttgcatgtttattttggttttttttttttacttattttgtttatgtgttattactgtgacatctcctaaaccattattcaatatgggagaaaatgcaagcgagatagacatagagactcatacctaaatcctagaactcaggaggctgaagtagtattgctgtgagttcaagaccagcctgggctataacgtgagactctgtttcaaaaaaacaaaaaacagccaggcatagtggtgcaggtctttaatctctgcatgtgggaggcagaagcagacagatctctgtgagttcaaggccagcctggtctacatagcaagttctaggacaaccaggactacaaagagacaccctgtctccaaaaacaaagtaaaaacacagtccagttagatgactcagcaggtaaaagacactcgctgcaggtctggtgacctaactttaatcccctgtgtaaaagcagaaggagaggaccaactccccagagttattattctctgacctccacaggcatgtcatagcgcatatgcccctgcacacatccacacaatagtaacaaaaccacttgtaacttagtgttccacctggggcagcccaggaactaagttgagtgggcactgaattcatgatgattctacctcccgccctgtgccctcaggggactacattcctggcacggagacccacatggcaccagaagtggtgatgggaaagccctgcgatgccaaggtggacatctggagcagctgctgcatgatgctccacatgctcaacggctgccacccctggactcagtacttccgaggcccgctttgtctcaaggtcagcaatggccccaaacagctgtgcagggaggccggcagctacgggcccaggccacaggctagtgacagttgttcgtctgtgacagatgtgagcaatggcaggtcccttctgccctgtttgccccaccagcccaccacccccacccccactcccagcatcctttagactaagtctggaggacatggtatcttgttgccaggcactgtcctgtcctatttggatgcaggtttccgtgttctaggagcctttccactggctgtagtgcagtcctctccctccttatagcagacccccaatcaagcgtagggaaggagggattggtggagagcgaacatgagatgtgacaggggaaggaggaggaagcaggccttgaatgtcgccttttggcctctagattgccagcgagcctccaccgatcagggagatcccaccttcctgcgcacccctcacagcccaggccatccaagaggggctgaggaaagagcccgtccaccgagcatctgccatggagcttcggaggaaagtgggcaaggcactacaggaaggtgagagccctgtgtgcctgcgtcagcggagagcagtgtgcagagggaagggagaaacagcctcaatcccccatctcccctcagtcctagaaagcttggggtggtggcttgggacatggaggaggaggggctgtgacacggaaaggtgactcagagtgcaaattaaagccacacatgcccagtagccactcacatgtcaagagccagaaaattggcaataccaggtgctggtgggaccgcgggcacaggactccctgggcaccgggagggtactgacgctgcagccacgctagagggaacctggtagcactcgggccgacccaaaccttcctctcctggtgcactatagccttgttggctagagggagcagagagggcttaagagcccctcaaggggaaagcaggtgattggggctgggacatcacccagcacttacaaccactccataccgctccatatgcacagcgtgagtacgggaactgagctgaaagccgtaggtggtgagcactcagtgagaagaacccccgagaggaggcctgcaccataagagctccattgcaagttaaaaaaatcaataaagaaagcaacacccatcgtactctgggcgagctgcctcaggcctggaatcccccttcctaaaaggcagggcagagacgattgttggactttgaggcctgggatatagaatgacatattgttttaaaaaataaataaaacaataaaaaaggaccaaatgtggtagccttttcccctactcttgagaagcagagcagcctctgtaagttcaaggccagccaggactacacagtgaagccttgtctcaaatacacacacacacacacacatacacaacacacacacacacacacacacaggggggtggggtactgaaacatgtggaggtagcatgtctgtgatcatagctaagagacaaacaggactttaagatacagcacccgcttgggctacaaagcaaagccccgtctcaaataaaaaagagagagtgagtcaggaatggagcttaacagaatgtaactcagcaatgggcaggagaccagtggcagttaaaggacaaaggctgggactggaaagatggctgagcagttaagcgtacatcgggggaagacccaaagaccggagttcagttcccagcacccaggcccagtggtggagaaccacctgaaactgaagctccaggatatctggtgtccatcttccagcctttatgggcaccgcactcacataaccaacacatatacgcccataatttaattttttaattgataggccgttcttcctgggctggtgtctgcatgcctgcacatttcccccctcacctcgggtgcctttctctcttacagtgggaggtctgaaaagcccttggaaaggagaatataaagaaccaagacctccaccccaagaccaagccacctgccaccagaccctacctactccgccgagagagaacccaccagccaaggccaacacagacggggctcctgagcctcagcctcctctaccgccagaaccaccagaaccgagcaaagcgccagccctgaacctgagcaaggaggagtctggcacatgggaacccctgcctctgtcctccctggacccagccactgccaaaggccccagcttcccagaccggagggcaaccttgccagagctggagctacagcaactggagataggtgggcgctcagctgtggccacgcccctcgccccacccctaccccacctcccctgccaggcctgctcctgcaggctgtgcagggggtaccttgggaagtaattcctccaacccttcacgctgtctccctctccccgcttccccctgcagaactgtttctcaacagcctgtcccagccgttctctctggaggaacaggaacaaatcctctcctgcctcagcatcgacagcctctcgctgtcagatgacagtgaaaaggtgagtggccggccgaccgaccgagcagcctgctggcccacgcaaaggccttagacagagcaggggccatgaggtcaccctgaggtgggaacttgaggatactctggagactccgttgcattggacggtgttttgctggggcaaacaggtgaaggagtgtttttctgtttcacacgggtggaaggctaaggcagactcatcaaggaaagtttggctaaagcagacacgggtaaaaggatgttctactaaaacaaacaggaaaagggcccgtgataaatgattattttttttttttactaataacacacatatgttggtctgccttctattacatatgagttacatttgctgggactctatagagagaaacacgccttcaccctccttgcttgtgccccagcttgagacaggatgccttccaccctaaccctaaccctaaccctgaccctgaccctaaccctaaccctgaatcaggaaaggctttaggtagtctggagagtgagcggtagctttggtcccacatagaaatgtaccttgggtctgtcataggactggcgggtctgaccctaagagaaggtcagttcctcttgttccaaggaaaccagggccagagacggtttcctgagtctgtgcctgcctttgtgttcagaatccatcgaaggcctctcagagctcacgggacaccctgagttctggcgtgcactcttggaacagccaagctgaggcaagaacctgcagctgcagcacggcgctggcccgggggcggcctactgacatcccgagctacttcaacggtatggtctgcttctcccctcttccagcccagtcctgccgggatccagggaggggcggagaagcagttcattggcctctcctcagcacagaagggtgggggaggaacgtgcccgccatccagaacctctctcacagccctggctggacagctgggtttagacagagagccctgaccactcccaagggttcccagaacagagaaccgctgcccctccaaattggctgcctgtagagtccccgaaggccaacatggggaagaaaatggccgatcctaggccagggccagaagctgaatacctaatgcctggtgatgaggaaataggaacacgcccaggagcagtttaatcaagaaaccagtaacaagtctgttggcatcctctgctgggatttgaagtcagaagatgagagggcatttaaatgactgctttcaagcttcgctccacagtcaagttagcatcttaccagggcgtctgtaacagctcgtaggcaccagctctcctcaagccagtgtgaggactgtcaggccccaaggccatgccagaggttcagagacattcataagttgcctacagtctaatttaaggatgctggagagagcggaagcgagttgagcttgcttcctgtctgggctaaaattgggatgttatgactcagagcaacttacgctcaaagctctgcagaaatggcacgggataaggttggggtggcgttatttaagaaaaacgtttactgagtcaggatgggtagcctaacttgtccgttacatccttagatttttctctcttctatatttagaaaagaaatagtctctgttgaatcttgaattttctggaattggcttgttactttaaaaatatttgattgtgcccaaagttgtcatgaagggactcacaagggcttagaggatgcttaggacagggcagctgcctgatatccgtgacactctgccagagaaaaagtggggattaggctgggcggtggtggcgcatgcctttaatcccagcacttgggaggcagaggcaggaggatttctgagttcgaggccagcctggtctacaaagtgaattccaggacagccagggctatgcagagaaaccctgtcttgaaaaaaaaagaaagaaagaaagaaagaaagaaagaaagaaagaaagaaagaaagaaagaaagaaagaaagaaagaaagaaagaaagaaagaaaaagaaaaagaaaaagtggggattagaagtcttttattccaggctgtggtggcgcacacttttaatcccagcactctggaggcagaggcaggtggatctctgtgtcagttcaagccagcctgatctgcacagtccaggacagccagggctacacagagaaacccttccttgagaagaagcagaagaaaaaaaaggaagtctttcatctctatgagcagataagacactgcctctcaggcgttggtggcacacgcctttaatcccagcactcaggaggcagaggcaggcggatttctgagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacaattcattatattatttatccattctaccacaaaaacatgtagtcaggagtcacttgtcacccctcataaaatagagggctttacagagaggttcagttgttggcatttttaggcaaggtaatattaatacatcatctctttttggttgtgatgctgtgcagggcctttgtgcatgctgggtaagtggtccaccactgagggacacgcccagccctgaatgtgttatacttaaaaaggaagttagcctgtgtcctttgggtttgtagaagactttttttgttgttgttgttgttgttttgtttttgtttttgttttttttttttttttttttttttttttttttttttggatttttggtttttcgaaacaaagtttctctatatagccctggctgtcctggaactcactctgtaaaccaggctggcctcgaactcaaaaatcctcctgtctctgcctcccaagtgctggaattaaaggtgttcaccaccactgccgggctagaagactttaaaatagctacatgctatcacatgtgcctcagttgactgaactaaacaagaagaaaaggacagccaagcagtggtgggtggcacatgcctttgatcccagcattcaggaggcagatgcaagcagagcccataggattacataaagaaaccctgtccccaaaagaggaagaaaccaaggaagatgaagagattataaagagaagacagacaggaggtgataaaccagtaactcagtgagggggtcctttgtcctctgtgccttcttgctacacatccagagtagaatattacttccccctgggagccagcctcttagcaggatgcaggccaaattgcaggtgttgctagccagggagagctgtgtaatattcaggcccctttaacctgaatttgctttctgctgctttgccccagccagacctgctccactctatgagtgacttcacaggggttgcccttggccctgcctgctcccccacactctgagtaacaagcctccgccctgccctcactctcagccttggctttctaggggtcaaggtccagatccagtctctcaatggcgaacacctgcatatccgggaattccaccgcgtcaaggtgggagacattgccaccggcatcagcagccaggtgaggaagggacacttagggacacagtaaatgagaactgcaccctggggaattagtggtccatggcttagctgctctccaggtctcagggcaggacaggcagggggtgtggaggatctctggacccagagttgggctaggaaggaccctccgagtcctctggaataaaggacgggcagtattctccccactacctgtttgactggaggaggtgtctcccagcatgttcggggaccataagctttacactcaagctcccttctcgatgcatgccgccctctcaccccagccggtttgctctacccacagatcccagccacagctttcagcctggtgaccaaagatggacagcctgtttgctatgacatggaggtgccagactcgggcatcgacctgcagtgcaccctggcccctgatggcagctttgcttggacctggagggtcaagcatggtcagctggagaaccgaccctagtcctgtcttccaccaccagctccactctggccacagcaggcttcctttgatctcagtgctcgctggtgctctgagatgctggatgagtctgcacagggacctgccagtccctggttcagcatgtagaccagggcttgtgagcagagcagcaaagggagcagagtaaagcacctcccaggacttgcctcctggcaggagaaactcttccctcatgaggagacaaggaggaaggaaaacaggggtctctgtgactctccaaacaaggtagccagacccacatgggtcagtcagcacttgccagcagttggggagcagcttctagcctgggtcacgaagagcaggtacccctaggaaggcaggagagtgtctaggggttcctgcccagctcctacagggcaaggcagtaggtgagccggcccaggggctgtggagttcttggccccgtgtctagcctccctggccttgactagtgtgagatggaaggagcaggaagggcactagaatgcactgtgccttccggtcattgcagcccacgtcctgggttgagctccttgatcaaccagggaccacagaagagacatgattctcgggcctcacgtttgtggctatgggcagcactcctcagcgtcagccccactggctccctggcactctagtccctcatctgtggcaatgaaggatgacacgtgagacccacctgacaggaacggtctgcaaatgataaactcaagaaagccacagaaacagggcttgccaccctctgggggcacactgtcagcatccagcatggtgtggcaaggcattgccagcagcagcactttgcactcaggtgacctcaaagcactttcctggctgccttccagcagagcattggctctgcatgagcaggggcaggccaggggatggggaagaagggactgtcttgacccatcatccacacaggcttgaccccccctcaagcttctttcagacttaagatgagcatcgtcgcccccactgccctagctgggacttctcctggtgggacttggaaacagctgcttaggactcattgtagcattaagttcactgtgaatcatttgttgggaggggcacagagacttctctagggaaactcatccccccacctcaaccagccaggatagctctgtccagctctttgcaaggatctaggctgctcctggccccagcacatgaacggcagccacggtgctgcatctggggtgtattgagttctataagcaataaaatttggaatgacgatgggtgtttgtaggctgtgatgtcgcctcttttgcctgcctgcttgcagtactccacaaccctgacagctgctggagtggattccttcaagcctccgtggttggagcgaggactggcatcagcctgtccagagagctgcttgtcctgctacctgtcatatccaactcaatccctccactctggtatgcccatctcctgtagcagcagggatatccctggccaaagtacttgggctgaaaggaggaggccaagaggccaggcagcccagtggcaccagaaggggaggggcttgcatgacccactcacctgcctgcacctgtcctgaggcccatcggcaagaggtcttacctggtattactttgagcgtctgcgtggtgaggtgatgacttgcccagcaggagtttcttgatcacggagcatagggtggcagaggacacaagagcactgatatgcctctagcccctagaatgagctgactatgatggtacacacctgtaatccagccttgggctacaagaagaatttgaagccagcctaggctacatgggactttgtctcagaaggaaaaaactacttgggcggtgggagatgggatgtagccttgactgtctagaactcactacgtagaacaaccagactggcctcaaactcacagaaatcctcccacttctgcctccccactgccagaattaaataagaatttatgctaccgtgtccagcttttggggggggggggttgtgattaaagcctgctgcaatggaatctaatactagacaacctgaatttagtcccaggaaaggaacagtcactgtggaaggtgactgttcccaaaagttgtcctctgaccaccacacactggatgtggtgtgaaagttttcacacacaataaatgtaattgtaaaaaaactgtaaggtcaccctggaaagctatgcacaggtgtgtgtactgcacacatgcacagcttggactgagattcaaccatccttagaggaatcctagactccccgcaaaaatggagcagctttgttgtccagatgaggttctaagcccccacctaccccgtccttacccaagaccgctgaccacatacctggcctactgtggcgtggccagctgccccaagtcttggtcccggggaggggggtggcgggggaagctgtctgctcaacctccaagactcaaaagatcctttcttgttcccacccacatcattggcatgaaccttcaagtttcctacatgccatatcccctggcctgaacgtcacagaagccgcagcatcacaggcgccagcgcccccatcatcttcagccccccctccaccgggctagccaaagagcgcactggaggcggaggggcagcagccaccagcccgctccccgcctccctgacagagcctccggcagcatgggggtgacaggtgcgagcaggcggccgagtggtgggaggcgccagaatggcggggcggaggcggagaaagggaaagctaactggtgttggcctggggagaggaaaggaaagctaaccccagccaagccctttgggtgcctttgattactgcagcattcctcgctgtgcaaaagctggggctgcatgagtgcggggtcttaatgaactttccaatgggattgcattcgcgggtgcacgcgtgcacgtttggcagagtggtgggtttgggatttaatgtctttgcaaaggtggtcgccgaatccatctgcgtgagacactgctaaggatcagatagccaaagctagtaaacccataacacgctggagggggggaggaggcgggaatcagccagaaacgtgctcagatgggcgggcttggggcttccggaagagcggtaaggccttgcgtcatcacagtgggaagccaagagtgcgcgcggtgcggtgcagtgcggtgcggtgcggtgcgcgtagtgttttaacggtcatgagatttaaggtcccttccaagaaaaacgtttggtaacaaggtcgagagcactatggtgcagagacaactctcgtccatctctgcccttagcccttaaatacagtggctaatagctgaaagtcagcatttccttttcaaccttatcaaagcaataaatatccctgattcaagagtattgacgagtttatttgctgattaaaaaaaaaatcaagggtccctctatccaggcatacctcagagcagacgcaggccttttctcaaaacaaaacaaaaacaaaatcccaagcactaaagaggcagaggcaggggaatctctttaagttcgaggccagcctgaactatagggcgaattccaggacagccagagctacacaaagaaatcctgtcttgaaaaaaggtaaaaaacaaacaaacaaacaaattctaggttaaaaactaatcaaaatgttaaagccaaccattgtgagtttctccctcttacaagttactggggtttctctttttaaagtatctgtggggtctggagaggtggctcagtggttaagagcactgactattcctcaattgaattcccagcacccacatggtggctcctaaccatgtgtgatgggacccagtgatctcttctggtgtgtctgaagacagcaacaatgtactcttaactgtttttttttaaagaagtatttgtgggtcaggcaggtggcaagttaaaaacactttccgtgtaagtgtgaggaccagagttctgatcgcagaacccacagaaaggccaactgggtgagacgggcgggcttgtaaccccagtctctgaatgtggagacagagccccagagcaaggaagaatcctgtctgggagctctggatttcacagagagaccttgcctctaggaaggaggaggaagttagaggcaaggatgactcccagagtcaacctccagcttccagacgcccagcactcacatgcacacacacgcgtgtgcaaaaatgaaaacacgtgtttgtgactcagctgttcctggtgtgaactgtgtccacaccagcagcatctctccagcgctccaggagcctttccaaggccctgagaaccttcttctcagtggaatgttttactttttttctttctagatctcccttctagattacacagtcacatctactgggttgagaggatggttgtcagtatctcacaagcatgcgaaccagagctcaacccccagaattcgtgtatggtatggcagcggcgcctagcatctcagtgctaagagggcagacaggagggtccccgagacccctggctggcctgattaaccagtgagagaccctgcctcaaaggacactgtggaaggctcctgcagaaggacatgcaagggtgtcctctagcctccacatgcctgtgcagacacatgccaatgtattctagaatagcactatagctgatacttggggtctgttttctgaaattgctctttcttattttctagaaagaatactctttctttctttgccaaaaagcgaccttctgtaattatttatagcatcttggttttctctgtttgtttcccttagtttggtttggtttttgatgtgacacattttagcattgtcctcaaatcactgaaagtgattaccttctctttgaagtaccctcctgtcctcctgtttctcaagccacctttgctcttctggaatcaacttctcatctgcagattgaccgtttttgtcaagtctttggtggccatcagttagttgcccctgttcaagaatgaaatcattaaagcagctcattggaattctttcaactgtaggtcttactgcctggccagtgtcacttaagggtggtcagacagagaccaggcacacctcaggattgtcagcatcttatgatgccttgtttgggagaaagcacccctcacccatgacccctgaactcctccccttatacctcaaatctcccaagctcccagaactcacctggacagattggttcagcatcctgtgtgacctttgacctttctcaatttctgactccactccatcaaacactgtatgtctctagtctcctgccttccannnnnnnnnnnnnnnnnnnnttagttaatcattacgaatccatattcatattcatcccccctcttgcttcccctcccttctcccccctcttgaattaaacatggggactcccaaatgcctggcagatgctgtaccattgagcaatatctcagccctctcttatctctaagctccatttcaaacatctggtcacaaggaggacatgacatcacactgttaagggctcccttgctacaggcaaattatcctaataccatttgaaggaagccagtgataaagttggatagtcaatgcccaatgcagtggctctcaaccttcctaatgctgctacccttcagtacatacagttcctcatggtgtggtgaccccccaaagaaaaacactattgtcattgctacttcataactgtaattttgctaatgttatgaattgtattgcaaatatctgcatttttcaatgctcttaggcaacctctgtgaactggtcattcgacccttacagaggtctagacacacggcttctcaactaaaataagtttagttaaaacaactaaaataacaagacagtcacagctataataaaatccagcagaatcctgcaaataatctagaggaggcataaaaaaggagcaaagtgacatgtggaagcaaataacagaacatgcgtttaaacccaaagggcagccgtctcggctcccttctaaagcaagtacttagcacggacaagagcactgtcctgggctcggtctccagcaccgtcccccacccacacaaggtcactttacagattacctaaggagacagaagaggtcatgcctgggctacgcatagatggtgatgggctgcttgcctggcacgaaaggctctgaattcaatctctgggacggggggtgggggtggggaataattaggaaaagcaacacttgactatatgctgccatttaaaaatccactttaaatataaaaacacaaagattaaaagtaaaagattgtgctaacactaaaaagcttagctctgactcccaggaccagttaagccaggttcggtagcgcctgcctgtaatcccagcaacctggtaaatagagatgaaaggatcagaaatgtcaggtcactcctatgtatataacccatccttaagtttcaaagccagccacagaaacagtagactctatctcaaaaattaattagttagttagttaattaaatcatattatttatttacttactcactttatatcccaaccagtttcccctctttctgctcctcccagtcctccctccccacccctcctacttctctctttctcttcagaaaaagggaagcctcccatggatgacaagcagccttggcatctcaacttgcataaggcttaggtgcatgttctattgagtcgagacaaggcagcccaggagagggggtaaaggtcccaaagtcaggctagaaaatggagtttttgcctactatatgcaagttccattcttagggctgcaaaacaaaaggatgtataactatcctaagggactgtgttcctaacaccagagcttcaaagaacacaaagaaaaactaatgtaatggccaaatgtgacctacattcccagcactaagaggcggagacaagaggatcaggagttcaagggtggcctaggtcacatagggagcttgaacccagcttgaacatgctgccagagaatcaggaaaacgtcggaggaagtaggggctagggaggtagccgagctgttaagggcaaattccacaccccagcacttaggtcagaaatttcataaccacctacaactccaggggactcagtgcgccctcttctggccttcagtggtatgtgcactcacgtgcacataacctgtacacagccacacaggcatacacaaaattaaaaatacaatttaaaaataaatatttaaagagagaaagaaaataaaagtagaggtgattcagtgagagggaagaggataagagtgtgtgatggaggtaaatataatcaaaatacattagatgcatgtatggcatcattaacattttacttaagaaaactgatgcaacttctaaggggaaacaggggaatctgccctcaccgttaaagatttcctcacccctctcagggactaagagcaagcaggcacagagtcaggatttagaggcgctaaatggctctccctgataactggtattcacaggacattccactccatggcagaatgcacactcttttacaaaaacaatctgcactctgggagtggtacacacacacctttagtcccagtgctgagagagcagaggcaggaagatctctgtgagttcgaggccaccctagtctacctagaaagttccaagccagcaagagctacgtagtgagaccctgtttcatgcacggacaactagaagctagagaggtggctcatcggttaagagcacataccagtctcttgtagaagacctggttcaattctcaatactttgggacactcactactttatataactccatttctaaatggatctgatgcctggggctggagagatagctcaatggttgactgcatactccccctgcagaggactctgttcaattcccagctctctgttgttttacaacctcttaggttcacacaccctatgacctccaagtgcatctgtacacaaatggcacacacaagattattgaaatgataacattttaaagtcttttttaaaaaataatgatgatcaaccgggcgtggtggtgcacgccttttatcccagcccttggaaggcagaggcaggtggatttctgagttcgaggccagcctggtctacagagtgagttccaggacagtcagggctatacagagaaaccctgtctcgaaaaaccaaaataataataataacaataatgatcaggcataatgatacatacctttaattccggtactcaagaggcagaggcaagtagatctttgagtttgaggccacctgagtctatatagtgagtttctgaggacagactgggtctacatggtgacaccctgtctcaggatgatgatgatgatgatgatgatggtggtggtgatgatgatgatgatgatgatgatgatgatgatgatgatgatgattggaggctaggtctagtgatgaacacctttaatcccagcattcatcaggcagaggaaagtaaagtcttgtgaatggaaggccatcctggtctacatagttcccatttgatgatgatgatgatgatgatgataatgacgataagtatttttttaaaaatcaactgagtaaagtagggaaggacgattcaacctgataaacagcatctgtgaagaaaactaccaccagcaccataaagatggaggtctggatgtttccaaggacactggaaggcagcaaggctgtggttgtacccagttcaaagggggaagaaacgaaagatgccagacatggaaggaagaaacaatgtcgtcttgactcacactcattcttttgtatgcacaaacccaggatgttctccaaataaaccctatcaggactcatgggtttttatcaggactgcagaatgtgagttggtatctctagaatattagcagcaactggacactgaaaaatacctcaaacatcacagactgaagcttggctttcttacaagtcaagcacagaagccccaagatgagccaaccccagactttgtcttccagcccccagagctgctatgacgcttacaaaattccaactcaccctctgtccattccaagtagcagcttagggaagggtagaagtgtgaatgaccagagatgtccaggaaaactgcaagtgagcaaggaaggctctatggttgggcgacaccaaaaagtcctgcttggggtggaatggagctgaagcccgcaaagggggtgggggtatgggtgaagaaagccagaagagtatgtgggtcaaggaggcagagctggcctacaagttcctgtccacgcttctctcagagcctcagcacacagctgacctaagatcctcatgccaggcagtccatctcagtccagatgtgcctgaatcctcaggctaggaccagccatgcaaggaccaccccttccatcctaggaagaagccacagtgtgttctcatatgctgctgatagaatcctggcagccattctcacccaaaaagcaaggttaacacttcctgctcttccctaggcttgtgggaacctacttagcataatgcacagaaggcatgatccctcgcaatcagtgattatggctccctgaggaggagagactgagacagcctggtgccccacctccagtgggtaaagggcagcttctgcaatagacgattagaaaagcttccaggatatccaccacctggctacaggatgccccccagagactctaccttctaggacttcaccaaccagcagtgggaccctggcacgacctcagatcaaacactcggagtgtaggccttggtctgaatcagtgttgggtgatgaaaaagagcttgagaagcagcaaaggtgacaaacagtgaggtgcagagattcttcggggactcctgcggaagatagcagagcagaagatggaggtaactcttaggcctgcattcaagtctttgacttagcagccaccagctatggaaagcctgggcagtgagccccctctaatgctaatgtggagagccatgggcattcccgcctgtggaggaggcagtaggtccaagagctgggacaaggccagatgacaa

SEQ ID NO: 884 - DNA, 2828 bp, Mus musculus
atggccgtgatggaagtggcctgcccgggcactcctgggtcagcagtcgggcagcagaaggagcttgccaaagccaaggagaagacacagtcactggggaagaagcagagctgcatcttcaagcttgaggccgtggagaagagccccgtgttctgtgggaagtgggagatcctaaacgacgtgatcaccaaaggcacagccaaggacggctctgagggaggaccaccggccatctccatcatcgcccaggctgaatgtgagaatagccaagagttcagccccaccttctcagagcgcattttcatcgcggggtcacagcagtacagccagtctgagagtctcgatcaaatccccaacaatgtggcccatgcaactgaaggcaaaatggcccgtgtgtgccggaggggaaaacgtcacggcaaagcccgaaaaaaacgtaggaagaagaggtcgaagtcactggcccaggcaggagtggccttagccaagcccctgcccagaacccctgagcaagagagctgtaccatcccagtacaggaagatgagtctccactaggcaacctctatgccagaaatgtctcccagttcaccaagcctctggggggaccaggccttggccacctgtgctttaagaaacaagatgaaggcctgcgaccggtactgcctcgaccagaactccacaaactgatcagccccttgcaatgtctaaaccacgtgtggaaactccaccacccccaggccacaggcccccggccccacccgactcaccccttcccctacagcggaatgccccatcctttcccattctaccccctggagccctggaaaccctatatgctggactctgccgtcctggacaaactagccggtgtcagcggccagcggcctctgcctggcccaccgcatctaagccaactggcccatggagacagtcagaagccgctgcctggcccacacctggagtccagctgcccgtctcggggtgccctagaaaaggttcccgtggaggaatacctggtgcatgcgctccaaggaagtgtgagctcaggccaggcccacagcctggccagcctggctaagacatggtcctcgggaagcgccaagctgcagaggctcggccccgaaactgaggacaacgagggggtcctgcttactgagaaactcaagccagtggattatgagtatcgagaagaggtccactggatgacacaccagcctcgggtgggcagagctccttcggcgaggtccacagaatgaaggacaagcagacaggcttccagtgtgctgtcaaaaaggtacgactcgaggtgtttcgggtagaggaactagtggcctgtgctggtctgagctcgcccagaatcgtccctctctatggagctgtgagagaaggcccgtgggtgaacatcttcatggaactgctagaaggtggctcgctgggtcagctcataaagcaaatgggctgtctgccagaagaccgagccctttactacctgggccaggccctggaggggctggagtacctccacacacgcaggattctgcatggcgatgtcaaagctgacaacgtgctcctgtccagtgatggaagccgagcggccctctgcgactttggccacgccttgtgcctgcaacctgacggcctagggaaatccttgctcacaggggactacattcctggcacggagacccacatggcaccagaagtggtgatgggaaagccctgcgatgccaaggtggacatctggagcagctgctgcatgatgctccacatgctcaacggctgccacccctggactcagtacttccgaggcccgctttgtctcaagattgccagcgagcctccaccgatcagggagatcccaccttcctgcgcacccctcacagcccaggccatccaagaggggctgaggaaagagcccgtccaccgagcatctgccatggagcttcggaggaaagtgggcaaggcactacaggaagtgggaggtctgaaaagcccttggaaaggagaatataaagaaccaagacctccaccccaagaccaagccacctgccaccagaccctacctactccgccgagagagaacccaccagccaaggccaacacagacggggctcctgagcctcagcctcctctaccgccagaaccaccagaaccgagcaaagcgccagccctgaacctgagcaaggaggagtctggcacatgggaacccctgcctctgtcctccctggacccagccactgccaaaggccccagcttcccagaccggagggcaaccttgccagagctggagctacagcaactggagatagaactgtttctcaacagcctgtcccagccgttctctctggaggaacaggaacaaatcctctcctgcctcagcatcgacagcctctcgctgtcagatgacagtgaaaagaatccatcgaaggcctctcagagctcacgggacaccctgagttctggcgtgcactcttggaacagccaagctgaggcaagaacctgcagctgcagcacggcgctggcccgggggcggcctactgacatcccgagctacttcaacggggtcaaggtccagatccagtctctcaatggcgaacacctgcatatccgggaattccaccgcgtcaaggtgggagacattgccaccggcatcagcagccagatcccagccacagctttcagcctggtgaccaaagatggacagcctgtttgctatgacatggaggtgccagactcgggcatcgacctgcagtgcaccctggcccctgatggcagctttgcttggacctggagggtcaagcatggtcagctggagaaccgaccctag

SEQ ID NO: 885 - protein, 548 aa, Mus musculus
VSRRGPLDDTPASGGQSSFGEVHRMKDKQTGFQCAVKKVRLEVFRVEELVACAGLSSPRIVPLYGAVREGPWVNIFMELLEGGSLGQLIKQMGCLPEDRALYYLGQALEGLEYLHTRRILHGDVKADNVLLSSDGSRAALCDFGHALCLQPDGLGKSLLTGDYIPGTETHMAPEVVMGKPCDAKVDIWSSCCMMLHMLNGCHPWTQYFRGPLCLKIASEPPPIREIPPSCAPLTAQAIQEGLRKEPVHRASAMELRRKVGKALQEVGGLKSPWKGEYKEPRPPPQDQATCHQTLPTPPRENPPAKANTDGAPEPQPPLPPEPPEPSKAPALNLSKEESGTWEPLPLSSLDPATAKGPSFPDRRATLPELELQQLEIELFLNSLSQPFSLEEQEQILSCLSIDSLSLSDDSEKNPSKASQSSRDTLSSGVHSWNSQAEARTCSCSTALARGRPTDIPSYFNGVKVQIQSLNGEHLHIREFHRVKVGDIATGISSQIPATAFSLVTKDGQPVCYDMEVPDSGIDLQCTLAPDGSFAWTWRVKHGQLENRP

SEQ ID NO: 886 - DNA, 73967 bp, Homo sapiens
cagaggtgggagaagcatgctcttttggaatttgtacaaaccgcatgcatcaattattcaagaaatagacaaatctaaaaaagaattagagaataactagctcagcatgagatccaatgtttcttagagctgtgggccaccacacatcatctagtgcacccctcgggaaccacatgcctccctttggggaactgtgatttatagtaaagctctgtccagatggcacggattgcgtgaaagcattcttgtctctacagacagacatctgctctaatctctgcatcttaacacctgggttttccctctacctaatttgagcatcctttatctgaatcgggtgaaatatatcttggtcctgatcaagacttcttgtgattagcacaaggagtcacgtaatccttgactgacatttccggcatcctctctagcccatgaagtcactcatctccttccacagctttcccaggtgagattccctttctcagaaaacaggagtagctctctctactcatgtaggctacagaccttctttactgtttccatgtgttacacaatccctaatgagcataagcttattacatttttttttttgagatggagtctcactctgtcgcccaggctggagtgtagtagcgtgtgatctcggctcactgcaacctccatctcccgggttcaagcgattctcctgcctcagcctcccgagtagctaggattacaggcatgcgccaccatacccagctaatttttgtatttttagtagagacggtgtttcaacatgttggccaggatggtctcgatctcttgacctcgtgatccgcccgcctcggcctcccaaagtgctgggattacaggtgtgagccactgcacctggccagcttattacatttaaggcttttgccgcagtgtaatttcatcctggggctacttttcgctgttgggaattctcaagctggctaaattttacaactcttaactgtaccagtcagtattgcatgtcacagaaacccagctgcagtggcttcatcacatgccagaagctgaaggtcagcagtccccaggaggtgggcagtccctggctgcatgacggttccatgagtctattggggactcagagcctagctttctgctctgccatcgtagaattcttatgctcaaacactggctgctacacctccaagcactgggtgtgcattccaaactaaagaaaggggataaggccaagggcaacagacaaaagggcttgtgccagctaggtctgtcccccagctttcccagaagctccatccagagacttccatgtacatctcactggccagaattacatcaaataaccaccctagctgtaagagagtcggggaagcatttcacactgggcaggtcaccactatgaataaaatccgggttccgatcaaaaaaggagagattggatatccccctctgagcaaaagatattatgttattttattgttttattttattttttttgagatggagtctttctctgtcgcccgggctggagtgcaatggcacgatcttggctcactgcaacctccgcctcccgggttcaagcgattctcctgcctcagcctcccaagcagctgggattacaggtgcatgccaccacgcccagctaattttgtatttttagtagagacggggtttcaccatgttggccaggctggtctccaactctggacctcaagtgatccacctgcctcggccgcccaaagtgctgggattacaggcataagccactgcacccagctaagatattattttaaaccaattctattagctgttagtatgcatggctaatccaccctaggagaatgcatacttctggagggcagtaatgccttttttcatgtttatatctttcacgcttctactgaagggttgaaactgaacatgagacatatttggaggcaacagtgggggagtaaggttagatactaagatggaacaggcttctgaagtggtcaacaaggagccacagaaggttctatttgtattttttattttttgagacagagtcttgctctgtcacccaggctggagtgcagtggcacgatcttggctcactgcaacctctgcctcccaggttcaagcaattctcccgcctcagcctcccaggtagctaggattacaggcgcccaccaccacgcctggctaatttttgtatttttagcagagatggggtttcaccatgttggccagactggtctcgaactcctgacctcaagtgatctgcccgcctcagcctcccaaagtgctgggattacaggggtgaaccactgtgcccagcccacaggaggttcttgatctgaagaatggttttggagccacttcaggtcaacatacatttaccaaataccaactcaccatttggtgattacaagctgccatcaaggtgcatactgtctgttaagagagataaagtaggcagatacatagctgggctaagtggtgcttggagaggaggcgtttcatcaggaacttgatggatgggtatgatttgacaggcagaggcagaggggtgcatttcagtccacagggcagccttgggtcaggatgtacagacaggtggtttgggtcaatggtaagtagtacagagggtgcccacagggaagctgtgaaaagtaagaccaaaagaggtgagttggggctagactgtgaggcccttgtgagccagataacaagcttgtacttcatcagtaggcaatggggagccattgaaagttttgggcaagggagtgacagacagtgtaggagggattggaatataaatgacaggaagcaagaggaaaggctgacatactacaagggcatcatcagaaaggggagacaaagggaagccacagacagaggtataatggagagagcatcaacatggcttggcatgagacagcaagaagaggcgggtgatggagactcccggggttggcggtgaggtcattaacagagaggggtggccaaggaacaggtttggggaacagtgcaaagctggagatgccagatggctagaaggtggaaatactctatgggcccctggaaactctggtttggagcccaggatcacggtcagaactgaaggtgttaatctggcagtcaacagcaaagagaggacaattgagagagccagggcagcccagatacactatgtccaaagctggcgctcctcttcttcttccagaatcctctcttctcctgcggctcccaacctctgcagcctcaacctccacctcccaggtcaagcgattctcctgcctcagcctcctgagtagctgggattacacacgtcagccaccacgcctggctaatttttgtatttttagtagagacggggtttctccatgttggccaggctgatcccaaactcctgacctcaagtgatctgcccgccttggcctcccaaagtgttgggattacaggcatgagccactgcacctggcctccctctccaattcttaacaattgagaccctccaagtttcaggcctaagcccctcatttctctacactctctcccttggagtcctcatccactactggctgtattgaatcattcaacaaacagtagttgagcacctatttggtgccaggcacttgactaggccctggtgccggagagagatgaatgagtcatgaggcctggcctcaacaggggagatggacatggtaacgatagatgtggagggtagaaggaatccctgcgctggtcccgggctgtgtgctcccccatccagccctcacctgctctgctctgcattgcaagtgactgacccctctaggctcccaggccagtaagaggctctggcaggaaacccaaaggtagaagggaaggagaatgcagggatttctccccatccctctcagtcttagtggtatctgtggaagtggttgtgtcttctctatggtttcaacttcttccaagtgaccccagtcccagcctttgattacactgccccagtccagtccctccaacccaggggtcgcagctggattcctggttacttcccccattgtctgaagaacttctccatcctttcatcccctatgtaaccaatttcctgcattcaattctatgtttattctgtttaaaaactcagaggccaggcgaggtggctcacacctataatcccagcacttcgggaggccgaggcgggtggatcacctgaggtcaagagttcaagaccagcctggccaacatggtgaaaccccgtctctactaaaaatacaaaagaattagccgagtgtggtggcaggcgcctgtaatcccagctactcaggaggctgagacaggagaattgcttgaacccgggaggtggaggttgcagtgagtcaagatcatgccactgcactccagcgtgggtgacagagtgagacttcatctcaaaaataaataaataaataaaataaaaataaaaattcagaatgaggctgggcttagaggctcatgcctgtaatcccagtgctttgggaggccaaggcgggagaatcgtttgaggccaggagatcaagatcagcctgggcaacacagggagacccctacctctatcaaaattaaaaaaaaaaaaaccctcaaaatgggtcctgttttcctggctggatcctacctgacatgatacagtctccccatcttcttgccacacttgcagtggcttaagtcctcatctgttgctacctgttcaaggaagctccctaagggcagggactggtctggaggttccatgcttcctacccagagcctgacacagaggagctcagtgcatcacatttgtggctggctgcagataagaaactgagacaaggtcatctactaggaggcagttcatggagagaagggctggtgagcagaaaccaggctgtaaggagcccacttgggtgggagatgaagcagactttcaagaagtttgggagtgaagggggaaagaaggctgggctaacagtgcaggggaaagccagaactagcaaggttttgtttgtttgttgtttttagggtgtcctcggcttgacctcatttgtaggttgaaaggaagaagcgaaaggagggagatatcgaagggcaggagatgctgggacattgggagtggaatgacaggacctatgcgatctcttaggaagattcaattcaccagaaggcttgaggatagtgtggagaggagactagaggtaagcaggtgagtctggaggggaaaatctccaaatcaggaaatgagaagaatttgtgtcaagccagggcaccctaagaaggctccaaagttgggagaggaggctagatctctggaaggtgtgcccaggacctgttcttgtaaggtcatctttgcccagtaccctccagagtcccctaccagccctcacctccattctttgctgaaattggcactcctctccccctcacccacatcgccatggcccctcctcttctacagcagctctgtggtttgtggtgccccctgccatctccctatgtggggttggtttggtgggcagcaggcacaggccagaaccagcacacagtggtgtgccagcaggtgtttaacaaccaactcaggatgggtagccctgatttatactgtttgccaacttccatggtataaatactcccaacatgtccaatttcaagctaccaatatgagatcactgatcacaaaatagctagagagaatggatcacactttgcctgcatccatttatccatttcccctcctgcctccctggcctctccatagacctcagctaacagcagcagtagggcaggtccaagctggggagggcagcaacagcactgtggctgcaacttcaggcagtcccgacagggaaaggaaaactgctctcctccaggaacatccaccctacagtccccagtcatctcttatctcagcctcacatctgaattctcaagtgtaacttcagaatctcacagtaatttggggcctgaaatccacattcagatgactcatcagccactttctcactggacatggctcagcaccataaaccatgctgactaaggcaataaaaaccagaatataatttcctttcttccaaggcaaacagaaaaggaaaaatgatccaaggatagcattccttcactgatttactcactcttcagcactgtcctagagaactgatgggcaattggctccctgaaccctgaagtctctctgcagagtccggcatgcaggagggcaggggctctgaagtcagacatggtttgaatcctgggtctcctgttacagcaaagtgacactgggaaagttacttctgtctgagcttcagtttgctcatcagtgaaatggggacagtaatactacctattcaatggggtcagactgtaggggttttcaaccgggggcaattttgcttccttggtgacatctagcaatgtccagagacatttattgtcacattgggtggatgagggagtgctataggtatgtagtagacagaggccaggaaagcttttaaacatcctgcaatgcacaagacagccctgatgtggtttggctgtggccccacccaaatctcacattgaggccaggcgcagtggctcatgcctataattccagcactttgggaggttgaggtgggtggatcacttgagttcaagacctgcctggctgacgtagcaaaaccccatctctactaaaaatataaaaattagccgggcatggtggtgcacacctatagtcccagctactcaggaggctgaggcacgagaatcacttgaacccaagaggaggaggatgcagtgagctgaggtcgcgccactgcactccagcctgggtgacacagggagactccatctcaaaaaaaaaaaaaaaaaaaaaaaatctcatcttgtagctcccacaattccgtgttgtgcaagggacccagtgggagataattgaatcactggagcagtttctcccatactgttctcatggtagtgcgtaagtctcatgaaatctgatgtttttgtaagggtttccccttcacttggctctcatcattctctcttgtctgctgtcatgtaagacatgccttttgccttctgccatgattgtgaggcctccccagccacatggaactgtgactccattacacctctttcctttataaattaccccatctcagctatgtctttatcagcagcgtgaaaacaggcgaatacaagccccgtcccccaacaatgaattatccaaccccaaatgtctatagtgccaggctgagaaaccctggcctagagggaacattcagtgaggttatgcacatgaagtactctaagtctatctggcttactttttgtaaagtatcagaaaacaagctgcgattctttcggaatagcacagtcttaacgctatttccagacctgaaatggatggggtgtgagaacccttgagtactgagaacctagttcactgctccaggtgtgagtcatcctgtaaatgtcaatttcttgtatttaaagcagagctgaggctgcacaagtgactcaaggccagaagctttcccaggttgtcttgacttaagcttggaggaagtaatctcgtcccgaagctctccttccagagggtgcaagcatttcaagactcagagacaccacactgctcactctgggtaggtgtattgtttctcacctcacccacacacagtggggcttggaaagacctcagaaaagtagctgaaacggagaggccttgcttatcccgaatatcttccttaccagtgtttagtggtttgctcctcccctgcaacctgatgtgacattccttctccagagttacagttttgagtcaacacagttcactgtctctgattaatacacattaatgttcagggacggacttaaagacagatcatcttgatggggtaggtgggagtgtacaggggacccaggaccagaggtgtcaagggaacctgggcaaagtacagagacactgggtgttttaaagaaggaatagtgaaagagagagaaggcaaaggcaagccagggagtgtctgcagactctggaggtgtgcccacatctttcctgagaagtggtgtgcccagaggcaaacaggtggtgggagaggcaataagggcatccaagattgccgataccaacctgtacatctggccaagctctgcctttccctgagtcactgaaatgcaaaaccctaggggtggaaagagatttgggggccaccagtccagcttctttcttgtctgccatctcccagctagtcagtggcagagccagggtgggcgccagagactgtttggctctaaagcacggactctacgggagccacaacctcaaatgctccaggggccagacaggtgacataaggttagatggttgggtggcgggaactgtaaggaaccgcaggctctgctctaaggcattcaaattcaaatttaaaaaaatattgggccagccaaacaaagcatatttctggcctgggtgagtgaatgaggccctcaggttgtgagtttttgaccactgcctaaataaatggtcttccctattccccagcagagatgactgtttggcacagatatccagaaagaagagttcagcttcggactgtctgcaaagtagtctcaagcagatggtggtctttgctcaaacacttccagagatggggtgttccttacttttcaagacagccttgggtggggcctgcctatccccggactagagccactcaccacacctaccatggacccttcatggaagtgggatgcccagggtaggagtacatcttttattttgcaataaaaaaaaaagtttggattttttttttaaaggactgcctcactctgttacccaggctggagtgcagtggcacgatcatggctcactgtaacctcagactctcagcctcccctctagctgggactgcaagtgcaaactaccacgcctggctattcttttatttttttgcaaggacgaggtccttgctatattgcccaggatgttctccaactcctggcctcaagcgatcctcctgcctttgcctcccaaaagcgctgggattacaggagtgagccaccgtgcctggcctggaatttattacaaataaaatacaagctcagtgtggaaacactagataatacagaggggcaaaagttagaaaaagtttctataccttccctactccccacccccgacccccattcagaaagaagcactgttgacacttcaatgcatattctgaactccaggtcctttctttgcatacatcaagctctcatcctcttgccggctctgtggtctgcaaacccagagagcagatgctttgctcagcgctcgtaccacgccacgcacccacatgctctctttgtacctgggtttcaacccacaggtcgggcccctgtaagcccttggctccccaagcttctcgagggcaggcactgtaaccttctttactcattccagggattctacaggaccaggcacacggtaagagctcaataaaaacgtctctacccccaccacctcccgcctcagccgccaccgcttggcagcagagaggaagcggaacgcgcgcgacccacgagggagagcgcctcgctgtctccaaggtaaccgaagtcagtggcagggagtgcccacgcatgcgcacactcgcccttccttcccgtaacctcgagaacgcagctggtaagactgccagaagccgagggcgcatgtgtggttccaccaacaccctagtcgcctccgccttctgtcagtccgcccgcccagcgatctcccttctacaaacatcgtccggaaatagtgcccatttctggaaaccaggcctcgttaaccaatcgttgctagggagcgggaagacgggcttgccgggacgaccgtctcattggttggcgtaggggagtgggcggggccacgggtcgcggtgcggccaaagaaaggaggcgcgaagcgaggcaaagttacagcctccgggggaggcgtggccccgggggcggccgagaaggcgagggggcggagcccgggaccggggcggggcgaccacgggccgggagctcagcggtcggcggccggcggcgggagatcgcgggcgagcggagcgcaacactcgcttggttggggagatcggcgcttggccggtaggtgacggggcgggaccctggggcccggtgcgaggcgaccagggagcggctgggatggatcgcctctcagccccgggctgggctgcggcctggcccctcgccccggagcagtggggtcggcggccaggccagcgcagtccgacgtaccccgtccaacccactcgcagcggtccgcgggcgcgccctcgcacgcgctgccggtgccgcgctcgccccgggcctccaggccgcgcactcctgctggccacacgctggctccgagcgcgcgcaggggccgcctgcttccccttcactagtgccccgcgccgccgccaggcccgcccgcctgctctgcgccccagtgcccccaggatggagctcgcctgccgcggggcggacgtgtctcctgcaggagtgcgccctggcatctgccctggcgtgaaaccctcccggcctttcatgggaagttctcaggtcacacctcaaggcggggagcaggagctaagcctgtcctcagcatgcagcggggcagtgctggccgcccgcagcatcctccctccgccctcggaccccagtcctcctctgtaattcttctgggctctccaactcgggactttatctgtcggttcaaatataacattcccatcttggaaacccatcgtggccctggcatcttgcagccactgggcaccaggcagagaggggccacttgtacgtacgtttcccacctgcccgggagcctccttagtgctgggtagcttcagaaaaagtgtttccttcctagtcgaggttaaaaagttgctctcggccctaaagggtggactggaggtatgaatgagggagaggataagtggtgaaaaggtacatacatcagcaaagtaaatggtaaaactacttttgatcgctggagacaatgaacaccaatgacttaattaaggactttaaaagcacatgaaattaaatgattagagtgaggtcatgatataaaataggagtctggagtttattccaagaaaaatgttggaaaccccttgactagaaacatggtctttctgaaagattagaaggagacagtatcttaacattagtgatgtgttttttgcttagtgtcttcatacctgtgagctccgttttccttcagatggctgtgtggtaagacagattgtagtgtcttgttttatgggcgaggcacctgaggcaggtgtgtatgagggagtgggggtggtatatatcttgcctgatgcctcatagctgggactaaggatgggtctttcccagaatcctagatcaggaccacattatagaactgagatgcagaaaggagggagaagtttttggtgtggtttttatgctcttaatgtgagaggacacttaaaaagtgcttgccttactttggttgtgtttggatttactcttggtgttttttaagtgatatcaatcagtttctttggagcgatgccagacctctgaatttttcagacacctttcggacatccttatttattttgaagggtgtggagaacttctcagaagatctcaaaataaaagtaatcgtctctgactctaattttagagataagtacccaggtatgtgtaccagctctttgtgaaatcagacagcaagacgctgccaagcttcaggccatcttctgagtgttttctgattataagaagcagttctgaagggggttttttgtcattggtattgtctgttaagagtttgtgggagcggcaccacagagaccctgccaaatcagtctccctctattaaacaaaaatgtctggttgggctgtttcgcctcaacagatgaaggtttggttcctcattttggttctcctgttgaacactgactcctttgtgatctgcctggaatatgtgtatatcatttactgctgagaagatggcttgcgctgattggttgtccagccctcggcaactgttgtgattttttttttttttttggtgattgataacagttcatccctggctagggtctggtgagagatctgcggagatgtgaaagagatgaaagctttatccagggttgttttcttcgttgttggcaccctctgaacagtgttgtatcactttggcctgtgaaggcacttttaacttcctattttttttcctgtctcaatggacagcacatgggctttcctaacaagcctgcctgcctcgatgaagagctgacagattcatattggttggtttgacagatgttctttctggggggaaagttcagaaatcttaaaagcaaagtcagtcctaagtaaaaagtctaagtcagcccaatacgcataaaggcagcgtacttctactaatggcttccatcatctcaaggttgtttttttttttttcctggcaaaaggttaaaatgcaactaaaattctgctttcgtgattaataagtcactaccacagttgtgtctgatgcttcctgtttgccccattttagtatttcagttaaactggaaacatctgagcattatgggcactattgatggcaccagtgtgaaattggtgggccggggacaattccatgtcagtggatttagggagctctaaggatgtcagcccctctggtctccacacaccaggattccctagtaagggaacagaatggggctgagcatctgcaagagctgggtgggcattcaaagtgatgcatgtgtgaaggttttgcatttactcggtgatgctggctaaaatgctgaaagtagtagcccaaaaagggaaggccagacgtagggcaaattgtaggggagcatttctgttgagctgagcaggacattgaagtatgagatttttttgttctgggcttatgactgcctgaatgacaatgcagaaaaagtcatttttcttcagtggccggtgtgctctttgtattctagtttaaaggagcctcttcccttcttgcttttctacatgtcttaatccctcagctccctgatagaaatcccttgaaattatgtggcatcaagaataattttatggccagtctttgtattttcacaccatactcatgtgaagaagggcagggacaaagatcagaaaagtgaagcctcataaggagaaacagacaggattgctcagaatctaaacccccttttcttgatatctaggtcactgctttttctactaccttgctcatgaaacgataaggattttcttcccccaaacatgtcaattttgaacataacgaaaccagggtagcagctttatttatttattgtaccaatcaattattaattgatattgatttttaattaataaaaggccaaaagatgaatagcctgctgcctggacaggtgtgcttgtgcccattttccagatgtagaaacaaaggcagagagcccgtgatttgtccagagcaacagaacaagtccttggtgtctccgtgtcacatgtggtggctgaggctgtcaggtcagagagacctgggtcaggtcgaggtctgccacggcctgcctgtgtgcccgcaagcaaatcacttcacttctctaatcatcaggtgcctcatctgtgaatgggatcagaaatacttcatggggctgttttgagtagaaaatgagaggagatatgtaaagtgctgagcccagtgcccagcacagaacatagaggctgtaactgttgttgttgttgttgttgttcttgttggtggtgtttggtggtggtagtaatagtagtagtagtagtagtagtaatagtagcagtagtagttgccaattactgcattgtgactaaacctgttttctgtaagatgatgtcaagaagggtcagactgcctgacaggccagagtcattttctcagtaggacctttagggggacagtccttcagtctaaaagcttcagctctcgggttctccctgtcttacactatatactgccctcaccatactccaaatgaggctacaaaggtccaggctctgcccagttgacaatcctaactctgagctggagacacagctaggcctgtctaggggcttcctgtgtcccacacgtgatcaagtaggttcctgcattaatcctggaggtgaggaaagggaaaatactgtatggcatgtagatcagcaaggacttgttctttgggggaacaggagggaacatttggttctgtgggatgaggttcccactaccacatggcatccccagctcaccaccctttccccctcgtaaagatgtctttgtcagcttctctctgagactctgtctgggggcccacgatctgcagtcaaggacttgcagattcccctttaaatctcacaagaagcctggaatggtgacgtgtgtttctttagtcccagctacttgagaggctgaggcgggaggatcacttgagcccaggaggtcaagtagctatgggcaacatagcgagaccccatctcttgaaagaaaaacgtttgttttaatctcacaagggaaaaaaaaagtttcatgttatattttaaagtcttttttcaccttaatacaaaacaaaaatataggctctcaccaggctactgttccctttaaataacattttgttttctcttggggaagctgacttgatggccgaagagtcatttctaaagtgaagctagtttttagaaaaaatagatcaccggatgtcaagcctcatgtggagctcggttcagatgaaaatgaaaccagcaggcctggcgtggcagctctgcacttgacttcaggctggaggtgagaggcagagtgtgcctggaccttgctccataactggttggccccacagagtgcatttgataggtgccttagtcattttccaagcagctttgcttaggtgagcagagcactttctctggaaggtgagtcacccatgcaggggtgtaggtgacaggcgatttattccccagcacagttgcagagaaagtcctgagcagaccttcgtgaggagccctctgccacaaatcagcctcatcccagccccagggctatggaggcagggggcaggaggtaaacaggaggcttctggggccagtgggctgacagcggaggggggatcgtggacggggcacagagcccagatcagcagtgtcactgactcctaagtccagccaccctgagggtggaaaatggcctgcttccagtgacagtcagcaaagaagcaggaggggagctttggccctggggagctgggaaatcccttggcagagagcagagagacaagccctattttggtgtgaaaaaccttttaggaacgcttttccacctgcctccttttcagccacctgagttggagtctctgcagagctccagcgattgtaaaggctagattaaaccctggatttcagaaagctttaggaatcccaagcctgccaccatctcagttgtctacacttctaggaccaggatttgtaccaagaaagaagcagcagggggtactcctgagccatccctccctcccaggttctggttactacagcttctcctgacgctctttctgctaaagccactatcaggtgtccattaacgcagagattttcttcagacactgttctggactagtgcagttggtgttgaacttgaccgattatggtcagggacatctataagcaatgtccaggaccaactacaaggagggcttgactttaatgaagctgcagctcttgcaaataatctcgttccctgtctctggcagactaccaacccagcccctgtacccataccccatcagtctggaccaaccagtagtcacctcctgctggcatggctaaataaccttaacctcactgtccagaaagagctgttaggattatagcctggacatgatcattcacattttttgcagtgagaaaatgcagaagagaaaatggtggcccaagaaagccaagtgggttgcccaaggccacacagctagttaatggcagagcctgaactataaaacccagactcttcactgtactctgctgccagggaacgaaggaactaatcctgaagcaggatttttttttttaaactagcttctccttttattcccctaccacaaccctatcactctcagcctttctgcaagctctgccaggcctgggaagggtggagccacagcagctgctgccctgggtctaagaaaaagtaaacagaaagctatttgttggacgctgtcttataccatgaggttcatgtaatcaaaaggaggtcaaggttgataagaaaatacaattaccaggaagtctcaaaggttgcccacacctttagggcactttcctacctagccaagcagtatctcacctagagtgggtatttagtaactttcaatgattgattacaggggtccaaacccacagtgcacgaagctcttctgcatctttcttctgtgcaggaggtgcatgcatactctgggtgttatcctagctgatctgcctggctcctctcagtgagaggctcttccttgtgggtgaagcatgatgtcatgatgtcatatctggatggtggcccctgtaagtgcaaagaattattgtagccaaaatctaccacccaccttctactgacattaaagtttccttttactgggccagaattaaaaggtaggtgtttctggtccatactagggatagccaggagggttgggaggaaaaggaggcttagccagcctccaatgaggatgtggttgccagttaagattataaatggaggctgggcacggtggctcgtgcctgtaatcccagtgctttgggaggctgaggcgggcggatcacaaggtcaagagattgagaccatcctggccaacatggtgaaaccccatctctactaaaaatacaaaaaagttagctgggcatggtggcacatgcctgtaatcccagctactcgggaggctggggtaggagaatcacttgaacctgggaggtggaggttgcagtgagccaagatccaccattgcactccagcctgggcgacaagagcgaaactccgtctcaaaaaaaaaaaaaaaaaaaaaaaagatggactcctttggccaagggagttgattggacccaccagactccttgagtcctgcccaacagtctccactggcagatgctgtgcctggagaggcaggaatagctttgtatagatcaatgtgaaggacagagtcctgcaccacctccctctagcatgtattagatacttgcaaatatatgcaaatccgagcccagatgggtgttgtccagttcagaagggttatcttctcaagcaattagaagtaattgggtctctaggtcagcatttaggaaaggggatggcaggagaggctccacagccatctttcaggacacctgcttgctggggtgcagttagaatacagccaccaagttgtgactccctcccttccagcctgccaggtgattggacagtgtggacacgtgtccctgtccagccaggctctcagagcctgtggcactcatttattcctcagaagtgtgtctgtcctttcactcaggaacatttgccaagtgtgtcaaatgggccatgtctgctaggtgctagaaaaccaaacacaattgaggcaccgccctggaggacctcaccaagacaggggtaagctgggcacgaaggcagacatctcacaggtcaaccccggtgctggtcaggagccatgactataggagctggagggagcgaggaggccaccatgcgcagcccagtggccctccttttccagcctgagccagcactgtcaggcgtagagcgtctcggattctgcaggtgcctgggtgggaacaccttggtatttctctcaccctggggtcttgtaccacttgtcagcttggagcgggagcttggtaacagttgggcaacttcagcactctgggggaaagaagtgcattttcagaagcgtagggacagtcaggagaaatttgctcaaatgttgcttgggcacagtggctcatgcctgtaatcccaatgacttgggaggctaaggcaggaggattgccttttaggccaagaactggagaccagcctggacaacatagtgagatccacctccaaaaaaaaatttttttaaactagctggacattgccaggcgcagtggctcacacctgtaatcccagcacttcgggaggccaagacaggcagaccacttgaggccaggaggtcaagaccagcctggccaacatggtgagacccgtctctactaaaaatacaaaaattagccaggtgtgttggtgggcacttgtaatcccagctactcgggaggctgaggcacaagaatcacttgaacctgggaggcagaggttgcaatgagccatgatcgcaccactgcaccccagcctgggcgacagagcaagactctgtcaaaaaaaaaaaaaaaagattagctgggcatggtggtgcttacctgtagtccagctacttcagaggctgaggtgggatgatcacttgagctcaggagttcgaggctgtagtaagctatggttgtaccactgcattccagcctgggtgacagaacaagtcctcttctcaaaaaagaaaatatagttcaaagtagaatcagacagtgagtagccagctaataaacacataactgaccacctcccacccctccaagtgagaattgggagggcagtgaccacactggcacatcccataggcttggtgccactagagagttgtaggcaggtagatcaaggcagtgcttctaggtaactgggttcagcattccaagaaggcctttcaagggtttcaacagagaaggctcttggtcatcctcatattcctgctggccagcacggtgcctgaaacatggtagccactgattaaatatttgctgttgagtgaaagtacaagacttgaatccaaactcctcccgctaagccctgctggcctcggggaggacgagagagccgtgggctgtttcatgatttaccctcttttaccaaagaatcgtgtgagatcctctgagaatattcctcatcatgccccatgtcccaagcccttttttaccttcccaagggaggacaagaatatgacccctcattataaagggacccctctgccacttatgtcctcaagctggttacttggtccagcttgtcaaagagcatgtggggcagcatctgaaatgaggccagggtcaaggttgccccgccacagggcggagctggacctgtgcctccttccatgcattggaagccttctgtggaagctgagttctttgggtttcttgtttattctgaagttcctcaaactagttcctcaatttcagaaccagtcaccagtgactacaatgaacttgaattctcctatacagggagcctgagcctgtctttcttcatcttttctgaacacaggtagacgctgcttgaagccactcccacctctgaaaaccagatttctaaacccagaaaggagcggtgggtggttgtatttcagcgagattgaccgtagcctagggaacttcttgctcagaatccaccccaaaaggttaaataaggagagttgtttttcacaaccaaaatgctgcttgtaacgatgatctcaaagcttggcaagatcacaaagtacgttttgagtcatcaaagaaactggctgtgtttcacatgattttagtgtcaagggcaattatggccatctaatctttggaaattggtcatgttaagtggcatacagggcagcccccacttaatcagaatattcagttacacaaaataccctaagttgctgatttcgatgacacttgaaatttttttaattaattaattaattaatttttttttttaattttttgagacagagtctcactctgttgcctaggttggagtgcagtggcacaatctcggctcactgcaacctccacctcccgggttcaagcgattcttgtgcctcagcctcccgagtagctgggattacaggcacccaccaccacacccagctaatttttgtatttctagtggaggcagcgttttgccatgttggccaggctggtctcgatctcacaacctcaggcagtccgcccgcctgggcctcccaatgtgctaggattacaggtgtgagccaccactcccggcctgaaaaattttttatacaatatacattaaacattccttgttgcttattgtataaaattaagtacacgtgtgacaggtttttatctcaatactaccttgcccgacatgttctcctgcatattgggtctttgtggatccatgatgccccctgtggcgtcttttctatttgctgttggctctccttgtgcaaaggatttgaaggttgaattgaaaataccattgtaatacttctcttttaaagcttataaaatgccctgtatcagggcctgggggcaaaagtactgatgaaatttatgaagatagcaaatgatgctcgagtctttgttataaaaagaatggtaaataggttcaagaagcctgcagccaggctttgtaaagtgaatggcaaatttgcatttgtcatagaatttctccttggaatgggcctggctatgtcaggcctgggtgggctgaggaacacaggcccaccacaagtccagcttggagtctttcttccctgttgtcattttaaagttgctttttccagaacataggctggctgtagttcatgcttcctaattaaggtgcttcctcccaggccagtccctgaatttctcactaacctttgacttgtgacagcttctgcatctcggtcccaatttttaaagcttagatcatttgggagtaggaagagtgtcatggttaagagtatgggctttgacataaaagtctcttgtgcaaatcctgccgctgccacttcactgctgtgtggccttgggcaaattacttggcctactgaggcccagtttcttcctccttgtaaacggataacattagtgccttgctcacagagttgtgaggattcaagaaaaaaatgcacgcattacctaatacatggcagataataatagctgtcattattattcatttgtatgattaccaacaaccagcatgtagttatgtgtatacaaatagcagattgttgtaacactcaaagatgaccacaggacaactaatttcagctttagctgccaaggaattgtgggtcccagttcatcacgcagagctgaggcactgccagtggacacagaagccagatggggtgtgcagaatgctcttcaaagaacatcttcatgggttcttgccgaccactctgtccctctgctttcaggattgtcctcctcctgctttgaccacatctgttccagactttctgtctgatgctagggctgctggctagaagctgtgggaggtaggcttcagtgccttatagcagcaactttgaagcaacttaacacttatagaccatgactcacatctgtaatcctagcactttgggaggctgaggtgggcagatcacttgaggccaggagtttgagatcagcctggccaagatggcacaatcccatttctacaaaaaaataaataaatgaaattagccatgcgtggtggtacatgcctgtaatcccagccacttgggtggctgaggcataagaatcgcttgaattcgggaggtggaggttgcagtgagccaagatcacaccactgcactccagcctgggtgacagcaagactctgtctcacaaaaaaaaaaaaaaaaacggccgggcgctgtggctcacgcctgtaatcccagcactttgggaggccgaggcaggtggatcacgaggtcaggagatcgagaccatcctggctaacatggtgaaatcctgtctctactaaaaatacaaaaaattagctgagcgtggtggcgggtgcctgtagtcccgctactcaggaggctgaggctggagaatggtgtaaacccggcaggcagagcttgcagtgagccgagattgcgtcactgcactccagcctgggcgacagagcaagactccgtctcaaaaaataaaaaaaataaaaaaacataaaaccaaaaaaaatcttacacttccagtcatacaaaggtctgactgctcatcttgtagcggcttccatctcactggaggttccactgatgtttccagagtgcccactgcatgccaggcactgtgctatgtaatttaaactttgttccttgcattgagtcaccgtgtaaaattctatcatgtaggtttgaggatccctatattacagataagactcctgagtctcagattatgtgacctgcccatggtcacacaccagagtattgagaaactaagattcaaactcagatcttctgactccaaggccatcctgtcatgtagctgaatggccattcctcaggattagtaagtaatatgttggaagaaattacctctgagggtctttctgatcctaagagcactttgattattcctttatgatttatttatccatctacccattttttccccatctagactataggcatgttgaaagcaaggatagcatcttcacagcaaataaataatacaatgtttggaaaccacctatctgatgctatctacttctctgacacatagaaacaggagaaaagatataacccattaacaaaagagtcacccagaaattccaatcccaagagcttaccacctagaattccttctacatgtacacataaatgtgaataagggtagagttttttccattattacgtataagtgaaaaattggaaacaaagtttccaggtgggaaaatgatgatacatctgtaccttccaatcttatgaagccttaaaaagaatgaattagaggtcaaccatggtggctcacacctgtaatcccagtactttgggaggccaaggcgggtggattgtttgaggtcaggagttcaagaccagcctgaccaacatggtgaaaccccgtctctactaaaaatacaaaaattagccggatgtggtggctgacgcctgtaactcggaaggttgaggcaggaggatcacttgaactcgggagacggaggttgcagtgagccaagaatgggctgctgcgctccagcctgggcgacagagcgagactccgtctcaaaaaaaaaaaaaaaaaaaagaaaagaaaagaaataaatctaaatgtgctgagatggaatagtattcatagtatcttaagtgaaagatacaatttgtatgacattacatgtgtataatccatgtttcttttaaaaatagtcccaaactaggccaggcacggtggctcacgcctgtaatcccagcactttgggaggccgaggcggctggatcacgaggtcaggagatcaagaccatcctagctaacacggtgaaaccccgtctctactaaaaatacaaaaaaaaaaaaaagtcccaaactatatgtttatatatgtatagtaattggaactagaaggatttacatgaaacttaagtgttttttatgttgcagagaggacgggacggtgccgggattttttttctatatacaattttgttttgtttacatttttacaatgaacaattattttggtattggaaaaaaatttttgagatggagtctcactctgttgcccaagctggggtgcagtggtgcaatctcggctcattacaacctctacctcctgggctcaagtgattctcctgcgttagcctccaaagtagctgggattacaggtgcccaccaccacacccagctaatttttgtatttttagtagagacgagatttccccatgttggccaggctggtcttgaactcctgacctcaagtgatccacccacctcggcctcccaaggtgatgggattacagtcatgagccactgcacctggcctgaaaaaaaatttttaagcaaggttaaagatcacatataagaaaggcaggagaggctagctaggaaaactgtcctcccttgggtttcccagactaggactaaccctgcgattcccacccctttgcgcaagcagtggaggaagggctggtttttttctccctggtccacttctgctgtttttcactctggggggccactcttgcccaggggcatgtggtccatccagcactagcacgggcctgtaaccacgcatgcatttgccattcgataaatcaaagcaggaaacagtccgcatcttctgagcaccttcctatttcttgagtcacaactgataaaactctcagtcctcagcagagaacaagggagggaatgaaatgaaaaccaaaaccaggaaggacaagcttgcccatctccagccttctgttttagcggcccagctgccagaactcagtgagcagaacagaagagccacagactttctggtgaagtttcctgcccacacatgggtttgtgcttgcatgtgtgtgcatgtgcgcgcacacggttggagaaaccagctcatcacatatttataaagccccaatctcaagtgtggacctaatgcttcctaaattctcatcccatgccaagagattcttttttagttgttttcatgattaaaaagtaatacttggccgggcacagtggctcatgcctgtaatcgcagcactttgggaggccaaggcaggcagatcacttgaggtcaggagtttgagaccagcctggccaacatggtgaaacccggtctctactaaaaatagaaaaattagccgggtgtggtggcaggcgcctgtaatcccagctgctcaggaggctgaggcaggagaatttcttgaacccaagaggcggaagttgcagtaagccaagatcgcaccgttgcactccagcctgggcaatagagtgagactccatctcataaaaataataacaataataaaaatgaataaaagtaatacctacagagaaaatcagtagagggagatacaagaaactgttaacggggatccccttataggaatggagggaaggactcatgcttttcaatggcaccccttctgtatttttttttttaaccacttagaaacattatctgttaaaaatgagaaccaaggtcgggcgcagtggctcatgcctgtaatcccagcactctgggaggctgaagcaggtgaatctcatgagctcaagagttcaagaccagcctgggcaccatggcaaaaccctgtctctaccaaaaatacaaaaaattagccaagcgtggtggcacgcacctgtcccagctacttgggagactgaaatgggaggatcacttaagcctgggaggcagaggttacagtgagctgagatcgtgtcactgcagtccagccaaggtgacagagtgagactgcatctcaaaaaaaaaaaaaaaagagaactgagaaaactaatatgtgctcactgaaaaagtggaaaaattagaaaggtataaaaagaaatattaaatcatccataagcccaccaccaaaagagaaccattgctatatgtcctaggtatctgcatttttataaatatcattgtaatataccgacacatgtatatagggtcgtattttagatatgcttctgtatcctctttctactaatttaatatcccatttttccatattgttaaaatgatttataaacatttttaatggatgttccatgatttatttaataattatccttcccctgtaattagacttttttgttccagtttttttactgttatagaaatactgtgaactttttttttttcttgagatggagtttcgctcttgttgcccaggctggaatgcaatggcatgatcttagctcactgcaacctccgcctcccaggttcaagcgattctcctgcctcagtctcctgagtagctgggattacaggcatgtgccaccatgcctggctaattttgtatttttagtagagacggggtttctctgtgttggtcaggctggtctcaaactcctgacctcaggtgatctgcctgcctcggcctcccaaagtgttgggattacaggcgtgagccatggcacccggctttttttttttttttgaaacaggatctcattctgttgtccaggctggagtgcagtggcgtaatcatggctcactgcaaccttgcactcctagactaaagcaatccttccacctcagcctcctgagtagctagaactacagacacgtgtgactatgctcagctaagttttgtatttttttgtaaagatggggtctcactatattgcccaggctggtctcaaactcctggactcaagcaatcctcctgccttggcctcccaaagtgctggtattacaggcataagccaccatgctcagccctaaacatttttgattatgcttttttctgttttttttaatttgttccctacttagattgcaattctgtgagttgtgcacacaaaaagtgggtatcttcacttgctatgatgctttattgttcccagagttccttcatctacattgtttcattgaatgagtaaaagggagtgggggtgtcaggaccaggaggaggatgaggatagaggagacaaggtgctgtgggcaggcagaaaaggaggccgttgtacagtggagctgatgggaggaacttcctgggtagaggctgagccttgcctttgaaggacaagcaggatgtatggggtggcccacacaacagcatggcacacatgggacctggagagttgagtagccaaggggttgtagagagatcagactggccaaagccaaaccctatgtttggggaaacaatggccaaaaagattatggaccacagagctgagactgagcccataagcagtgcagagccagcagatgtctttgagcttgaggttgtcttaagtacacgatgtttcaagattagctcagcgccagggtgggaggtcagagagaagctggaagtgggtaagaccaatgccaatagaatagatgcgagggaattgccctaaacatctgaaggggccttatagacagtagtttctgcacggctagggccggccagccatcatcaggcatgtggtggtaattgcaggacagtcagaaactttaccccataaattgtatttaccctgcagtttgacctgtgggattggcagcaagactgagttttgtttttttgagatggagtctcgctctgttgcccaggctggagtgcagtggcgcgatctcggctcactgcaacctccacctctaggttcaagcaattctctcatctcagcctcctgagtagctgggattacaggcacgcgccaccatgcctggctaatttttgtatttttagtagagacagggtttcactatgttgcccaggctggtcttgaactcctgacctcaactgatccacctgcctcggcctccgaaagtgctgggattacaggcgtgagccaccatgcctggccgagactgagtttttgagggcatgtcagatttgtttctttttaataattgatctgtaagattttaatgattaatgtaccttcacatttcatatcctccttaatgggaaatgcttattcagaaattactctcctgggaagcaggcctcaagcaggccaatgagtccagttctgaggttcctccagctgcgtttcactcacagtgcctgagtgcaggccccagtaaggccccttcctccttcctcagacatctgtttctatgtcccagggatcacatggccattctccttctccgcctgagggagagagtgaagcaagcctttcagaagcctgtcacttgtcagattgttagcccaggccagggtgggggttctgtaccaatggcaggattttcttttcttttttctttttttttattttcataaagacacagtcttgttatgttatacatgctgatctcaaactcccaggctcaagtgatcctcttgcctcagcctcccaaaatgctgggattacaggaatgaggcactgtgcctggccagtgccatctgcccctactctgcagcttctgccatctggaactttacccccaagagtctgggaggaatgtggaattataccccgctcactcatctgagaatttaaaccctgggggtatatgaggatcaagcgtgtgtccatggtctgatagctgaacttcatctgcagcctcctctcctgggactgcctgacttacgctttactcactgacaacttcaagctgctggtgattgctgcattgactcacctctgtgccttaccttttgccatcccctctacccagaacaccctctcctttttcttgggcaggtcttgctcactgcttcagactcagctcaggcatcacctcctgggctggactaggtgtcgctctgtgttcccgtcacatctgctgtgtgtctatctctgtcattgcatccctgtattgtactgaactcttctgacttcttgtctgtttcccccagtagactgtaagatcctcaagggacagtgtcttcttcctcagtgtactgccagcactcagcacggggcccaacacccagcagacctagtacatgcccaggaactgccacgcataagatccttgctctgcagctagacaggacactctggggccaagaccttactcaacataaagcctcagcctgcctccagtcattggatttggaggctctttatcgggtgcctagaagtgattatatctttttgtcttaagtattttgtctgatacgaatattacttctttgtggttaatattggcctggcacatctctttctatgtctttatttccaacttttctggataattttgttttgtttcttttagtcagcatctagctggatcttttaaaatccaatctggtttgctgttttgtaatctactcacatgtactgtggttaatgacatgctaatattttgccttatttctgccatcttgtgtttttattttatatttattgtcctttttgcttcttttttcctccttgccttgccttgtatcagattgacagcattttctatttttcctcctttattcttctggtctgaattgtatttctattattttagtcattactcttaaatcaacatacatactaactgtaattttttctaataaaatttaaaagttgttgtacataaagtccccaaaaaggcaaggatcatgttactttttacccattgaacaacccatttcacccatcttccttattgttggtgtctagattttcatgttttaaaacgatttaaactggccagacatggtggctcatgcctgtaatcccagcactttaggaggccaaggcaggcagatcacctgaggtcaggagttcgagaccagcctggccaacatggggaaatcccatctctactaaaaatacaaaaattagccagatgtggtggcacatgcctgtaatcccagctactcaggaggctgaggcaggagaatcacttgaaccagaatgctgaggttgcagtgagccaagattgtgccactgcactctagcctgggcgacagagcaagactccatctcaaaaaaaaaaaaaaaaaaaaagatttaaaccaatttctcatattcaactgttaattaaattgaccaacatattgtttgagttcctgtgcctaccattgtttctttttcctatttacttttttctttgcaaagtacatccttcagtggttctttcagtgaaggcagtgccaccttacctagaactcctgtttgtgtatgtgtgtattagatgtgcatttgtttgattgtttcaagaaaatgaaacgacctgttaaaaccatcaagttaagtcataacacataacataacaggatttagtggcgtaactgaactaaaagtctgacaaattgatggctgattcagccctgacttgacaagacccctcatcagtaagggatcttcgtctgcttcctgtctacctgggctaaggaattattaccaacagtagatgggcagatgctaggggtagtaatatccacatgggtagtaatactgctcagttcctggatgttctagatgcctctgccaaccagattttattctaggaaggaactagagatccttgggtcctaagagaatgggccaagagtgtcctggcttgagccctaactccatgttggatgctctaactgtataaattgagcctcatttattcctgtaggtaatgtacctctctaagccttaatttcttcatctgtaaaattggagataatattgccaaccttgcagggttggtgtggaatgcattaacaaggcagatagagttcctggcacagtgccccatacacagaagacatttatggacggtagtggctattacattccctggcacttgggagacactcattgaatgtttatagggtggatgcagaagcctaccataaaaggcttcattgagtagataggccttaaaggataggtgagatctgggcagacattgataagggaggaaggcaagcagccactccctatgggaggaacagggtgggcagaagaagagaatcagaggcttgcccagtgctgccctgctcgggcaagtgaaggaatcagtctggaacaaactgggggaagggctgtaggaagggcagaaagggtagaaaggggagtcaggatgagcatgtatggggacttctgagtctgcctcgccagatggctgttttgccaggccagcttgctctgcctgatacttgcccttggttccctctttttttttcccctccttttctttctttctttatttttccttttgagatggggtcttgctctgttgcccagactggagtgcggtggtgcagtcatggctcactgcaggctcaagcaaccctcctgcttcaggctcccaagtagctaggactacaggcgtgtgccaccatgcctggctaattttttaattttttgtagagatgaagtctcactatgttgtccaggctggtgtcaaactgctggtctcaagtgatcctcctgccttggcctcccaaagtgctgagattacaggcgtgagccaccgcacccagcccagccccgcactttgagtaggcagaggtttgcctattgtggcctggtggccaggcaagctgaagacttaaaagaggaagttgggagaagattggttttcaaccaatatcttattaaggaagttgagtcattctacttctgctatttatcccctctgggcattcagagaaggacaagtttttacttccagatgaaatagtcatgagagggatttgccttggccccttgtagacattttcaagctggccctgtaagacagagttttatttccctttcgtgtatggagaatcaaggctccaagcattgcatgaactaggtaaggctcaagataccttggctatatggtgctgaaacagagaagtcccatcttctcagtgatggcttttagtagcctggtgacagacaagggaatgaacattcatttagcctcttctgttggccaggcaacctgattggcatttcatgtactcgtcttcattcggtcttcaaaacagctctgaaggagctaagagaagaaactcagagaagttaaaagaagtggctagctcaaggtttagatgtcggcttaggaggcagcagtctaggttcaaccccacctctgcaacctgcaactgcgtaacttttggtgtgctactacacttccctaagccatatcttcatgtctgaaaatgagatgacagtaggtactttgtaagtatcgacagttagtattctgagttggagttgtccagccctcaaagaatcctgacagatgggctacattctcagaactagaaggaacctcaaaagatttcctaggccgctggtttccaaactcttttcttggagaactagggattttgtagaggtcctcggtggatgaagggacactgagcatgtggagctccttcagccagggcagcgggttcaaatgtgagttacatgccagttgcatgcatctggttcttttagttattgggagatgaggtatgatttcatttgacaaaaatggtcccactgctcttcttaaaaaaaaaaaaattgttaaggctagaacccatagcttctggttcccagtctggaatttttactatgttgtacttgctaaaacagggaactgaatgaaatatgatatattctaaaaaggttatcatctgtgaagattaacatttaaaacattgtttttgtatcttccagtgaatcaaaaatttgtttactgtaaaccccattcctgccccagaatcctaggaacagaaattttactgtcagagaaaacaccgctctcatcacctcagaacagcactgtccaatagaactttctgcaatgctggacatgttctctgtctgcactgttgagtatggtagctagtgtaacaaggaaatgattttaaaattttacctcattttaattaaatgtaaatagccacatgttgctagtggctaccattttggacagtgtcgccttgagtacagagcaggggtcaggtggcagtctctggccctttggcatcagaatcatccagagaacttgtcaaaagtacagattctgggcctaatgcccagtgactggttcagcaggcctaggaggaatgcatttaaagaacttatctggttattctaatctgtggtcagattggaaactgctgcattggagagcttttcctcggagtggaagaatagagccagaatcaggcatttagcccggccctgattttctagggagactagaggaaccttctggggaatggcagatccttggagaatctgttgaaagctatggaccaagtcttccctggaaaaatgcaaattacatttttctccctgaatccatccttgaacctagattaagaactcctcatacagctatgcccagaggttgatctggtactgtccagatcattcctatcccccaggcttctccaggaggtcactgaggcatcacagaagaaagaaccaacagtgtctgtgcatcaggcctcaaagaatatggagtgaattctgctcctttcctttcctcttctgatttcttgggcttatgggtgagccatgtgggtttggctgttgccactgctcgtgtcctcaactcttatgcagagagtagagggcccaatgcctttggggcgtgaataagctgaggagagtgtctaggctgaggaatgaatcaggagtttgacttgccttcaaaggcagagacataactggctcccacttcgtcctccccacacgctgcaggagggagaaggggcaaagtgttagggccatgagctggggtgacagccagagaccaaagtccagggctgggaaggccccctggccagtagtcctggacttagtacagaaccatgatttttgtagaccagagtccagatagaattaggaaaggagggagggagcaagtgcatccgtatgtgtgtgtgtctgtgtgtgcatgtgtgtgtgtgcatgtgtgtctgtgtgggaggtggtgtttggggagagccactgtcaggccaaagtgtcccaagaatagcctcttgaacttggaggctgtcggtgagggtctgagtcatggtgatgtggcacagaaaagccagccacaggaggagctttacagctcccaggccgtgatttgtgcccctgagaggtgagggtcagcctgttttccccatgtccttcacaagttcagctgccatctgctgggtcagcttctcaacagcctccttgttactgtctgcctgccaggctgttggatgagtcatcggggaactgcaaaggagtctctgagcgtggctgcctcagcctcagcttccacttctctgggaagaggggagcctggtgtgctcacagaggggcgctggacagctgcctacctaacaccaatatgaaaggacaactctgggactcgggatgccctgcaccccctctggaggagttctagctcaggatgacctatccagaagcctccgttgggccatgccaggcggagacaggctatcagagcccccacacagccagatctctaatagccacgtgcccctcagagcagcaactgcaccacctggcctcatttttctcattcatcaggcaggactctctcttcctcctcagcattcgggatcatcctgtctccaaaggttatggaaaagcaatctttgtcctttgagtccctcgttcagccagcgtcagttgcgtggtctgtggcccctgtgctatacactggggaggcactgtgtgcagggccccacctcttccctcaggagcctgttgaccagggaggaccttagtgtgccctcctgcatttgcctgtaacccaggagcttggggagtgggcatcatagcctaaagaacctagggtctggatcctggccatgtcctgtcacacgtgggttgggtgaccttgggcaagtctccactgaattaggcctcagcttcttcaaatagaaatgaggaggtcacgctcacatcgagctccctgtgagcattccctactgctgttaggtttggagactttttggtctgttcttaagatctcatttcccctggtaaagaggctgagaacagtgggatcggctctgggcttaggtcagtttcttttttggaggtagagtggggtggggaggtgtgaggtgggatgaaagtacagttacaagaagcatagccagccttgaagggcttttgcctaattggatgtcagaacaccccttagactttttttttcttttagagacagggtcttattctgtcactcaggctggagaatgcaatggtgcaatctcagctcactgcagcctcaacctcctgggctcaagcattcctcccaccgcagcctctagagtagctgggactacaggccagctaccccagctaattttttgtatttttttgtagagacagggttccaccatgttgcccaggctgatcttgaactcctgggctcaagtaatccttctgcctcagcctcccaaagtggtgggattacaggcatgggccaccatgtccggccccctcagacttcttaagatcctcaggtaacagtgaggccacccattcagcctcctcagcatctggcgtttggtaccaaatccaggcatccttgcaggaagctggagctgctccaagttcagagctaggagacccttaaagacagagatgcaaggaactaatcaatagtgaacaacaaaccccaccacacccgccagccaagctggcagagcctttcatagccatcgaggtgggaagaccagtgaggcagattcagaaggaggaatgcttcaacctagtacctcagcttcccaccatctcattcagtcctcaggcctcacagggcaaaaggccagaggccttagagttcagcttcagatggtgtacctgtctgccccagaagcagagaagtgatccagggttcacagagttatagcaaggaagatgatttctgctggtagcagctttaagacaaacctaccatcagagagcagttattaaaaatctgtctgcatttgggaccttctcaggctgtttctaaagcaagtcatgcctgagaggggccctgccctttaaaaactcccagcctttaaaaaggtttccaaatggtaacagtctcaaatcagtgctcttctcttttttgccaattccagtctgcaggctgtttgcacagattgttggcaactctgggttgctcttctttgcagcttcctagggctgggcaagacagaacccagagagacgtgaattcttatgctttattctttatttctagaggtataggttcgtgttagggccttgaatataaattctactcctgatgttgcctgaatgaaaaatgatacctagaagttttcagccaatgagtttggacattagaggaggaagcatgttagttccttctggagagccacaaacagacgcattgggcaaggaaccacgtgctgagcaccatttgcatgctgagttttagactttgtaggacacacacacacacacacacacacagatatctacctcctactagggaacagaatagaaccttgcttctctccacttggagaaaagtcgctgtggatggtgtgtgccaacaggtcctctccaaaggcttatgtggggtcagtgaggccatggttttggagtctgggattcaccaccctgtcctggggaaacaaagtttgccataaaacaacagaaaaagatcgagccatcataaaggcaagaaagagccaacccagacatttgtgccacagctctcctagagggagtgggctggcatccttgctggacacagtgaaggaggctgtttatgttgtggtactgggaggaccgggggactgtgccgtgtggaacgtgtagctgttgagaggtggactctgttaccattgaggatgtttggaggatgagtatgtgtggcagaggcacacataaacaggcagagaccctttgcccctgcctttctcccccaacccaaggctgacctgtgttctcccaggtctgggattctaagtgacctgctctgtgtttggtctctctcaggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtaggggcctagggttgttgtgggcacggggcaggtgggtgggcctgcaggtgggtagctgggcccaggggttccctatggaggagagaggtctgtgtcactgctagataagattctcatgagacacaaccagaggtctgtgccgagaatcatggaaagtggggttgtaaaagtgcacagatggtggatgtggcaaggggaggctgtgcccatcgtgactggagcaggggaagagaggtaacagacgagcactcgggactctgcagaatcatcaagcaggccatcaaccttctgctgtgaccttgagcagccccagtgtctggagaggctccagacaggaaaggccaggtctcctggaaagccccactggggcctgtagggccttcaccatcttccacctagaggtggccccacccccaggaatgagcaccgtgctcttgagcctgctgggccagtcctggggcggcaggctgctgcagggtgagacctagtctggtcctttcttcttctactcatgataccttatgatgactagtaatggtggcttcccttggagacagaaactcccacgaggcctgggtagggccgggagtcctctctctccaacgccttccctcaacccgggaggcttcttggggtggaacctggagagctggacagccatgctgtcatttctccacacgcatacatcctgccctcgtctcccacttcctcctggttggtttttgaggagagatgagagaataaaaactaaaatacagagagtgacataataattgttttaaaaaaatacacatatatccacacttatatgtacacacatatataaatacctaatagctgtttttcctatgagccaggcactgtgttgagcattttctgtagatcatctcacttcagcttcataggaagtgaggcgggcgccctgtgatccccataatataggcttggctatttcagagcaggtggctgaggccgtggtctgctcttgaccagtaagctgagaagctggggagagacagtgcgggaaggaggcattggtggggaggtgactgccagacaggggttgtctggaaaggaggggaaggagaggcgccagaggggatctctgtaaaatgtctctcccctaagtgctaaattcctattttttctcctctctgctaatccaactccttttgctttaggtgagaatagccaagagttcagccccaccttttcagaacgcattttcatcgctgggtccaaacagtacaggtaagcaggggagacaagcctgagtgggaaggtggggactggacccagcgccctcgtccccagcacttgcctgggccgctcctgctgaccccgggctccctccctcagcacctgtggttcagctcctggaactcacccaggctttcctggctgagccgctctctcagccaaataagcttttcaaaggcttttcacagcttgtggctgactgcctctgggccacatcaacttgacattttatttttattctcctcagagtccttaatgcaccccctcgtttcccatcaacagggagggtgctgggaacagaagctgcttcccactcttgcgtgaccgtgagcgcaggccgggttggtggggggggccttccactgtcctctatgggagaaacctgctggtgccttttctcctgggagatgcaccgagtagggatgcgggcggtagaaaaggaggggacagatagacttggtggcccggtagaaaggaagccagggtggggctgagtctgttcccaggctctgcattcccccacagatgattttttgaaacaagagttcaagtgctgggcacaatggctctcacctataatcccagcactttctgaggccgaggcaggtggatcacgaggtcaggagatcgagaccatcctggccaacatggtgaaaccccgtctctgctaaaaatacaaaaattccctgggcatggtagcgcatgcctgtaacctcagctactcaggaggctgaggcaggagaatcgcttgaatccaggagtcgaaggttgcagtgagccgagattgtgccactgcactccagcctggtgacagagtaagattctgtctcaaaaaaaaaaaaaaaaacaagagttcaagctagaaacagctccttcccctatcaccaggcaggttttgtatcattggagtttggaacctgctagtgataagattgtggggagggcagctggctgccttggaaccaagaaatgctcagtttggtgggattccttctgctgtcctgggtgccttttggcccagggtaggagcctctgatagacacacttctttcagctgtccaagagaagcctgtaggcctccagtggtccccaggactgccatgagtctgccttctccatgggggcagaagatgaggccaagggagggtggctgaggccatgatctgctccacagctgttctgcagcaacccatctgttgccgggtcctttaatacttggcagggatcccagtccagttagagccatggcagtgatgagccccgaggccagcagagaagggcaggctccccagtaccaggcagcagcccaggctgttcaccttcaacagcagccagggacccccaggaactgtgagaatggaggtgaccagccttacctgttcctccatccggaggcaacagaaacaagctctgctcagtcagagctgagaggcctgccatgagcgtggccccctcctaggaactctccaggggcagctcaccttggagagcagtgagcgaaccgtgtctgctcccctgactctccccaagaagtgctgagtctgtaccccatcaccatagtaacaagcacagcttctcggcagcttgccttggggccagacactgagctgggctttttaaatgaactaaattattgaaacttcatttccaccctgtatggcagaaaataccaaacccattttataagtgagataagtgagaaaacaggttccttgggatttagaaaccttgccgcattcacacaaggaatggcaacctgggatttgaccttggatctgcaggagtccagatacaagtgtctggaccagtccatcttcctgcttcctcgtgctcaatatgcaaatctgtcccttttgtgacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggtgagaccctccacccactgcccagaccccaggttcatggggccttgaaattggagcctgtccctgggccctggccctctgtgctgatagctgtgtttccccccgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaggccaggcccacagcctgaccagcctggccaagacctgggcagcaaggggctccagatcccgggagcccagccccaaaactgaggacaacgagggtgtcctgctcactgaggtaactaatcccccggcacctgtatatgtccctctaccagcaacctgggggatgcttttctctctttatcagagtcactcttgcctgtggtgacaaatcaaacagtaggacagtgctcattgtggatgaaaagtatcatctcttattccgccaatctcacttctcacagcctttttagcgtcttctgttctgagttcttctggttggtcacctcctgcttgctgaatgtgggcactgcattaatagtacacatgctgaggacaaggggaatcagccaggagccactggagatgttatcatggcccccagagacggaagatgaggatgggacctgttttcaccacccacctccttccctttttcctcttgttaacttcccaaataattttataactttaaatgattttatcaaactttgatttccgggttttattccatccatccactttttttttttttttttaataaatgtgttttttgagacagagtctcactctgtcacccaggctggagtgcagtcgtacaatcatagctcactacagcctccgtctcctgggttcaagcaatcctcctgcctcagccccccgagtagctgggactacaagcgtgtaccaccacgcccagctatattttttttaatagagatgaggtcttgctatgttgcccaggctggtctcaaactcctgggctaaagcaatcctcacacattggcctccaaaagtgctcggattataggtgtgagccactgcactgtcttattccatccactttttaattttttaatttttttgttttgttttgttttgagacagagtcttactctgtcgcccaggctggagtgtagtggcactataacagctcactgcaacctcccccttccaagttcaagtgattctcccacctcagcctcccgagtagctgagactacaggtgtgcactaccatgcctggctaattttgtgttttttggtagagacagggtttcaccatgttggccagggtggtctcaaactcctgacctcaagtgatctgcccaccttggcctcccaaagtgctgggattacaggcgtgagccaccatgcctggcccctccatccacttttaacatcatccttgacccccgcccctcttcactgttcctcccttccctccaccttctagctcctgagttttgttttttcattgtcaaggtgattggcagttctgtttctgtctcaccatcacaagtctgggatgtttttcatcacaaggatcagtggccgcagcccatgaacccttccctcgccttcacttcattcctctgccccctctctggtgctgcccggctcagatccctgccttcgccccagggctgcctggttgtgagggctcagctcagcagccctggcaaggtcaccagctggagagtcttcctcactgtagccctgtagccctctgctgccctggccactgaaactgtcctctctctcctgccaaccccagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtacgccagggctcaggggctgagtgaagagggaagccaggaagggggcctggtgtgttccctctgctttctgtccaggacagtcgcagggtggccgtgggtctgacttgtgaacagaacttggctatcactagccacctgaggtcggctggaactggaagggagcagcctgtcacgtgtcctggcctggctgctgcccctggcatgtgtgtatgtgagaggcagtgtgagaggacacacgtggcctcggtgtctcaatacagccagggcctgaggggcaagtcccaacgtggaagatggttggagcgtcatgaaattcacactgaggtaaaacccctgaaccacataggaggccgcccctgacctgggccagatgataggaaagcagtagcctccacctgtggggtgcttctaggaggaagccagcctcagtgggagtgggcagatctgccagagtcggagctgtgccccctgttggccaggcgtgccacagtcctgcaagacagacatgttggggacatgaagcttggcaagacaggaagtcactggccgggtggcaagagccctgaatcagaccaggtctgtctgacctgagagttcggctttcaaccactcttcaggaagaagagggaagaagatagacttcttgtcctagagttttgagtagagacagaagacaggaatcacccctcccaccccttcatctcactgatgttagaagtggagagcagagaggacagtgtggcatgctgggcctggagctgaggcctcctcctgtcagatcacactatccgggcccagagggagcatcggtggcggctgcagaccgacagaccttacaggtgtcggtccttctccctgtcaccaacctttcccccacccccaactctcagatcatcttgattggaagccaccttgtccccagtcaaagctctcggcctcaaagccagcaccaggacctaaggcgcgtttctgtggaccatccccttggccctctgggcagggtgaagtaagctctgagatataccttgtttcaagtggcttatgtcagagacactccaatccccgaaagaaaagcaacaaatacaggtagagcatccgcaatctgaaaacccaaaatctgaagtgctccaaaatccaaaacttttggagcaccaacctgacacaggaaatgctcactgtagccagagcacaaaagcctggcacacgctggctccattcagagcagacgctgccaccaccgtccagggtgcctgtggccttaaggggagaggagacagctgggatgtgaataaacccggcttccctggtgtgtacttgggctggatggtgagaccagtgaggggactatctgcaggtaccaccccaaacttcagacacactgtgtcgaatacgaaaactccgccctcaccacccctgactggcaacacgtgctgagtgcgtgctgagttcttgccgagttcttgccagtgtggatcatcgtcttccactgggggaggccaaggccacgtgcctgacctgctcagctgcaattcccctccccaggctaccggagaaggctcagctgtccctcttgagaggtggtgggaggagagtgtgagagtgtgaagagacgcgcacccagtgctgggagcttagtcactgggcttctcagctgttcccctgctgagggcctcaagagtcctcccaggcaacaaggtaaacaaccctaatatagtggaagaggataaatactccatgtctcgcccctcgcatccactgcaaggcagttggaaaagctccaagcacaaggcatggacttctcagcaccagagctgcagctcaagcccaccagagctgccactcacagaaccacttccttcccaccccggagaatgcagtggggatggctctttggcagcctgcacagctgccattggttgggcagacagcccctgctttccctcaaggcagtggtgtcctttagggttttcagctggaagagcaggagaaacagttccctgattaggagatggggaccgggaggtggatcaggcatcagaggtcaggctgcacatcggatcagagcaagtctgtgcccccctgatgctccttggggagaatccagtgtgtaaggtgtcacgtggcagtgccagcactcccttcatcctcctgatctagatgctgattggccataggtccagggtttgatgcagttgtttttatttttaaggttttgtttgatcttttttcttttctttcttttttttttttttttgagacaggatctcgctctgttgtccaggctagtatgcagtggcatgatcacagctcactgcagcctcagccccacagacccaaacaaccctgttgcctcagcttcccacatagctgggactttaggcacgcaccaccacacccagctaattttttattttttgtagaaacaggatctcactatgttgcccaggctggactcaaactcctgggcaacctcccaaagtgctgggattacaggtgtgagccactgtgccccaccaggatcccattttaatagaagaaacaactacttgtttatacacgcataaaaagtccaggctgggtacagtggctcacgcttgtaatcccagtactttgggaggctgaggtgggaggattgcttgaggccaagaggtggagaccagcctgggcaacatagcgagatcgcatgtctacaaaagagtaaaaaatagaaataaaaaagaaatttcaaaagtctaaaaagatatctgtcaaagggcagttacctctgagaataggactggggaatggagacttttgctttttttggtatcatttgcattcttttataatgagcctatatttgtttgcaattaaaagtaagatcagggccgagcacggtggctcacacctgtaatcccagcactttgggaggctgaggcaggtggatcacaaggttaggagttcaagaccagcctctggccaagatggtgaaaccccatctctactaaaaatacaaatattagccgggtgtggtggcaggtgcctgtaatcccagctactcaggaggctgaggcagagaattgcttgaacctgggaggcggaggttgcagtgagccaagatcacgccacagcactccagcctgggtgacagagcaagactcagtctcaaaaaaaaaaaaaaaaaaaaaagaagtaagatcaggccaggcctgtggctcatgcctgtaatcccagcactttgggagaccaagggtggtggatcacaaggtcaggagatctggccaacacagtgaaaccccatctctactaaaaatacaaaaattagccaggtgtggtggcgggtgcctgtagtcccaggtacttgggaggctgaggcagaattgcttgaacccaggaggcagaggttgcagtgagccgagattgtgccactgcactccagcctggcaacaccagagtgagactctgcctcaaaaaaaaaaaaaaaaagaaagatcaggcggtgcggcacttatacctataatcctagcacttctttgtagagaccccatctctacaaagaaaaaaaattagccaggcatggtggcatacacctgtggtcctagctactcgggagactgaggtgggaggatcgcttgagcccaggaagtagaggctgcagtgagccaagatcgtaccactgcactccagcctggacaacagagtgagaccctgtcccccaaccccacaagaaatgggatcctactctagggactattctgtaccatgtttttttcatgcaataatatgacagatttccttattggcatatatacaactctcttatgctttttaacggccatgtagaagttcttatcctagtcagtggatggattgataggatccatgaattctaggaaatttattcaaaagagtgtttgtcggccaggcgcagtagctcacgcctgtaatcccagcactttggaaggccaaagcgggcagatcacttgaggtcaggagttcgagaccagcctggccaacatggtgaaaccccgtctctaccaaaaatataaaaaattagctgggtgtggtagcgcatgcctgtaatactaactactcgggaggctgaggcaggagaatcacttgaacctgggaggcagaggttgcagtgagccaagatcacaccactgcactccagcctgggcaacagaatgagactccgtctcaaaaataaaagaataccaaagaaggccgggtgtggtggctcacgcctgtaatcccagcactttgagaggccgaggcgggtgaatcacctgaggtcgggagttcgagaccagcctgaccaacatggagaaaccctgtctctattaaaaatacaaaaagttagccaggcgtggtggcgcatgcctgtaatctcagctactcaggaggctgaagcaggagaatcgcttgaacccaggaggcggaggttgcggtgagccaagatcatgccactgcagtccagcctgggcgacagagcaagactctgtctcaaaaaaaaaaaaaaaaaaaaaagtgtttctgtgttgcatgtatgggcaatcacacatttttaaagaataattcatatcatttcccagatcctcataggggtctgtagcccaaaaagggttaagaatcactccttttagaacatctggctcaagtgtggagttctgggagctttgctttggctctgctgctgatctgggataatgtggccctggccaagtcaacccagctgtcaccaaacacctgctctgtgccagacaatgtgcaggggctggggacagagatgtgaaatccacaggcctgacctgaaggaacccgagttgtaatgggggatagacatttatattggggtaaaggtgagcagccttcagtcctggacacgtgtttagaaggaaaatagcacaaggatcagaggaaaatacctcgatagaggtgagaaaataaggcgggaccctctaatattcattggacatctgtgcacagtactgtggtagcccctttcacatagtttacattcctggaatcttcaaaagaatttatagaattgctcttacgcctttttttattgatggaataaaacagataagaataccaaagaagaggctgggtgcggtggctcacgtctgtaatcccagcactttgggaggccgaggtgggcagatcatgaggtcaggagagcgagaccatcctggctaacacagtgaaaccccgtatctactaaaaataccaaaaaattagccaggcatgatggcgccaccagctactcgggaggccgaggcaggagaatcgcttgaacctgggaggcagaggttgcagtgagccaagatcatgccactgcactccagcctgggcgacagaatgagactccgtctcaaaaaaaaaaagaataccaaagaaggctgggtgtggtggctcacgcctgtaatcccagcactttgagaggccgaggcgggtgaatcacctgaggtcgggagttcgagaccagcctgaccaacatggagaaaccccatctctattaaaaatacaaaaagccgggcgtggtggcgcatgcctgtaatctcagctactcaggaggctgaagcaggagaatcgcttgaacccaggaggcggaggttgcggtgagccgagatcacgccattgcactccagcccgggcaacaagagcgaaactccgtttcaaaaaaaagaataccaaagaaaacaagagggaagttcaaggaggaaaaagtgatccccagtgttcagtgtgcaggcaattgaggggaaggaagtggcttctgtatcaggcagtaggctcattgctgacagtgcttccacctggggatgctcagtcctaagtgtattttaaaacattagcatggatgccaggcacagtggctcacacttgtaatctcaacatgttggaggccgaggtgggagaatcacttgagcctaggagttcaagactagcctgggcaatatggcgaaaccccatctctacaaaaattagctgggcatggcacctatagtctcagctacttgggaggctgagatgggaggatcgcttgagcccgggaaggtcgaggctgcagtgagctgtgattgtgccactgcactccagcctggccaaccaagggagaccttgtctcaaaaaaaaaaaaaaaaagttcagcatggaaaggccttcaggaggcagagtagctggcagctctggagtcaggcttgcccgagtaaaagcgctgctgtgatctcttatacccagtgaccttgggcaaattacttgcccaggcttcagcttcttcatctataaaatggggataatgatcccaccagcttacaggctattgtaagatctgaataactaatgcttagaaagggctttaccggtgcctgggaaatgataagtgggcattagatcttagttctcatgaatatcctcatcgcagtccagccccctcattttacggatgaggaacacggaagttcagagaggaggggtggccagacgggcagccagcttggcctggaaggctgggctgctttctcctctggcaccgacttctaaagcaccttgtattttgaagtatctcctcccacctctttggtctgggtggttggaaatatttttagcatggacgggacactctaagaggacttacagatttctgcaaagttaaagccaagtttccccaactcttttggatcacagccctgttaatatctcagtcattgtttcagggcaacccaggccaaaacaaatacccaacagttctgtttatgaagcagtgaggtcgaataataagtctttatcctaacaacttagtagccatttgaaaagcgtgacataagttgaaagaaaaagggtccttccatttccaaaccgccagattattaacgggatgtatgccttgttgcacatctcaacccttgaaatcagataggacaccaccaccttcatatcccacattttctccttgaagtacttttaatcacagtgacctgcaaaaacatagcttcatagagatacattatcaaagggaatgtcacgtgcgtgatcgtactttgaagctgaactgtctcgagcgagtagttcacgcggtgtcctgcagatactgcggtggccgtttccctcaaatgtcagatatccatttggcgcccttctgagttatctgcagtgccccggggtgcctcagctcagtttgggggtggttaggctgaagacatttgctaacaagtcctgttgttgaattagttccaactcaggttcagaggctttttagagctggaaacactggcagagtcaaagttcatgggaggtgattaaccaaaccagatattagggaaccagaagggcgacattttccactgataggcaaaagtccaaaaaccccacagtgtcagggctgtttgccaagtcagcaagtctgtgaagatcgcttccaagctggttctgttactgccagcgccccctggcgatgctactcaaggcttacttgagaaccatcagcagctaggaaggaggacaagtctactaagcggggaggggggaggaatagcattaggagatatacctaatgctaaatgacaagttaatgggtgcagcacaccaacatggcacatgtatacatatgtaacaaacctgcacattgtgcacatgtaccctaaaacttaaagtataataataaataaaattaaaaaaaagaagaagaagcctaagaggccgtgcgcagtggctcacgcctgtaatcccagcactttgggaggctgaggtgggcggatcatgaggccaggagttcaagaccagcctggccaacgtggtgaaactctgtctctactaaaaatacaaaaattagctggatgtggtggcacgtgcctgtaatcccagctactcaggaggctgaggcacaagaatcgcttgaacccaggaggcggaggttgcagtgagctgagatatcacaccactgcactccagcctggtgacagagcgagactctgtctcaaaaaaaaaaaaaaaaaaaaaaagaagtctaagaggccgggcacagtggctcacgcctgtaatcccagcactttgggaggccaaggtaggcggatcacctgaggtcaggagtttaagaccagcctgaccaacatggtgaaaccctgcctctactaaaaatatgaaaaattagctgtgcatagtggcaggtgcctgtaatcccagctactggggaggctgaggcaggagaattgcttgaacccaggaggcggaggttgtaattagctgagattgcgccactgcactccagcctgggcgacacagcgagactctgtctcaaaaaaaaaaaaggtctaagtcagtctaagtatcagcttctctgatgtgagctggaggaattggggagctagcacttcctgagtgcccactggttgccaggcctggtgtcagttaccatccttccaaatccttgctctacccaggagcagataccaccgtccctgctgtttgcatgtggaaatatgtggatgggaagtctgctgccttgttttaaaaggcggagccaggatctaagcccaagatgtttatatccaaggcctatttcctcccaccaagttgctggtccctgcagaaaggagtggatgatcccggacctgccatttggcagtgggagtggccttggccactccccagaagcctcctcagaagcctccttaagttcccagatgctgggagacagctgcaaacagaataaacactgctctgtctatgtggatgttttagtcctccgggaaagaaaagtgttgaggccgggcatggtggctcacgcctgtaatcctagcactttgggaggccaacgcaggcaaatcacaaggttaggagtttgagaccagcctggccagcatggtgaaaccccgtctctactaaaaaatacaaaaattatctgggcctggtggcgcacacttgtagtcccagctactcgggaggctgaggcaggagaattgcttgaacccgggaggcagaggttgcaatgaatagagatcacgtcactgtactccagcctgggcgacagagcaagacctctgtctcaaaaaaaaaaaaaaaaaagaaaagaaaagaaaaaaaaatgcacccgatggagtccaaatcttggttcttgacagtcagataagtcaaaaacccagcttctgagagtagacatggatgttgataagcaaaaggtcccacatcctagaaattgcccagaaatttagctggaggaaaaaatgttctgcgtttggcagatttgagggcggacagcgtgccagcagccaggatgacgaatgtagggggttttttgtttttttgtttgtttttttgtgggtttttttttgttttttttttttgagatggagtctcactctgtcgccagactggagcgcagtggtgcgacctcggcttattgcgaccttggctcattgcaacctccgactcccaggttcaagtgattctcctgcctcagcctcccaagtagctgggattacagccacgtgccaccacacccagctaatttttgtatttttagtagagacagggtttcgccatgttggccaagatggtcttgatctcccgacctcgatctccttgatccacccgcctcagcctcccaaagtgctgagattacagccatgagccaccgcgcccggctggaatgtagtgttttgttttgtttttttaattttttttttttgagacggagtctcactttgttgcccaggctggagtgcactggcgcaatctcagctcactgcaagctccgcctcctgggttcacgccattctcctgcctcagcctcccgagtagctgggactacaggcacccgccgccacgcccagctaatttttttgtattttttagtagagacggggtttcactgtgttagccaggatggtctcgatctcctgacctcgtgatccacccgcctcggcctcccaaagtgctgggattataggcatgagccactgcgcccggtgcggatgtagtttttatgtggctgtttttgcacacaggcagcactccagaactttaattaagtacaagaagttgctcctgataccaagggcacgggatacacaatttagcctctgagggtccagcaggccccccaggcccctgcatcaccactggaaacagcagcagcctctgtgtgtggagcactagggtgctgacaggatgccagggacccagctctggtcccctcaccctgtcttaacagctgcctctgggcccttgcaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaaggtaaggcccaggccccacggccctgatccccagcaggctcttctctcacaccatcctgtctgatctcctctcagttctgggctagcctggtcatccccagtagcaggccctgagtcaggctgacaggactgtgcctgtaggaaggggaatgatgttctccaaccccttagccaagcactgtagtttctggtagacggtggccacagagaaccgaaggtcaagctcccacccactggtgacccctggtatggggtcggcgcaggcgagcagagtggcagcgttcccgagtaaaccctgctcctgtccctttgccctcagagatcctgcctacctctagcctgaattgataccctcctcccttcctccacgattaatgaaactaatcagaagcagcagctgccacgtagggtcagccagaaaattacatcactggagggcaggccaaaccgagccagggtgggctgggacccggcatgactcacctgttcctcttcctccccggggcggcctggcagctgacaacgtgctcctgtccagcgatgggagccacgcagccctctgtgactttggccatgctgtgtgtcttcaacctgatggcctgggaaagtccttgctcacaggtaaggccccccaccaactgccgtgccccccaatgcattcattcgccaaatgccttccatgctttccagaatgggaattgaggtgtgaacacttaggtccacctgtgtgtttaagccccgcaaccagcctggatgattatcaggggtttctttgttacgcgtaaatgtgataatagatgtcaggtgctcattgtcgatgctcctgtacacagggaagagaagggaaaggctggttgactctccgtaggtcccaggccttctgccttggagtccccgtggctcctacctcttgtctggcctttgcaggggagtgcactgccagcctgtgaccccagctctcctgcgcctctgagcacggttggctggaagcacagtgggcaggctgaccaaggggcctgggctctaaagtcagtgaaatatctttctttaactcctctgattattgaaataatccatgcccactgtgaagtatagagttaagcatataaaagaggcagagaacagaattctcaccatgtctcttacccagagagagaatcacaaatttttttgttgttttcattgagacagagtctcactctgtcacccaggctggagtgcagtggcacaatctcagctcactgcaacctcctcctcccgggttcaagtaattctcctgcctcagcctcctgagtagctgggattacaggcgccttccaccatgcccagctaatttttgtatttttagtagggacggggttttgccatattggccaggccagtctcaaactccagaccttaggtgatccgccccactcagcctcccaaagtgctggaattacaggcatgagcctccgtgcccggccgaatcatgaatattttaaataactccttccaggctgttgttttccctgtgcctagttagggccattataacacaattttgtgccctgcgtttttcatgtatagccttaaggataaaatgatttcattttgaccaacggaaaaagaatctttggaagtatatgattgtgtgttgttaaaggactatgttggcaattctgaagatgtaaattgaatgtggacacttgacctccacccgtgttgttttaagcccttttaaaataactgtagtgggctttttcttgttacaaaaaaaaatgtatcttttctgattctttttaacttttattttttagagacagagtcttgctctgtcacccaggctggagtgcagtagctcactcatagctcactgcagcctcaagctccttggttcaagcgatcctcccacctcagcctcctgagtagctgggaccacagcatgtaccaccatgtccggctcaatttttatgttttttgtagatatacatggggtctcagtatgttgcccaggctggtcttaaattcctggatttaagcattcctcccacctcagtctcccaaagtgctgggattacaggcatgagccactgcctgacccttttttctaatatctgttgaagaaagtagagctaagcaaaaattacaaatacaaatcaccaggaaaaaaaccactgttcacatctgccatctatcctttcagtcttttacgcatataagttttctattacaatttttaaatttcacttactagtatttcttactagtaagaagtattacttactggtattacttactagccttctacaacctaatttgtaatgtccagcccctgccccatttttaaaaaacactttaagggtttggtccaaagggcagagtccacatcatggatgctctgttactttgtacaagttcccagcagagtccccgcctagctcctccctacaagtctgacttggagactttatttctatatttaaagtattttaacatgtccgggcacagtggctcatgcctgtaatctcagcactttgggaggccgaggtgggtggatcacctgaggtcaggagttcgagaccagcctggccaacatgggtgaaaccccatctctacaaaaacataaaaattagctgggcatggtggctcatgcctgtaattccagctacttgggaggctgaggcaggagaatctcttgaacccgggaggtggaggttgcagtgagccaagatcgcgccattgtactccagcctgggtgacagagcaagactccatctcaaagaactaaaaagataataaaataaaaagtactttaacagtgacaaatgtaagataccccgaggattaaccagggtggccattgcctaggctcctgcccatcagcattccaggtaactttatgtctcatcccccttctcaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaaggtcggtgacggcacccagcatggccaacagggggagctgcagggccctggggcccaggctgcaggctggaggggctgctctgcggtggcagatggagcaaggggaggcctggtcatccatgtgggatcctaattcaaatacttgccacccaaatctgggggtacaaggggagatccagctgcggaggctcaccaagttcatggcaggtgagaactctcttctgtccataccctgggccccatccacctgcctcctaacgggccgggcctggaggctgtgggcgtcttgctgcctggctctggcctgttttactggctccatttgtccctttcctgggaaaagtgccctcactgtagcccagacccctccattccttgtggtagaccccagcacagcgggaacaggggccggcgggagttgcgcaaagagcaataacagccgggtatcaggaaatgagggaaggcaggcctcacctgttgtcttttgccccccagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaaggtaggaagagccccacgctggctgacccggggggcagaagacagaggtggacagaggaggcaggtgggcgcaggtccagagcaaggcacccctcagagccttagtttccccctctggattatgggggtgcagcagcctcagggttgttgggagattgcgacagtgccacgcctggacccagaggcagcgctcaggagatgggaaagagaaaactcacacgcaaactcgaagtgctttttccattctcccactcaactacaatcaacccagaagactcctgtgaccacatgtgtggggatttccaccccaccaagccagcaatcagttctgcagcagacactagcttggtgtcctctaattcagttctgttccaacactatctacctggaggtagcatcagatcccacagcaggagggctcgatccccaagactgcaccccctacccatgccagtctcaggcccacgtgtttacctgtgcttctgaccaactggctataagtcagggaccccatgaccccctccttgggattgattaatttgctggagtggctcacagaactcagagaaacacttccttacatttaccagtttattagaaaggatattacaaaggatacaaatgaagagatgcatagggcaaggcatgtgggagggagcacagagcttccagggcttggcaccctccaggaacctccatgtgcccagctaccagaagttctctgaacccggtcttcttgggtttttgtgtaggcttcattacgtaggcatgattgaataaatcactggccattggcgaacagcttaacctttagcccccttccctcccagtacgtgggatggtgggatgaaagtcccaaccctctaatcctgcctatgtctctctgatgaccagcccccatcttgaagctacctaggggctgccagccttcagtcaatccattagtacacagaaagagatcattttggagagtaaggcttttaggagttctgtgccagaaatggggttaaagataaaatatatgtttactagtatcataagggttatgatgtatagagggggctcaaactcactaggaatccaagaatacaaaataaagacaggccgggagcagtggctcacacctgtaatcccagcactttgggaggctggggcaggaggatcgcttgaggccaggagttcaagatcagcctgggcaacatagcaagaccctttctctgcaaaaaaatttaaaaattagccaggcatggtggcacatgcgtgtagtcctagctactcaggaggtgagaggattgtttgagcctggaaggtcgaggctgcagtgagccatgattgcaccactgcactccagcctgcgcaacagagacccgactcaaaaaataaataaataaataaagccaggtaacactcaagagccatttgactggaaaaaagcagaaagttggtgggatgtagggctgttgggacccctcaggtgctgctgatgggcatgtggacaaggctacccactctgggggggcacctggctgcactcaggcagacgtctgcagactgagaccaaggacttctacccctgggtgcactgacaaacgaatgccagcagatccatatggggacacgcctgaggacgcgcactacagcttcctttgtgggaggggagtagggtacgatggggtccctcactgggaggacagagacacaaaaggggatgcctcatggagcaccaagcagttaaagcaactcggcgttcacagagcagcatggatggatcctaaagccatggtgccgagtgaaaagagaacccgacacagaatgggacccagaacataatgcctgtttggtaaactaaaaattgatcaatagccaggtatggtggcgcacatctgtagtcccagccactcagaagattgaggtggaaggatcgcttgagcccaggagttggagtccagcctgggcaacatgatgagacctcatctctttaaaaaaataaaaataaaaataaattgataaataaaacaacgcacattttgcaaggacacaaccaaatcaaaaatgacacatcaaacataatagaatgtcacctgagggatgggcacaaaaaaggctgtgattataggaatgaaaatgaaataaagaaaaccagagagatcttgcacctcaccaaagacagctggtagttataaggatgagggtggtcccagggctgaactagccccatgccagaacaaacggtgcctggggaagtaccgactgaggatggggtaggagagatggtgggtccaggatgccactttgcctgggagctcttgagttggtgtagccccagggctgttttcaatcttctctttcttgttaacaaagtcctctggagctgattctgtagtttttgaatttgctactgatacctagaagaaaaacagaatcaaagacagaaatccagtcctatccctgtcatattgggaccattttattgaggaagtctcctgtggagaccaccatgctgccctctggagccacctcccatggtggcccggggcagtgtcctcccctttgtttgcctctagcccttctgcactcaggagaggccgctcctgcctggaccgctgtctgtgcacagcacgcttcccctcaccattgtactctctgttttctagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaataggtacgggcagccgtggctgcagtggggccctgagcactggccctgggccacccgcggaggccggtgtttctctttacctgcggtgtgggctttcttccagccccttccccagcagctcagcttctaccgactgtgcaggaagaacccctgaaaacacagccagcctcctcccagtctttcacagccatcttccacttttccctgcagaattattcctcaacagcctgtcccagccattttctctggaggagcaggagcaaattctctcgtgcctcagcatcgacagcctctccctgtcggatgacagtgagaaggtgagtcggttgtggccccggagccatggctccaggggtgtggttttcccggccctggcacagagcaagtagctttgcgtccagctagtgaatggacactgtgcaagtagtgggtaaagggagggtgatgggggtcaccccttccttctggtgggggtcctcactaggttgggggaggtggtcatggttcagagtcagagaaaccatgggaatctacccttctgggattagggaatgtgttttgccaccagagataatggggaggcaggccttcgtcccccatggaggcaacccttaccctcctccagctgagggcatgagcagtgccccttttccccaaatgagacccaagccggagatggatcctggagcccagggccctgagtccgtacccaatcctgttgtttcagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtacagtccaattcccacctgctcagcagtccccgtggcagctgatctgcctggagctagacagccattgagggattttgtctcccctcctctggcacagtgggagggaggaaggcgcctggtcccagaacttgaggttcctggccagtaagttgggtttcaagcaaaggtcccaatcacccatgagcctttcctgatggggcagtgagggaccattatcccctcattgtcagttgatggagtcccagaaggttcccctagcttggggaggagagcagtctcttgacctggagtcaggaaaatgagcaattaatctcttctaaagggaaaaggaacaggacccatgagcattttaatcaaaaactcagcaaaaggaatccccctctgggatttgaggtcagatgagaaagacaacataaaattccttcgttttcaagcttgattgcataggttatgatgtggctttgctacaacaagggcatcatcagcttggagttccctggccctctccagggcaagtgtgactcatggcatcagggccccatggctggccaaaggccacttcaactcaggcaacaatctaaattgcccataatctaatttaagaatccttgtgttcagttcctttctgctttgcatccaagttgaaatactacttccccataggagccagccccagctcttagcaatgcacaggccaaatcccaggtgctgacggccaggaagaactagcaggtgtatataatatgagggctgttccagcctgaattttttttttcttataaaaatgcagctttgtgaccaggtgtggtggcccacacctgtaatcccagcactttgggaggccaaggcaggtggattacatgaggtcaggggttcgagaccagcctggccaacatggtgaaaccccgtctctactaaaaatacaaaaattagctgggtatagtggcgcatgcctgtaatcccagctacttgagaggctgaggcaggagaatcacttgaacccgggaggtaaaggttgcagtgaactgagatcacgccactgcactccagccagggcgacacagtgagactctgtctcaaaaacaaaaaaatgcagctgtgcttagaccagcctaaattttatctctgctgctccatcacagccagacctgctccccctacatagggcagagtgacttttaacaaaaacgttcccccagcccctgccaggaccctggtccttggggagccagcagccgctctcctgactatcaccttgtccgccttctaggtgtgaaagtccaaatacagtctcttaatggtgaacacctgcacatccgggagttccaccgggtcaaagtgggagacatcgccactggcatcagcagccaggtaaggggggcaggtacactctgacgggcagagtcccagaagccaatgcagctggccccaccctccaggaggaaagctttcaaagaagtagaatggcactctagggaatacttggaattggccttcaacgtcccccaggacctcaaagcatttcccagggcctcaaagcaaggctggcagtggtgacaaagaggtcctccagacctacacttgagccgggtgggattctctgagtcccgtggaatgacagacaggcagtgcccttagggctgccggtctggctggaaggagatgtctttacctttctacatggcttgagccctatgccatgatctcagcccactggtttgctccacccttagatcccagctgcagccttcagcttggtcaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccagggatctgccagcccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtttccaggccatcggtgtcctctctcttgcctgccggcctgctgaacctcacgaccctaacagctgcctctctttgccttcttgctgagatcttttcaagtcccccttgttttggacaaggactgtttcagcccttgagtggggctgctttcccaccactcctcccagtggctgcttctagtcccaacgctgggctagtcattcagaccagttaggcaagataccttgcccggtggcatcagggaagtccctcgccaaaatatgccaggctgaggggtggaggaggaggacaacaaagcctgcatgctttgtgccactgcccaagttaggcagccccctaccaccagaagggaaatagggatgggttctgggccctgaccatccagggatgccggatgcacaccacaggccctccaccctcccctcctgtccttgaggcctggactcttaaccctttccgctgcctcctgagccctgcatggggccagggatgcctttgtgggctgagttccttggtcatggagctggggcacacggggtgctgagttccttggtcatggagctggggcacacggggtgctgagttccttggtcatggagctggggcacacggggtgccttatcgaatctggctccacactccctgtgtgcacaagtgtgtgtgcgcgcggcttgggttggtttagccggttcttggaagggccctgggaccacgaaaagggcggcagccctgagccgctggcgtgcagagcgggtgcaagtcctgtccagcacagccaggcttacctgccgcctgcctctcgctctaggcccgctgcggaagcgcgagccccacccccgaggtcttcggagaggaaggagttctggcttcgggcccgcagccttcggaggacgcctcactcgggccgtcccccgtccgcccgcccgaaacctaaatgcggctccctgcctgtggggtcgcggcggggacgtcacagaggcggcgacatcacaggcaccggcgcctctaatatttccagcgcccaccagtccctcagccaaagagcacactggaggcggagaggcagcatccaccagcccgctccccgcctccaggacagagcctcggtctgcatgggggtgacaggtgggagcggccgagcgcccgggggcgagggttggggcaggcggggaaagcgaaagtgagagggggaggggcgcgaagggggcggtcaggaatccgcccagggcccgttcccctgctcccaaacccccggcacctgaaaggcaggtcgacccgccgccaaagcccacccggtgcccctgactacggctcccagcctcagcccctgcgcggtgcacacccatgtgctctcacggacacgcatgcgcgccttggagtagggactgcagagtcagtggttcttgaaggggttctgagaccacagaaggagcaatggccttgtgcacaggaaacgactcatgaattatcctgaactgcagatccaaaaaatcacatccagttgtccctccttgatgcttgaggctttgcagggaggagcggcagtcttcagcacatttttacggagcgcttcgttgatgccttgtactcttctctgaaccaatgagcaaagatgtttgcccccagtgccctgtgtctccccttcccataggggcgtcagatcccccactgaaatggtggctttcttttggggatcctctctcccagaagggcatgggccagcattaaaaacggtcaaaaattaggtgggcatgatggctcaacgcctgcaatcccaacacttcgggaggcagaggtgggaggatcacatgaggccaggagttcaagatcagcctaggcaacatagcgagactttgtcctctacaggaaatgtttaaaattagacaggtgtggcggcatgagcctgtagtcccagctacttgggaggctgagctgggaggctcactggagcccaggagttgcagtgagctatgatgctgccactccagcctgggccacagagcaagaccctgtcaaaaaaaaaaaaaaaaaaaccagaggtcgggtgcagtggctcacgcctgtaaggtaaaacgtagattagacagccaggtctgtcatggagaggattacactgattatttgaattgggctttcaggcatgagtaggactttgccagaagaaggctttccaggtataagaaatagcatttgcaaaggcactgggtgcagaaaggcctgcggtactctgggggtagcttcggcttagggtgagggacaggaagctggatgccaagagatgaaaaatgaaggtagagatcagaccaagaggccacatggagtctgggggtaaccggagacaagtgagatgtagcaggctcactctgaggtcattgaaaatccaggttggagggggacatagttgcagtggtcccactggaagactaaagagatttaagacagtgcagtgagtagcatcccagagtttggagccagccagacctgcctttgggtcgtgtgctgctcttaatagctgcatgacctcatacacgtttcctcatctgtgagaggagagccgtggccaactgggcatagggtaggtatgaagactgaatgtgcaaagcactcagcaccaagtgccaaagggtaggaagtcatgggtgtgtgctggctctggtactgggagatgaggacagcatcaggggtaggagggcagtagctgcggagggaggaggagtcacaaatgacccaggtttctcatttgggtgaaaggatgaaggatgaatagggcgaggagagtggggtatggagagatgacagactagaaagggagacaggggtcagacaggcagaaccgtggcagccacacttaagagtctggacatacaagatatgaatttgaggtaagaaattaggccaggcatggtggctcacgcctgtaatcccaacactctgggaggccaagatgggaagatcgcttgagctcaggagtttgagaccagcctgggcaacatactgagacctcatctccttttttttttttttttgagacagagtcttgctctgtcacccaggctggagtgcaatggcaccatctcggctcactgcaacgtctgcctcccgggccgaagccatcctccctatcaaaacctaacaaagacattacaagaaaagaaaattatacaccgatatccctcatgaatatgcatgtgaaaattctgaaaaaaagccaatcagattcaacaacatagaaaaagggtaatatatcacaaccaaatgaggtttatcccagtaacgcaaggctgatttaacattttaaaaaataaatttatagctgggcatggtagctcacacctataatctagcactttgggaggccacggcaggtggatagcttgagcccaggagttcaagaccagcctgggcaatataacaagacccatctctacaaaaaatacaaaaattagctgggggtggtggtgaacacgtgtagtcccagctactccagaggtgaggtggaaggatcacttgagacagggaggttgaggttgctgaaattgcgccactgaactccagcctgggcaacagagtgagaccctgtctcaaaaaaaacaatgtattttaccataaacagaatataaaaatataaaagaattatcactcaaataatataacattactcatatgttaatgtattataacgtatgttatgtataacatatataatatcatattaaagaaaaaccatatgatcatctcaataaatgcagaaaaagcattaggcaaaatccagcatccattcctaattaaaactaagcaatctaagagacgaaacttcacaaagatgcccaagctaatgaaaggcatcatgaagaaacctacagctagcatcatccttaatggtgaaaggctaaacactttcccctaagctcagaacgaagcgaggatgtacacacgcactcctactcaacattgtatggagattgtccccagtgcaattaggcaagtaaagaaaataagaggaaccagattgggaaggaagaagtaaaagtgtcttgactcacacacattattgtctatgtagaaaatccgatagaatctaaaagaaaaaaaaagctatgagaacaaataagattttagtatagttgcaggatacaaaagatggatatatttctgtatactagcaacaaaccactggaaattgaaattatttcggccaggcacggtggctcatgcctgtaatcccagcactttgggaggccgaggcaggcagatcatttgaggccaggagtttgagatcagcctggccaaaatggtgaaaccccatctctactaaaaatacaaaaagtgagctgggcgtcgtggcgcatgcctataatcccagctgctcaggaggctgagtcaggagaatcgcttgatctcaggaggcggaggttacagtgagccgagatcacaccactacactccagcgtgggtgacagagtgagaccctgcctcaaaaaaaattatttcaattatttcatatactgcagaatatcacttgaatccctaatagaacattctcaagtcaggcaacgaggtcccaagctgagtcaatgtctgactttttctcccagcccccagtgctgttaagaggctcacacaacagtaatttcttctcctgtccatacccagctgccgtttatggaggggttgaggctgtgggtgttgattaaactgcccagggaaattctgtaaagggagcaaaggccctgaggtcagaagcctgggggaacagcaggacctgggacagggggagttggagagggagaagagagacacgtgaggaagccagggaagcatagtggtcaaggaggtggagggttctgaagagatcattgagccggccactctgctgatacatcccccaagaccaggctgaagcagatggtcccaatcccaagaccagccatgcaaggacccctccctccagccactacatctctaggaagagaccgcagtacattctcatccttccaatatgatcctgggagcgattcttcccagccagagccagggctgtcacttcctgccataccccaggctgatggggacccaccttgcatgatggcagggttgtcatgatggccccaccatcaacccctatgcatggccctgggtagcagagaacagggcagcctggtgcttcccactcccacagggtgaagaaacagcttctgcagtaaaagatacaagcctccagggaggggtttggggttgcggacgttcccaaggagtcagtctcccctgcagagggtgatctgagctcataaatcgtcggataggtgctagcaccacctcagattacacacctggggtgcaggccttggcctggagtcagtgatggatgacccagagagaggagaggaagccggcagaggagcaggaatggggagatgggggaggttcacatggggcgttattgggactccacgcagttacagggtcctgggagtagccggtgggggcagggagttaagagtttcctgagtcaagcctgcattcaagtcatcacttcagctatgttcagctgggggaccttgggcaaatggacctgtcctaattttttgtgttgaatcagtgagataaagcaggtaaagtgaccaggctatggaagcgctctgtcatgttcagggtactgttagcagtcacggttttgggggatggagatggaaccgggagcctccgaggaggcaaggcacagacggagagtggagggagcaggactggaggataggaatggcgaccggctcgggaacaaggagagcggggcaggacggtgagggggaatagcagccgggaagagagaaaagaagggcaggaaaagggggctggctccggaatccctctgggactgtcctctaccctgcagctccctgccctcacctcctttcccctgtcaggtgcccatggatttccatgctgcggcaaagggtcagtggaggttgcagagatgcggtgagaaccatcctcaatcaacgtagggcctcccccgagccctccaggacctccgacctcacccccagcctaggatcccccagcctaggatctccctcccttctgccatttccaaaacctccccggggccagtgtccaggccaaaaggctggggagggcgtggggcgcctatcctcccacttctgtttatgccctcagcccctggcatgagaggaagactgaggggtggtggggcacacccagggacaggataggacctgacccctcagagctgcctggcttgctgaggacagagctgctcaaggcgggggtgggcaggcacttgaagaaagagtgggcaggtgggtgggaggacattgctctggggctcccctgctggggactagtgttctgggcactaatcctcgaagtgagttgccccagctcacctgcagtgcttgataaaaatgagattcctgggccttacctccaaccaactggattcctctttgggggtggggcatgagttggcaagcagcttcctaaactcactaaagtttcagaatacaaccgcagacttcctggtggcagtggagtgggacagcaggggagtggatgagctggtggcggggtggtcggcgggaggtgcatcgtgccagcttctgttacaaggcagagggctttgagggccccagaaacccccttcccgctgaagccccacagatccccatcacccactctgtcttcttctgtcttagagatgacttaagtcaacaccagatacaagaggaacaggaggtaaaaatgggagtgtcctcttacggggaggtggtaggcaagcggcagggctcttccctaagtccccaccagcccctacccttgacaatcctgggaccctagtaccaggccggtgtgggtacacccacacacacaccccctcaccgggcaggtctctgagaggaggcaggcatggggttagggggcggggggaagacagcaggacccagggcaggggtggggcagggactcggtgccagggagggcctcaggggcaggacctcccgctcctgcctcctcagctttgagttgaaacatttcagctggaggcagacatgctagagcagaagccccaactccaagtggacctggacctggacccagacccagacccagacccagaactggagatcggacaggtgccggctttactggagtcagagctatacccagccctcaagcttgaagctgagctggacacggaagccaactcgaacgaggagtctgactttgaagaacccatgcagctggtatgcaagatagagtccgtccactccaacatggggctgcccacgccacagaccttcagaccgtggagtctgaattcaaactgccggagtttcacggaggagaaccacgtgtctgcctgccatcactccatcagtgcgcagacctccaagcacctcttctgggcaaacaagctcatccaggcctcagagcacagcctgcagcgggccatcaacatgcagctcaacaatggcagcgcaggccagcccatcagatccccgctccgggaggccatccccaccaacgccctgtgctccgaggagcagctccagatccctgatgcccactcagctcctccaaccacaagctcccaggcaccaagccccctcctgtcctcagatctcccgccacccattgacctgacagagctaatcacctttgcatcttccctggccatggcctcctccagcaggatggacctgcccagtttggaacacatgatgaaagctccaccccaggaggctctggagccttccacagagcccctcctgaccactgtggaggagcgagagccagaaaatcacgcagagaccctgccagagaaaccacgcgaagccagagcaccactgaaatcttggagtcaggaagacaagaacttcgctcaatcttactttgacttcagcaagccggggatcaagagggccaccatcaaagggcaaatccagcttctccagccaccagccacgtcccctctgctgcagggaagcaaggaagagtgagtgaggccagccccgcagctcccatagaggggctgtgctagaacgtggcaggggtcctcacacagctgggtaggggtggggaacagtggaatgagggcctgggagcaggatgtggtgggctgtgacgcctccacctcagtgacctcataaaggctgttggaacgaggttccagtggactgaggcgcagagccaaggcgagggctggaggaggcctggggaccaaggagggtgggcacaggggcctgggttcaaaatgggaaggaccacactggcattaggcggctttccaccctgggggtcgggcctcaccaaggttgggaatgctcaggctggggtctgccctgttgaaagcctgttggccccaaccctggggtccaggacacttttcttgaggggagaatgagggtgcagggctctccagtacaccttgctttctggtagtgaatggacacagaatgtaatctcagctgcccagacgcgggcagcagcagaagaccccttacccccagcgacctcttcagaggggcctctgggctcacccctctccttcaaccaccctctggggcccaagtgacactctctcttttgtgttgcagctcagtgccgccaggaaaagagaaagagaatccattattggtgaaaatccattttaagctgtcagcccccacaatcccagagaaatgactagacagaaccaataaagcctccagtgctggccgtcggcttagacttttgtgcaaatgcccctgggccagggagccctcctggctgctgtgtcctcgtctgttttttagggatgccaccccattttttagctgccccagctccacctgcccccagagggcaatgccacccttgtcctggccacccatctctcacctgcccactccccagggtcaattcccttcactccctcctggccagccctctaggccagcagaaagacttgtggctggtcttggggagacctcggtgtcctgtgaggcttccatttcttagactgtgaaatgaggcttcctcttggcctgaggccagggatgtgttgggatcatctgaggagatggccttctgggcgtggactgggcaggtgagaaagtgggtctgagggggttcttcctgcgctcttcatggggaagagctggcatggggaagggatggtgtccaggagcttgaaggggaggaaaatgaggccgaagaactggtcctccagagggtcacaggctggagctagacgtacctccaaatgcaggagagccatagatcacccagacatgtgcacacagacaccaccagctgcccggcacatcacacatacagcacccacacacagaggaagcagcacatgccacacatgcccatgtacacatgtgcctgtgacagtcgcatgtaccaaacatgcacacaaagccgggtgtggtgtctcacgcctgtaatcccagcactttgggaggcagaggccagcagatcacttgaggtcaggagttcgagaccagtctggctaacatggtgaaactccgtctctactaaaaatacaaaaattagttgggcgtggtgacatgcatctgtagtcccagctactggggaggctgaggcaggaggatctctggggtccgggaggcagaggttatagtgagctgagattgcaccactgcactccagcctgggcaacagagcaagactctcaaagaagaaaaaaaaaacacacatgcacacaaatgcacactcctcccacccagggtttggccttggaggcccagaaggcaggcagtatagactggcttctgggagagtagagacggcagcaaaggaaggaaggggattcggagtatgcggatggacagggatgtggacagggaagcctgggggagggagaatgggaggccgcgccatggcctggcctcaggttccctgctaagcaaaagcccagccttgtggatcttcaagagcctgcccagctttcgaacgggccaaggagagagatgcccagggcctggagggtgggattaggaaggggtgagcagttcagaatggg

SEQ ID NO: 887 - DNA, 4684 bp, Homo sapiens
atccttgctggacacagtgaaggaggctgtttatgttgtggtactgggaggaccgggggactgtgccgtgtggaacgtgtagctgttgagaggtggactctgttaccattgaggatgtttggaggatgagtatgtgtggcagaggcacacataaacaggcagagaccctttgcccctgcctttctcccccaacccaaggctgacctgtgttctcccaggtctgggattctaagtgacctgctctgtgtttggtctctctcaggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaggccaggcccacagcctgaccagcctggccaagacctgggcagcaaggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtcaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccagggatctgccagcccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtttccaggccatcggtgtcctctctcttgcctgccggcctgctgaacctcac

SEQ ID NO: 888 - protein, 947 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 889 - DNA, 25365 bp, Mus musculus
  misc_feature (1)...(25365): n = A,T,C or G
aggctggcatttgggttctgacaggcagacccactgcagggtgctttcccaaattctcatgggcttgttcgagccttgagggcggcaggttcaaaccttccctgggcatgagcggtttctctttcagccttgggtgttggcagccacggaaggcaagctcgggccttttctagctcagttggggcttctgagagtcagccatagactgaatgttgggtcttccccatccatcttgggtatggtcacctgctgcctccccccccccccccacctcagtttcccccttcgtcagaagtaatgaacatgttgtattccaactcccctctcaaacgctgcgaaccaagttttagaaaagcaacatggtggtttcatttaaaattcttttttctggttgtgggagtagagactggtaagttatcagggactatggagaatgtgactccaaatgcttttgggacgctaagagggtagctagggtgaaaaaggcctttcatgtgtatcagcctttacagttaagtccagtgactgcaggtgggtgcattggactgggtggggaccaaggacaaaagctggcatggaggcctgctgccagaaaaggaacagataacttaatctttctcccctacccttggggaacgggagaaaagctgatgccaaggtgccaggtgtgaccacattgctgggactcagggtacacagtttaaccccaggcatcatgaggtggagcgaggggctgcaggctggcactggcctaaccgtgaggaaggtttagagagaagggtgggaaactacagctcagaagctgcaagagttttctgtctgcctcttcagcccctgcaaagtaaaacaaaactcaaataaaagctggacctggcagatattaatacaacagagccagggctgctgtgcacacagccatccgctttcccctttctgtttctataagtggctgaaataaatttagtgaaactaccccacccagctgagggcccagggtttcagagcagtgggatttttcacccagaaagctcttcattttcaaagctgagatctttttgtttgaattctgttgggaatggaatgcttttgacttaaaataattattttaccgcactcacctattcctcacagataagtgccttgacactgtaaaagcttgctagaaagctggtctataaatgctctgcagcttaaaatagtggatggtgtggggccagtgtcttggtggatctctgggtattttttgccagattagtttctgtgttgtctgaatattttcagccaagtcccctcttgtctgtcaggtaggaaagtaagctgggtaagtcgacaaagcaggcaataactggatcttcatcttttcctagtgagtacttactgagggcctactatgtgctgggcactatgccaggcactaaggactgagttgagagctggttaaaatctgaagtgaccaaagacaaccagcaaggaacatcagatttaatgtaggaagatggaaatttccttcctaggaaggaacaaggtgagggcctcctcacacctgctcagcaaaaatgcactggaaaggaagctgtctctgtttgcagacaacgtggttatctatagtaaaaacaaaatcttccaagaaatctaccagctcatacataggagacaagacaaaaaaaatcaactatatttctaaaagctagtaataaatggttggaaacaagtatttaattacaagagttcaaaaaatgggaaatattaggtacaaagcttaaaaacaacaacaacaacaacaaaagcatctatataccagaagccattgtcatagggtacaggcttacaatcctagaactcagaaagtgttagaggaacattgagttccagaccaggctggcctacagagaaagaaacacactatctcaagaaaactccaaccagccaatcataaaagcactgattaaacaaaacaagtgtgtgtgaggtgtagctcagcagtagcacacgtttggcttgctgggttcaatgcccagcagcctcttactctgtctcccaccaataaataaatacatttgccatactatgccaatatttatggctagcagaatcttagaaatgataatatttttaaatgggtgctattctgcgggttagccccaggaccctgtgtactgaaaatgctgtggtttgaatgggaaatgttcccccacggactcacatatatgagcacctgctctcaggttagtggtgctgtttgggaggttgtggggctcttaggctgtagtgctttgctagagaaagtatgcactgggggtgagctttgagagtctgtagcctcacccctttcaatttgctgtcccagcttcatgtgggaggaagggtgaccagccagtttcacgctccagctgcctgctaccatgcctccccacgtcatggactctccttctgtaaccataagccaaaataaacacttttccccctctgtaagttgctttttggttttgttttgtttttttaaaatcacagcaacagagtcacagtaactaagtcggaatacagacagacactccatccctgattcctcaggagggctattttgcagcgataaatctataaatctataatcttctgaaatctatataagaaggcaaaagaatgagaatagataaaatcattcaaaaagtacgaaaacgttgggaggaaaaatagcctttgattttaagacttccaattcagctactataattgccagtggttggaactgatgatacaagtgaatggtctgacttggggagagagatgaagacaattactaggaggaattggagtctttcaacagtgctaggattggacaatctcaggcaaaacaaaacaaaacaaaacataacaaggaacttcaacctaagtctccttttttttggagggggtctgattttgtgtgtgtggttgttttggctgcatatatgtctgcaccaagtgtgtgaagtgcatccatgggctagaagagggtgctggaaagcgtgtggcagaatcttgcctacccaacactgggatcttccaaggcatctcttacacacaagtggattaacagatagttcctcggcatctagagaatacactgagggctggggatgtagctcagtgtacagtggcctagcatgtatgcatcccagcacaagaagcaaagatggaagggaagagaaaacattaaggaagcagaatacagtgccctttactactgatgtttaatgcaagggagtagacactccagtcagaagacaggtcagaaaactaactcaacgacatgtcacttttaagggactcattttagatctaaagacacaaacagattgaaggtgaatgacaggaaaagatttcctcagtggctaaagacatgtgaggctctgggttcaatctctagccccaaagacaaacaatgggaaaagaataaataataaagaaagctgactgtggtggtttgggtagggatagcccatagtccacaggagtggcacctttagacggtatggtcttgttggaggaagtgtgtcactgtgggggcgggcctcgaggtctcagcagctcaggccagttctctcatggctccctgtgatctcgatgtagacctcttagctcctctagcccctgcctgcacactgccatgtttcctgcctgaatagaatgaactaaacctctgaaactgtaagccagccccaattaaatgttttcctgtaaaagagttgccatggtcaaggtgtcccttcacagcaatagcaactctaataaagacacaaacagactttaaaagattatacgtggactgtcaagatggatggctcgaagtctgacagtcctgcaggttgtacctttgaactttcacatacatctaagattacaggagactaggatattatatatttatcagacattcaaaacagcaacaacagaacaattataaatatttgttaattacataatttaaaagtatccatcgtttggaagaaagcagacttcccagaactgagccttgaacggctcacagctgaaccaggagtgccttctaccactgtggtctgttcccagccctttagttttcatcatctaagacagggtcttgctaagttgcccaggcagtccttgagcttttgatcctccttgcttagcctccacattagctggactacagatctgtgtcacccaggcctggcagaaacaagaccttaatgacttgggttagagagtactcagctgtgacaccaaaggcatgattcacagagataaaactgaaacatcagacttcactcaagttaaaaaccattcctccccacccccagtggaagacatgttgttaaagagttgaaaaagtaagggggccggcttgagaaatctttgcaaatcacatgtctaaggaactgtatctagaatatgtttgtttttttggtttgtttgtttgttttttaaaaaaacaaaccctcaagtcttgatagaaagttaataataacccagttaaaaatgtgctaaagacttgaatagagactgcacatgtctaaagagacggggcgttgttataggagaaatgtgagttatgttgtaatgagaaaggtgggcatagaggctcaaagctggaatcctaacacttgggaagctgaggcaggagacatgccttgagtctaaggccagctggagttgctttagtcagttctagaccagtgtgggttatagtgagaccttttctccacccaatccaatccagatgtgatgggacagcacagcacacctagtagaatgattaaagtaaaaatgataacttacgtactgacgctgtaaagcaactggagactcatgaatacacatgctagagatgcaaaactgcgaaatctactttgtacaatggcttggtagagctgtgtgtggcggtgcatgcctttaatctctacacctgggatgctaaggcaggtgggtatctgtcagttccaggatagctagggttatgtggaggctctgtttcaaaaacaaaataaaaggcttagtagtttaaattttaatttaatgtacaatgaccatatggccctagaaatctctatttaccctagggctgtaagagctatgctcacacacaaatgtgtgtatgaacatctattgcagctctatttccagtccaaatgtcccataggttcatggtaggcaaactattatatacttatgtaccaggaagctatttgtcagtagcagggaatgagctatcaatatatgcaacatggataaattttaaaggcattatgctgtgaagtatttatatgttgtttggctttatttatatggcattctagaaaagacactattattgcgattgagaacatatcagtggctaccagggattaaggatggagcaacgtgtgaccacaaagggacacacccaggtagtcttttgagggttggtgaaactgctgtgggtgatggaactgtgctgattcttcagtgcatctgttcttaatgctcataaatacatatatcaaagatcacttttattgtaccaaaaagcaaaacagctctaagaaggaccatgaactatcaaactgaaactactcaaggaaacaaacattccatgaacacatgctccagaggagacactgttggtgaggtaggtgtgtagccaagaatgtttcccataggaagtgatgtttgagctaggttcaaaataattacaagctttcttgggcatagtcctggcacctggtgaagttaaaaggccatccttagttatcactttagtttgaggccagtctgggttacataaaactgtgtcaaaaatgaaaaaaaaaaagtagccaggtgtggtggtgcaaacttttaatctcagcacttgggaggcagaggcaggagtgtttctgtgagtttgaggcaggctggtttatacagtaagttccaaaacaaccagagcttctacacgaagtagagaccctgtcttaacaaaacaaaacaaaacccaaaccttggggcagcgacttcagacagaatttgcatgtgcaaaggcccagggtaggaggaagatgacttaatttcctttaaataagagcacaaaagaatgtcctgggggcgtggatgtaatagtgaaaagtcgaaggctgtgcagtgagcagaggggtttgttctcctcccgcccaggcaagtgggtacaacccagggaagagtttccaacttctcttctgggatcggaaacaattaacctaagaatggaggtttaaatacccaacttaaggtcccagcaagatattttctctccgctagaagcaggattggacttgcagtagcctaggagatggccttgtatcttcacttctaaaggactcagaccccaggccatgtttcatttaccataaaatctagactgccctgtcctaggcggcactgcactggttctgggggaccatgacagctgaatgatactctgaggggcttaggtcttggacacacgggagacaggttcctacctctattcggtgacccctgcatctactgtttgtagaaacactcgtggcaatcatcagaatattccgaaaagttacacaacaggttcccgtgccacatcctaacccacttccctggctcacttgaatacacaagtttgaggccagcctaggcaacttagcaagaccttgtgtcaataataaataaaaacaaatcacagctagaagacagaaccaatactcgaatcccgaactgctcaacgccagtgccctgggttcatccttagagggtctgaatcactgtgcctggcgtcaacaatcctgacaggtaacccaggtagcttcagggcttcaatcggccaattctctttttacctttaacccagggaaatcgaggccaccctcagggctcaggtagcaaaggaccgggaagggtcagatttcaatccgaagcctttgggagatttcgcaaatgaccaggagcctaggaggaaacgcaacccctctaggcgctctgaggcgtcgcctggcgccattgaccggttccgccgtctggggggaggggggatgcgggcgaccccgcgccgcaagcttccccctcaacaaggtcgactgcttcggctcggctttggcggacgcacaccgtcgtctccgcgtctccgggcctcccgaggactttcactttcccgagtcgcccaacctcgcggccccgccccccaccccgaatacctgcgtagcggaggacgcgcgaaccggaagtcggcggcagagcggcgcttccccccaccccctggccggaagcggctacgcaggtggagacggcggcctgtgcaagctccggacgctcgggaggcctaggcttgagtcccgtgagcttcgcggctgggccgggtacctgcggccacctgcggatcacaggcccgcgcgctggcggccgcctgtccgggacgcagggttagcgaagggttaaggagcgctgccccccctccccggaaagtcccctaaatgacgtcgcaacccgacaattagaacgaaaaaaaaagagtttaattatagagacggctgtgggatcagggacaaacctgggcgggcgggtaaacaagccgggagcgcgccgcccgcggagcccgcgcctcggggagcgggggaggggcggcccgggggatctgggaaggcgtaggaaattcgaggaatcacacccccccttttgagaaaaaaaaaaaaaaaacaacaaaattatttaagcagctcggggtgtccaagaccgctcggtcgcctcagggacagcaccacccagcgaggtcgcccctccccggccagggttcccccctgcagctgagcttcgcaaacactcgggagtttagagcagcccggagggtgatgcggactgaaaagccgaaataacttcacatcaggactccgtctaaccttgtgggttttaacgcaccctgctctgtcctgaaatctggaactcattacctcatcatcgagaaactgcacgaaatccgcggcacacacaccaacccccccctggagctggggaggggaaggagcaaacatccctttaaaaagaaacctacacacccgaatgatttaaattaaggtggatggaagttatttcccttcctggcgcttgccagatttcaagaaaagatgaaaaatgagagcgggggagggaaggcacagcagcagcagcaaaacccggggcagcagccgtgttaaaaaatgggggggggggcatcaactcaagtcactggagaggagtcaagcagagaccccgcggggaattaacgttaggttcgtgggctgcagtaaaagtcgtgtttcgcaaagttgaaagaaaaaaaattgtttctaaaacagttgtgatttggaaggtttccctgggtttgcccagaggctggcgataaataaaagttttgttttttttttttcttaaagtgtgcgtgtgtgtaaggggtggtgcgcctcgaacgctctgctccgcccgctccgtcctttccagagaaacgtactcgtaatggggtgacctaattacatcgcaatggaactcgctggtagccactcggagcacctggtttcataacagacccggcggcctcgaatgctgggaagaaacgtgcgaggcctgggcggtgcggcccgcgatttccgcccgggtctccactgcagcacgcgagccggtgcgggtgggaggcagccagacctaatagtaaataaacacatagttcgtggttttaaagggcggtgtaattcattgaaggccactgagttccgtgggtcttattgcttggtacccccaaaccgggcatagtgacaagccatatgttccgttcgcgtgggggcgggagagcagcaagaagtgtcgcttcccccacctctaccttccttcttaccaaagtaacttttcccccccttgtttttaacattcggggatgtgtggaggaggcagcccgaattcaaagcgcgcgtggaaagtgacttgttgctcttttattttcagggggtgcccttgaaagtctggacttttctgctgtagcaagtttaaagatcggttatgtgaacaaagcgccccatctaggtctgaaagaattctgcccaggcagtggtgcccccaccataccgggaaaacgcaggctgccggcccagcacgcgtggaccccgcgctgcgcgcaaaatcttactgctctcgccccctccagcctaggctctcctggagaaaaagttttctctggtcatccctacttcttttgctcactgatgggaaacaacaaacataaaactcttgactcgaacatttggggtgctccgcattcctaaactcctcgcccagctcattttgcgatgggcagccgggtgtggacagggaagtcaggggaaggtaagtcgtgcgggcacttggagaagtttcaagggacactagctcaagatggaaaccgcagccctggcccgctcaagaccagctccagcgcctgctaggaagaaaaaaaaaaaaaaaaaagacaggggggagagggagggaggagggggagagagagagagagagagagagagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttcttcatttaaatacgtttaaagctcctccttccaccccccccaacccaccaaatcttataaattgggctttgcgcgccgcagcccgggagagtcagaaaggcgaggggcgccgggagcaggcgtgtgggactcctgaccggagagccggaggctgcgccttccccgcaccgggaccttcacgacacaccagatcctagtccttgccccgtgcgaacgcccacgatgaccaccaccctcgtgtccgccaccatttttgacttgagcgaagttttatgcaaggtaaagcagggcggagcgttggctttttgaaagtttctcttgtgctccaagaaactctaaaaagtttgggtctcggggacgtgaaggagtttcactgcttgcgtttccctccatggtgaaggaatttgtttatgtcctcctcgcacttaagtttcaggtcccaggtggggttctgtgaatccggggagcaaagttctgggcgactgctccagtttgcggggcaaggaggtgcggaagagtggttaggtttgggacgaattttgaaggattcttttctgcatggtgcacctccggagctgggctaagcgggtgggctcggcttcgcagtgtgcgccttgggtttcctgtacccgctggagatgttcgaggttacccaacaccttttgctaggggtctctaggaaaagcgaggtctcagggcggtatctgactgggagaattttcctgtctgttttggggagctaagagataatgcgacgaagaaagaggccgacttaaggttcaaaaagatgtaggcaaagagactttgtagtggagtttgtccgccccagctgggctaggttcccgctgcgggagctggtcgatcgtgctgcaaacttggggctgaaactgtttgcttacctgggttgtgaggcactacggttcgttgactaaggaataggggaacaaaatgctgccagacctcaagttcccgccagttaggatttaagagggccaaaatggggcagtttgccagtcaggtttttgaaaaacaaaacagaaaaaaacttttaaaaccgtaatgttccaggagtgcgattgaaataactccgtgaatgttgttaattttttgcccgctctacttccccccaaccccccaatttgaaaggatgaagctgctaggctacttttaattgctgaactgtttttgccttcccttaaacacgtcgggtcatgttgctctcttcctagctcgctgctcctgtcggtgcagctgccaaggccccggggctgcagggttggggtgcagggccgtgctggagttgaagagcaacatcaaaaactttgtattttcggcttctttccctccctgcgtttttccaagtctgtttgccctggcggcagcctgagctagccaactccatcctgggccccgctgccccgctctttgatctatttctctttcttttgccccctccccccgcaggactttttaaatgaacctcattgttggaagcggctctcctctgggttcctgtaatccgctcggtggggtggttgcggttacagggttaccgattcccgatcccctgctgcggatcctaagggactaactttagaatttgcacaatgacacacacccacatgtgtcaggggcctggagataactttcaagtctcccacccccactcttttctaaatcttaggtagtttgggcaggtgactagggcttgtggcagcctctgtccttgctcactcacacacccccgcccccaattgactgagtcggggagtgtgagcgtgctggtgctttccttctcgtctgcagctttggttcaagattaaacactggtgctcttatccagagctctctcgcagccaggaaaccaagtgcaaaggcatcttcctagtgaagggggtggagaatgctgggagaaaatccctcccagggtgtgggatacctacccttcccgaaccttgtgttttcagacactatatccctctacccacatcccagactaggcccttccacaagcaaggaaaaagcacagtttgaaaacctgttgccaaaggaagggcacacttgtggaagaggaaatggtggagagtgtggggccagattttgtgggggtggggggggcggggggggcgggtaagcagggactgattgagagaggatttggctcatccttccaaacttctaaactaggtttacctgattcttttagggggagggaaatgaaaagggactgtcttgtgtgaaaggctctctgagttgaggaatgtataaacagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggaaaattagctttagggacaggaggaagctacatatcgggtcagcacggggcgggatgaatacataactttttcttccacacacggcaggattttgcggtttcttatgagcagtgccaaaataaatccaggtggctccttttagagagactggcctatcagatggagaggtgctgtcctttgtggacaccatgccctggcctcgtggatgtcctcagtcactcatccgtccctttctttccctcccctcccagggtaacaagatgctcaactacagcactcccagcgctgggggctgcctgctggacaggaaggcagtgggcacccctgctggcgggggcttccctcgcaggcactcggtcactctgcccagctccaagttccatcagaaccagcttctcagcagccttaagggtgagccggccccgtccctgagctcacgcgacagccgctttcgagaccgctctttctccgaagggggcgagcggctgctgcccacccagaagcagcctgggagcggccaggtcaactccagccgctacaagacggagctgtgccgtcccttcgaagaaaacggtgcctgtaagtacggggacaagtgccagttcgcgcatggcatccacgagctccgcagcctgacccgccaccccaagtacaagacggagctgtgccgcaccttccacaccatcggcttttgcccgtacgggccccgctgccacttcattcataacgccgaggagcgacgcgccctggcggggggccgagacctctccgctgaccgtccccgcctccagcatagctttagctttgctgggtttcccagtgccgctgccaccgccgctgccacggggctgctggacagccccacatccatcaccccaccccctatcctgagcgccgatgacctcttgggctcacctactctgcccgatggcaccaataaccccttcgccttttccagccaggagctggcgagcctctttgctcctagcatggggctgcctgggggaggctcccccaccactttcctcttccggcccatgtccgaatcccctcacatgtttgactctccccccagccctcaggattctctctcggaccacgagggctatctgagcagctccagctccagccacagtggctcagactcccctaccttggacaactcaagacgcctgcccattttcagcagactctccatctcagatgactaagccagggtggggagggggacccccccccatgcctccttcacctctccaccccatctcttcccttcacctccccaccccctaactttccctcaaaccccacattgatacatttaagctcagcccctttcccagaaccttggtatgttaccctccccccacataaggacaagtcaatttgttggtagcttctggcttgaaaccctctccctccatttcatagcccacttaaccacgcataacagagttccatcttttgtcagtagatgcctttttttaccccccccccccccggcttaagccttaagtgccaaatcacaaaagaaaaaaagcagtaaccgtttacagaagcaacttagtgccttgtaatctaactttgtcactgtgactacattacctcttcaacgccagggggcacccgtgggcctcccagagcctctgcccgtggggttgggggtgggggtggggtgacccgcaaccagcagctcccccagctggccacacaagtgcacctttctttcggtctcccgcacactcttcctcttccttatagttactcacctccctcagagagttgttgctggacttggggtttttttggggggaggggtctattttgactttcaaaaccttttacttcccagcccgaacccctgttgactaatcttgcctgggtttgtgtaggtctccagggacaaaggttgaacaagttggacgaaggttttgacataagtgggacttcgtgatttaatttctttctttcttttctttttttttttaagtggggaggaaggggaaactagatggactatgagagacttgattttggtgctaaagttccccaattcatatgtgacatcttaaaaatgacaacaaatgagagaaaagctaaaaacaacaaaaaaaaaacatgtaaggggtgagcagttaatggtctgcattccacatacaatatctgtgtaaaacgatttcctgtagaagtagctttaatggattttgctctagaataccttaggtctaccttagagcccccacacaatgcttttttccctgggtttaaacttcatctaactttcagaaattggagagcaaaaatgttgcttatcactgcacatcaatataaaaaagcttatttaacttatcaaaacgtatttattgccaaactatgctttttttgttaattttgttcatatttatcgggatgacaaatccatagaatatattcttttatgttaaattatgatcttcatattaatcttaaaattttgtgacgtgtctttccttttttccacagttttaatatattattcttcaacaacatttttgtaactttacactttttttggttattttattttaaaaaaatgaaaaattaatttaaaaaaatgcaaaaaactgttggattatttattttagaaattctcccctttgtgttggactgcaaattgagtttctttctccttaggcctttcacaggtaggactgagaatgtatgtataagttctgtgacagtacagaaggaaaaccaccattttatgtatagcttctaaaagggaaaacaaaaaaagagaaaaaccctttgaattccatgtgcccatctcaagacattccgctcgcagatttgtggttctggattccaggttggagttttccaatgttgacataaacaactggcgcacacacataaagatgaatgtaattattattcctcttgctggtcactaccgtcgctttctatttctctttctttgtgtgaatttatttaaaagaaaaaaaaaactttttgtaacgactatttgcagtttaaaaatcaataaaccccgtttttcaagaaatgatttgtctataggtttttccttggtctgacactccttggggcaacgaggtggctggtctttcatctttaaagctaaacccataactctggatgttgatgccttaaggtcactcagcttgggtggggcggaggtattttttatttttatttattttatttatttttttttttttttttagcaaaggagcctgcagagagcaggtccagggtatccttgctgacctgtgtgaccttggctactgtagggagctgtgacaggatcatccagtcttcccactatgaacttcctttgggggatggtcagggtgctactgataaagtacatagcccatgctgcacttgctggcttacattgactgtgtcaagggctcataggtattggtctcataggcattaacctagtcaaggtcctagcctcagtacacccctgaaccggtatgaggaagcactgcctgcctgcagaggagccaccaggatgggaaagggcagtctgcacctggatttgactgcagggctggaaagggaagatggaggttaacatagactgtataggaagtcagtagttcccatcaagggaggtggtaggccagttgtggcgcaagagttgctggaggaggctgaggcaggaggatcctgagacagacagccaggatcagggagcccctggaaagtgattttttccccctctctctttggaattttggatttttcagtttctctgcagccctggctgtcctggaactttctctgtagaccaggctggcctcaaacttaagagatccacttgcctctgcctcctgagtgctggggttaaaggcatgtgtcaccaggaccctgctggaaagtgattcttttaaaggagtagggtctgggagaattgagtcctggggagggcagagatatttgagcccttggcttcttacagttagcgagttttaagggttgagccatcttcacctttataccactgtcctccatagatctgctgcagacagtgttcaataccgcatgaattaccagtattctctggacatttcaagagttacttggtttaccaagcttactgcttgtcaggcatgtgaggtagaaatatggggactcatttcttctccaggacgggctgattgatacaggaagaaaagaggcagccctggagcttgagatgaacccaggcttttcatttcttaagagggaaaattaactgtgtggtgtgaatgtgtgtgtgtgtgtgtgtgtgtgtgtgtaatagagtgtgagtgtgtggtgtgagtctggtgtgcgtgtgtgtgtggtctgagagtgagtgtgtggtgtgagtctggtgtgtgagtgtgtgtgtgtaatagagtgtgagtgtgtggtgtgagtctggtgtgtgtgtatgtggtctgagagtgtgagtgtgtggtgtgagtggtgtgttgagtgtgtgtgtgtgtaatagagtgtgagtgtgtggtgtgagtctggtgtgtgtgtatgtggtctgagagtgtgagtgtgtgtgtggtgtgagtctggtgtgtgaatgtgtgtgtgtgtgtgtgtgtgtgtaatagagtgtgagtgtgtggtgtgagtctggtgtgtgtgtgtatgtggtctgagagtgtgagtgtgtgtgtggtgtgagtctggtgcgtgagtgtgtgtgtgtgtgtgtaatagagtgtgagtgtgtggtgtgagtctggtgtgtgtgtgtgtgtgtgtgtgtgtgtgtgtgtgcatgtgtgtgtgtgtaagcatgtgtttgggtggtagtgatgatcttaccattttgattaaaagcaaagacaattagtccatcgccttgaactcattcactttagccagagagcctgtggtggacatttaatnnnnnnnnnnnnnnnnnnnnctccatgttacctggggaagctgactgtttgtagaccctcactccaaatcccatctaagtgtttccccgaggagctcaaagcttcagtttgtccagaccggtggcttggattcctaccatctagaactgaattggaagagatgagcctgaaactacttaggaaaggaagcaacagcctttcagccccattatgtcccactatgttagaaaggtccttggcaatggccctaagcaccaggctacccggacatccaggaaatgtggtttcacagctggcaggataagacctgcagtaggagctgaaggtatggcccacacaaggggatctgtggccctaaagactaggtcctgctctgggtacaaggtcttctttcctacccctgctcaggacctgggttatctccggcttatacaagatctcctttgtgtggacacagcctcaggggtgctggctctgctggccttcctttggagcagctcaaagcgatgagctgtttgggccattgacctcctcctcctcccctcctcctcttcttcctcctccccctcctcctcttcctcttcctcctccttttctttgacaaggtctcactatgtatttttagctaacctgtaactcactatgtagatcaggttggcctttcctggtcttaatgcctcttcatcaagaggaagtaagggcctgctgggcttcaggaatgtaattgaatcacaaatccctagcactttagtagatagctttgtgtgtgtgtgtgtgtgatggcagaagaacgagccagggcaccaagaaggaaaggagctgtcttccttccttccttccttccttccttccttccttccttcctttctttctttctttctttctttctttctttctttctttctttcttaaaaggtgtctgtgtgcatgagggccacactgtgcatgtggacgtcagaggacaacttgtgggcgttggttcttcccttccaccatgtggggtccttcagttcatcaggtttgcccactgcgccatctcagcaagccgaaccaccagtctaaagggttactgtgacgattaaagaccttagagtattaactcagatgctcagactgatggcacggaggaagcgccgcagaaccccagttacattttgttgctgggataaaacaccctgatagaaaggcaatttagggaggaaggatttgtcttagctcacggttctgggatatcatcctttacagcagggaaaccaagacagcagggaacttaaaacctagtcacagcacagccacagtcgagagcagagagagatgaatacatacatgcttagtgttcagctagctttctctactgttacactgccaggattcccaaccagggaatcatgcctctcaccttcagcctgggtcttctggtatcagttaaggccctctagacaatctctcatagacatgcctgcaggccaagccatctagacaatccctctcctagactcctctcccctgggcttctaagttgtatcaagttgacaaactgaccatcacatatagccctttgcatgggagaagtgtgaaagtctcaggacctgaactcaggctcattagcaatgtcatggcatatgatcgctgtcctatggagtatcataagctggtacactaaagtcactgggcacagtccctggcacgctgtaataacagattaccagggtcagttcctgtctccctcacccttggtggtgagctgcagaagctgagaggcacccgctgtattggatgactctgcacacaccttccccgcccccccccccccccccccgggtcatgagctcatggcccaggaagctctctggattggcatgtttggaggagggtgctgggaggagggagcaggccatcccccttggactttcccctttctgcctgctgagaggtggcttctgttaatgatcaacagaccaaagggtgccctgggtgccccagggagttggctcagagcccttctttcccccggggtctcccacccatgcacgtagccaagcatttaatcatgtctggctggcttgactggaatgctacctgagttcagggggtgaggtggcagggaggtcagcaaggctcctgttgcctgctggctgccttgcagatgctcccaggcggaggtctacaggtacagagagctgggaacagggcaagcacctttggcctgttcccaaggtcaggtcagctccggggcttccactctttgatgggtactgcttgggtaagggacacctggcctgcaggtctgcattgctttttggaggagtcccaaatgggcacatcttagcgcctatctgagaaactagtctctggagagaaagcagggggctgcttgggaattgctgctgatcagcggatgagggtatctcttccttgtgtagcctgtttgtacttgttgtgaaatgttggcaaagccttggtctcaagttacagggctatgagtgacggccatacctgtgctatcagcttgtcgtgcaacaaaaataaatattggccaaacctagtgcagttttctccctacctggattctctctctctctctctctctctctctctctctctctctctctctctctctgtgtgtgtgtgtgtgtgttttgtttgcttttgtttgtttgaaccagggtttctttctgtatcccccctgctgttttggaacttgctctatagaccaggctagccttgaactcaagagatcgtccaggtaaatggaaggggaaagagagtgaccacagtgggcagattttatttcttctatccccagaactgcaagcagggaaggagctgcttctggggttaaaagaacctgggttcaagttactcttcagcctcagggtcactgtgtggccttaagacacaaggttagaaagcaatttagggcccagttttctgcatctgcagaataagatgattccagtgatgatgatgttattaaccacacctgcttcaatgggccaccatccacacagcagatgtataacaagaacaaatgataacacacagcgtagatgaattgcacaaagctgagggaggaagtcagatgcaagtgagcacacgtaggggctgagaatatagctcagttgggacagtgagtgctagccttgaatacatgaagccctgggttggagctcccaggcattgtataaccaggcatgatgggggcacacctgcaaccccatctttggatacataacaagtttgaggtcagcaggggctgcaagagaccccaagttaaaaaagaaagaaaaaagtgcatacagcatgagttggagaccaggcaaaactggtctcttatgagacaataaaatccactgagctgtggtctgaagacatgagtactttattgtatttaaattatacttcaaaacaaaaaaaggaggggggctggagtgacatctgtgaggttaagagcactggctgctcttgcagaggacctgaattcaattcccagcacccttgtggtggctcacaaccattggtaaccccagttctgttggatccaacagctatgcacatggtacacatacatgcatataggcaaaactttcatgcatgtaaaataaaataaatctaaacaaagttataattcaaaacaaaaatcttgtaagtttggtgtgagggttaaatagtatgcataagtaaataaaagaatggatggatgaatgaatgaatgaatgaattcagtaccaagctataggaaactaataaattgtggctattttggtaaaaacaacagatacaagatgttggtagctctgtggtcccccctccctttataggaggaagacattggctaagagtaggagagtgacctggctggagagggggatttgaaatcccccgcccatcctgtgttcctctataggagcactgacagcgatgtgggagcaagggagaagaataattagtaaatgcaagcatccatagcagaaattaattttcctcttggcagattcaaaataaatctcctatagctacttggtacctgtcatgattcataggaagggcaaaaggaggccaagctcggggtgaagagaggagagctttggttcttgggtgagccagctctggggagccactgtcctagaggtcacccatatgaggtgcttgcctgcagggcttgcccagtcctttgctaggactgatgaggctgtggggccttaggagtctccctggcttagatgagacttggtcctgtcttctctggccctcagacttaaacgtgcacggaaacctcttcatcctatctgatctccctctgaaatgattaaatagccatttccatcctttgcagctagatcctgagacggatgtctagcttagccgctagatctagccacggcagggttcaggaatcactgtttcagggctaaccccttctgtggactgtgtcccaaaaatcaaccttagtgcttggggaggagcccaaggcctggggacagacagcagagaggaacataaggtatccccacctggggttttgctggttcatggctcctcaaatctaccttgggcatccaatttgtcttactctctctcattccatgctgccaggcagtcgtgaatttgtgaccttgcagatggtcttgggcaagtgacgtaatctctctgagaagggaagcatattcaccttggccacatgacaggattgggggcagacaggaggaaggcactctggaaagggccctgtgcagaggtaaataaatatggtgtagggacttgtagcccttaggacggtgcctctgttagggatgcctgggagtcagaacctggctcatccactagactccgtgcaccaggctcacaggtggtatgtgtactgtaggagactgtctaaacgtcacatacttaaagtaacaggatccagcattgtggagacttacgatgcaggcccagctctggctcagcctttccttatgtgattatatgtgatggtatctttaaatactattatcatttgtcccatttacagacggggaaagtcgggctcagggagatcactatttccagtcacacacttatatgccaccagtctgtcaacaccccagctctcagtccccacatggtgagaagacagatgtcaaatggcagcagtcttccctagggatcaactcacgctcatggagtctctttctctcaactcatccattcctgatctctccatcccatctgattactctctccagcccaggaggctgtgcagtgaggagaagttggccttgatttcagcttctttggcaaatgaggaaacggaggtgcgacagggtaatggctgctgtgttaggctcagtctcaggtgcagtggtccaagcccatgtctcagatgagctgtggcatggctggtcgcggtgtgtgtcatattttctttctcaggaggatgttggctcatgaggcagggcaggactcagctgattcttctcatcagccgccagtgttacgggctctctgaaactcaaggcctcacctcatggagctaatgtcttctttgctggtgcccttctgaaagatatggtacatacctaatttttaaaatcatttatttttactttatgtgcatcagtgtttttgctgcatgcatgtctgagtgacagcatagattcccctgaaactggagttacagacagttgtgagctgccatgtgggtgctagaattgaacctgggtgtcctctggaagagcagtcagtgctcttaaccactgagccatctctccaacccctatgcttcataattgtcaagctgtattcccacagtcctcctccaccaaaagttactcttgctaaagtagggatgaaagggggagaaagatcaggttcttaggaatccttccaacagtgctgctcagggagagaagatgaaggaggccgtacagaatcagcatagccaccacagccatggctcagggctccctcgtaccccactcccatggctgctagctgggttggggatgacagcactctctgacttggtcattgatgaaagaagtcctgtttccccaagccactctcttccttttttcttgacttccttctatccagatcggaggcagggggatagcagagcagttggacttaggtaaaacttgaaatattttttggtatctggatggtctttgatccttgcttctctctcacatactacagtatcttccagaggggttgggagcagagaatgcctcttgtcacactgaagatgtcacccaggctagaaataatgcatatcaaatacacacaaggattcctcgggggaagggatacacgttctaggaaagtttatactggtttggtgcccagaagaagaggtcggggcactaggttttctcttactatgcatgcaccacatggccctggagagttggagacctaccctggagagaggcaaatatgggagttacagtggtggaactactgaacctttacaccctggtttgggacatggagggagccagacctgtcccagccatcactggttggatcttggagggtcactttctctttccagatctctttgtctttgtctatgaaatgctggagttgaactaaaaaaaaaggccttttaaagattccatgaatatcttagaaagcaaaatacacagattttccttttaggaaaagccaaatttccttcacccgtgctgagggctgggaagccagctgggtgggagttataaaaccctggctggagttacagagggagttggtgggacctgctgacatcagccgactcacacagtcaggggttctagagtttggctgtgtgcacatcctttgatggggtggttggaaccacttttatgaactgtatattgacaaagaacatgtaagtcagccccttggcatgttgtattttcccagacatgccattttcaaactaaaacactgaaatgtagggtcttattttaggtacttgcacaccctgtctgggatgtgcaatcctgtctaggagctgaactgactggcttctctgacatttgaagtacaagttactgaaggctaaagtctcagggaggtggatttcgcttcagcccatggatatttttttttttaacaagctgaccgtcaggggcagtgagtttcctcttggtggtgacagtcagacaaagctaggtgaggtggtattcggtacgccagtccaggcaggagctctgcagaatgacttctgaatgtacacccaaagcaacctcccggcttcactgccacgtggacttgttattttaatgcttataactttatgaaagtgcagaacctttgagggaggcaggtatctggaattccttacagctctgcttctggcgcagattctcgacacacacccagtgaatggcattttcattagttgaggcttctctaggaacccatcctttgcagggatttgatccttccactgtctagccatggatgtttcggggagctgcagtgtccagaagttcctgagttgtagaacttgcctaaggaatggggcatgaggcctgtggctggctctgtgtccctgagtgagtcactcaagctctttgactctcagttgctccattggtgagaggagttgtggattttcttcctgccctttccagttggactactttatgagtcaagcactctgtgtttgagctcagtcctctgttctcaagctgtttgttcaactctgctttattaggggttctaggcccattaaaacagcacaacacaaaacaaaacaaaaaaccaagtagccttgggaagcagacagtaaaaacaagtggaaacatattactgtattcttcataacaaagtgtaaggattacaactggacttaaggaagttgactatttttatttgtttgttttgagacagagtctctttacaaagc

SEQ ID NO: 890 - DNA, 2664 bp, Mus musculus
gcgccttccccgcaccgggaccttcacgacacaccagatcctagtccttgccccgtgcgaacgcccacgatgaccaccaccctcgtgtccgccaccatttttgacttgagcgaagttttatgcaagggtaacaagatgctcaactacagcactcccagcgctgggggctgcctgctggacaggaaggcagtgggcacccctgctggcgggggcttccctcgcaggcactcggtcactctgcccagctccaagttccatcagaaccagcttctcagcagccttaagggtgagccggccccgtccctgagctcacgcgacagccgctttcgagaccgctctttctccgaagggggcgagcggctgctgcccacccagaagcagcctgggagcggccaggtcaactccagccgctacaagacggagctgtgccgtcccttcgaagaaaacggtgcctgtaagtacggggacaagtgccagttcgcgcatggcatccacgagctccgcagcctgacccgccaccccaagtacaagacggagctgtgccgcaccttccacaccatcggcttttgcccgtacgggccccgctgccacttcattcataacgccgaggagcgacgcgccctggcggggggccgagacctctccgctgaccgtccccgcctccagcatagctttagctttgctgggtttcccagtgccgctgccaccgccgctgccacggggctgctggacagccccacatccatcaccccaccccctatcctgagcgccgatgacctcttgggctcacctactctgcccgatggcaccaataaccccttcgccttttccagccaggagctggcgagcctctttgctcctagcatggggctgcctgggggaggctcccccaccactttcctcttccggcccatgtccgaatcccctcacatgtttgactctccccccagccctcaggattctctctcggaccacgagggctatctgagcagctccagctccagccacagtggctcagactcccctaccttggacaactcaagacgcctgcccattttcagcagactctccatctcagatgactaagccagggtggggagggggacccccccccatgcctccttcacctctccaccccatctcttcccttcacctccccaccccctaactttccctcaaaccccacattgatacatttaagctcagcccctttcccagaaccttggtatgttaccctccccccacataaggacaagtcaatttgttggtagcttctggcttgaaaccctctccctccatttcatagcccacttaaccacgcataacagagttccatcttttgtcagtagatgcctttttttaccccccccccccccggcttaagccttaagtgccaaatcacaaaagaaaaaaagcagtaaccgtttacagaagcaacttagtgccttgtaatctaactttgtcactgtgactacattacctcttcaacgccagggggcacccgtgggcctcccagagcctctgcccgtggggttgggggtgggggtggggtgacccgcaaccagcagctcccccagctggccacacaagtgcacctttctttcggtctcccgcacactcttcctcttccttatagttactcacctccctcagagagttgttgctggacttggggtttttttggggggaggggtctattttgactttcaaaaccttttacttcccagcccgaacccctgttgactaatcttgcctgggtttgtgtaggtctccagggacaaaggttgaacaagttggacgaaggttttgacataagtgggacttcgtgatttaatttctttctttcttttctttttttttttaagtggggaggaaggggaaactagatggactatgagagacttgattttggtgctaaagttccccaattcatatgtgacatcttaaaaatgacaacaaatgagagaaaagctaaaaacaacaaaaaaaaaacatgtaaggggtgagcagttaatggtctgcattccacatacaatatctgtgtaaaacgatttcctgtagaagtagctttaatggattttgctctagaataccttaggtctaccttagagcccccacacaatgcttttttccctgggtttaaacttcatctaactttcagaaattggagagcaaaaatgttgcttatcactgcacatcaatataaaaaagcttatttaacttatcaaaacgtatttattgccaaactatgctttttttgttaattttgttcatatttatcgggatgacaaatccatagaatatattcttttatgttaaattatgatcttcatattaatcttaaaattttgtgacgtgtctttccttttttccacagttttaatatattattcttcaacaacatttttgtaactttacactttttttggttattttattttaaaaaaatgaaaaattaatttaaaaaaatgcaaaaaactgttggattatttattttagaaattctcccctttgtgttggactgcaaattgagtttctttctccttaggcctttcacaggtaggactgagaatgtatgtataagttctgtgacagtacagaaggaaaaccaccattttatgtatagcttctaaaagggaaaacaaaaaaagagaaaaacccttt

SEQ ID NO: 891 - protein, 361 aa, Mus musculus
APSPHRDLHDTPDPSPCPVRTPTMTTTLVSATIFDLSEVLCKGNKMLNYSTPSAGGCLLDRKAVGTPAGGGFPRRHSVTLPSSKFHQNQLLSSLKGEPAPSLSSRDSRFRDRSFSEGGERLLPTQKQPGSGQVNSSRYKTELCRPFEENGACKYGDKCQFAHGIHELRSLTRHPKYKTELCRTFHTIGFCPYGPRCHFIHNAEERRALAGGRDLSADRPRLQHSFSFAGFPSAAATAAATGLLDSPTSITPPPILSADDLLGSPTLPDGTNNPFAFSSQELASLFAPSMGLPGGGSPTTFLFRPMSESPHMFDSPPSPQDSLSDHEGYLSSSSSSHSGSDSPTLDNSRRLPIFSRLSISDD

SEQ ID NO: 892 - DNA, 23406 bp, Homo sapiens
cagagatgtagacaatgatgcaggtggccattgttgttgcaccttctcccattgtttttattttttattttatttttatttttatttttttgagatggagtcttgctctgtcgcccagcctggagtgcattggggtgatcttggctcactgcaacctctgcctcctgggttccagcgattctcctgcctcagcctccggaatagctgggattacaggcccctgccaccacgcccagctaatttttgtatttttagtagagacggggtttcaccatgttagccaagctgggcccaccagcctcggcctcccaaagtgctgggattataggcataaaccaccacaccgggccaacaccttttcccattgttgcaagctcctcttctgctgaactaacttatagggcatttaaagggatgaaggcctcctttaaaaaaatcaactcttcatttctgtctttttcctctttttggaaccagatattaaagactaggacattcaaaatcaattacatacaccgggaaaatttgaaaatgaatgcccatgcatgatcagagaaaggcacaggctcagaatagatctcagaagacctcacatttatacctcaggctgatccttggcacagagacagcctacaacaataattaaaaaaaaatttaccaaacccagcaaaccttggtgaagggggagaatctgatttccagagtaaccacattattagattgaaatgtccagttttcaacaacaacaaaaatcacaagacatacgaagaaacaggaaagcatggcacatccaaaaaataaatcaacagaaactgttcctgaaaaataactgatggaagatctactgataaagactttaaaacaactgtcttaaagatgctcaaagaactaaataaagatatggagatggtcaagaaagagatgtatgaataaaatgggaataacaataaagagatagcaagcctaaagtgaaagtaaaaagaaactctggagctgaaaagtacaataactaaaatgaaaaattcactttaggattcaaagacagttttgaggaagcaggaaaaataatcagcaaatttgaagataggacactggaaataatcaagtctgaggaacagaaaggaaaaagattgaggaaagtgaagagagcctaaaggacctgtggaacaccattatatgcatactgggagtcccagaagaataagagagagaaaaggggaaagaatatctgaaactatggctaaaaacttctgaaatgtgatgaaagacatgaatatgaacatccaagaagttcaatgaactccaagtaaaataaagaaacccacaccaggatacattataatcaaactctcaaaagtcagagacaaaaagagaatcttgaagcagcaaaagagaagtgactcacataaaatagattcttttttttttttttaattaaagacataaggtcttcctttgttgcccaagctgatcttgaactccaggtctcaagcaatcctcctgccttggcctcccaaagtgctcggatttcaggtgtgagccaatgcatccagctacaagggatccttaatgagattatcagcaaatttctcatcagaaattttggagaccagaggcagtgggccaacatatttaaaatgttaaaagaaaaaaaaaaatcaaacaagaatcctgtatctggaaaaactgtccttcaaaagtgatggagaaaatgacattcccaaataaacaaaagctgagggaattcattaccactagacttgtcctataagaaatgccccaagggtgtcctgcaaagtaaaataaagaacagtagatagtaacttgaaaccatatgaagaaatgaggatctcaataaaggcaattataagagctagtattattgaaacaacagtttgtaagtttactttgtgacataatttaagagactactttaaaaaacaatgattagtctaaaagcttaaattattataactttggattgtaatgccacatttgttttctacagaatttaaaagactaacacacttaaaataattattagtttatatttttgggcacaaaatgtataaagacataattatgtgacatcaataatcaaaagggatgcagatgcagctgtaaaggagcagaatttttgtatgtttttgaagttaagctgttataaattcaaattacagtgttttaactttaggatgttaaatgtaatccccatggtaaccacaaagaaaatacagtagtccccccttatctgtggtttcactttctgtagtttcagttatccacaattgaccacagtctggaaatattaaatggaaaatttcagaaataaacaattcttaagttttaaattgcatgccattctaagtaatatgatgaaatctcgtgccatcctgctccatcctgcttgggacatgaatcatctctttgtccagtgtacccacaccatatctgctacctgcccatcagtcacttggtagccatctcggttatctaattgactgctgtggtatcacagcacctgtgttcaaggaatctttattttacttaataatggccccaaaatgcaagagtagtgatgctggcaatttggagagaacaaagcagtaaactgcttcaagtgaaaaggtgaaaattctcaacaaggaagaagaatcatatgcttatattgctaggatctatagtatgaatgaaacttttatccatgaaattctgaaggaaaaaaaatgtcatagtacatgcagggttcagtactatccctggtttccagcatctactgggggtcttgaaacatatcctgtgtggataaaggaaggactactgtagttgtagtatagaaagaaaatgtaccaaagaaaatgagaaaggaatttaaatgtttcactatggaaaatcaagtaacacaaaataagatagtagtatagaaaaatgaggaacaatacaactctaaggcatctagaaaacgaataacagaatgacagaattaagtcccttctcatcagtagttactttaaatgttaattaagtgccccaatcaaaagacagtgattggcagaatggataaacaaaaaacctgatccaactatatgttgcctacaaaagactgactttagatctaaagacacaaacagattgaaagtacaaggacagaaaaagatatttcatgcaaatagtaaccaaaagagagcaggaatggctatactaatattagacaaaatagactttaaatcaaaaaaggttacaactggccaggcacggtggctcatgcctgtaatcccagcactttgggaggctgaggtgggtggatcacgaggtcaggagatcgagaccatcctggccaacatggtgaaaccccgtctctactaaaaatagaacaattagctgggtgtggtggcgcatgcctgtaatcccagctactcaggaggctgaggccggagaatcgctttaacccaggaggtgggggttgcagtgagcagagaccgcgccactgcactccagcctggtgccagagcaagactccgtctcaaaaaaaaaaaaaaaaaaaaggttacaagagacaaggacattatatattaataaaatgctcaatatagcaagaagatagaacagttatatacatttatgcacctaacaacagaccatgaaaaatataacactttcagaaggtaacaaaaaatcttaatgacctggggttaggcaaagatttctgagctgtgacaccaaaagcatgacccacaaaaggtaaaactgataaattagacttcattaaaatgaaaaacttttgctgtgtgaaagatcctttgcttggagagttaaaagataaggtacagacatgagaagatatttgcacgtcacataagcaacaaaggaactttatatatccagaatatgtaaagaactctcaaaactcaacagtaagaaaatgaccaactaaatgacccaactaaaaaataggcaaaaggtttgaatagacacttcaccaaaaagtatatgcagatggaaaataagcatatgaaaagatgttcaacatcattagccattagaggaatgcaaactaaaaccacagtgtgagactaccacatacctattagaatgactaaaacaaaaaaacagtaatactgttaagtgctggtgaggatgtggagctagtggaaactctcatatgttgttgttggaaatgcaaaatagtatagccactctggaaaatgatttggcagttttgtattaatttcaacatgcagttaccatatcacccagaaatctcactcctagttatttaccctagagaaatgagaatttggccaggtgcagtggctcacgcctgtaatcccagcactttgggaggccgaggtgggcggatcccgaggtcaggagatcgagaccatcctggctaacacgatgaaaccccatctctactaaaaatacaaaaacaaaattagctgggcgtggtggtgggcacctgtagtcccagctactcgggaggttgaggcaggagaatggcgtgaacctgggaggcggagcttgcaagtgagccaagattgtgccactgcattccagcctgggcgacagagcgagactcgaaaaaaaaaaaaaaaagagaaataagaacttgtgttcacacaaaaacctgtacatgagtgtttattgaaactttattcataatggcccaaagctagaaataatccaatgcccttcaacaggaaaatggataaactattgtataagcacacagtgaaatactatttatcaataaaaaggaatgaactattgatacatgcaacaacatggttaaatatcaaaggcatatactgcgtgaaatcaaacatacaatatgattccatttgtatgacattctgggaaagacaaaattgcaatgatagagaacagatcagtggatgtcagggactagagatggagaaagtatgaatgcaaagggatagtatgagggagtttttgaggggtaatggaactgttctgttacctgattatggtggtggtttcatgaatcaattcataagttaaaattcatagaactgtatgccaaataaagatcaattttactgtatgttaaattgaaagtaaaaaaaaaaagttacaggaatgaatgtatactcacaaactgaaataactactttgaaggaaatgaacattccatgagagcctaagagagaggagggacactgttttgtgacaaaggaaagcatcaagaatgttttccctgaggaagtgaggcttgagttgggttctaaaaaatgatttagaatttacttgggctaaaggaaggttgattcacacagaagcatttgcatgtgcaaaggccccggagtaggaggaagatggctcattctcatctaaaaaggactagagcacacggagtgccctggagggtgggagaagtgcatggggagtgagaaaaacccaagctggaataagagagtcagattacgccagactgctctaggtggggcctaggttagggtgggtggagaggtgtagctgtgggctggcctgataacttcactgacagttggaacatcttgcagagacccgggcaatcagaccccccagggcaatgctggacctgggattggattctcagtagtcctagcaggaggcggcctgctcccaaacccaaagattccagacaccctgcagtgccgcatttaccgtagaccctaaagtgccctctcctgaggcctctgccttgttcaggagaatattgacagctcagtaatacacactaagctttctgaggggcttgagggctttgagagataagatagtctggcttgtacagactaccacagggccccagtgatgtagttgttttcaaaaatacttgtgtcaataatcaggtatttttcagatgggcaacagatccccatcaccctaccctgaaccactttactctcccccaggctccaagcccagggcctctccccatttccaggcctcagggcctgtcttatccagggctgggggtggaggctagagagtgacacagatcaaacttataagttgtcagttgaccatttaatggaagtctacactgaataatcctttgccaagtgaatagccccggaatttgttttgtggtgtaataagggttgccaaatggcttagtttacatacaacagcatgacatatagacggttgcagcgagacatgactctaggcactttatgggccaaatgtaggcagttatcatgattcctatttcagagatgaagaaattgaggccttggtcagtgacttgaaaagtcacatagctagaaaatggccaagatttggatccaggattgcctaacttcaatatactggctcactgattctcaaacattagtatttgggtcgtgagatggaaatttaccaaaaatgcagattccccggccccatctgggccagggaatcagcattccaaactttaaacaaggggactccaggtgtctctctctctttcaacctgaagaatttgggggattttgcaaatgacctgaagcctgagaggaagtgcaacactgcagggctctcaggagggggtaccctgctgacgcctgtgactaggcctaaccttctggggtcctgcggcccagtgctgcacactgtcatctgccttgaggtgcgcctggggtccagattggccgatgaatacgtacacccgcagcgcctccttcactccgaagactttcactttcccccttgcacaaaaccgaacatcccaccccaccaccacctccaagctaaaatacctgggccgcccctccccacgaagggacgcgctccaggcgaatggggagggcccggaagtcgggcctgggacagaggagccggcccaccgcctcccggtcggaagcggcagtgcaggtgaggcggcggccagcctggggactgcgcgggtaaggagcgggagggcggaatgcaccgcgaagttggcgggggacggccacgcacgcctcgcctcggccttcctgcaccgtagggccgccctcccgccacccctgggcacctgtcgaccacgtctgggcgagggcgggtcggctcccgccctcgggccctcaccgcggcggggacgccgggtcagcgaagggttaagggactcgctccctcctctcggctccctcacccttggaaagtccccgaaatgacgtttcaacccgacaatttaaaaaagagtttaattatagagacaggctctgggagctggaacaaacccttggtcggcggggccggtaaacaactcgggagcgagcgggctaggccagtcgcagccttgcggagcccgcgcccccggggagagggggaggggagggcctccgggagttggaaaagccgaggaaattcgaggaatcagctttctttggaaaaatccactttgtagccattctggggcgcctgatggtgctcctggccggtcccgcagccttggagggaaagcggcgccgcccgaagcaggggcatagccggtgccccgcggggacaggccctgggccgggaagggggccccgcccgctcccagtccccttcccctttgcttttttccagcccctcctccggtccccccagctgagcttcgcgaaccctcgggagttaaagaccagccggcctcttttttggggggggtggggggtgggggagcgggaatgggtggaggccgggggaataaaaaaccgaaatagcttcacatcagaactcagactaaccttgtggtttcaacgcgcactctgctctgtcctgaaatctggaactcattacctcatcaccaagaaactgcacgaaatctctcccccaccgccccaacacccacttgggaaaggaacgagcaaacatccctctaagaaagaaacctacacttgaatgatttaaattaaggtggatggaagttatttccctttctggcgcttgccagatttcaagaaaagctgaaaaatgggagcgggggagggaagcaacagacggctggagggcagcagcagaacaagcgaggggcagcagccgagttaaagtgggggccatccatttcgggcagaggagacaaatgaaagccgaccccgctgggatcacgtaggttcgtggctgcagcaaaagttgggtttcacaaagttgaaaaacagccggtttctcaaacaattgtgatttggaaggtttcgctgggtttgcccagatgtttacgaataaataagaaatgcagttttaaaaaaaagtgtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcggcgcactaaattgtgccgcgctcgcccccgccagaccatgtcctcctggggaaaaagtttccctagtccccccagcagcgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaaggtaaaggggggcggagcatttgcttttcaaaaagtctttttcttttgccttaagaaagaacccccaaaagtttgggtcttggaaggcaatggggaaagtggtgcagcgagatgattcttttctcctccggcatttctcccaagtttgaaggaatttggccccgtccttcccaccctttgagtttcaacagttgctggcggggattacatgtgaatctggaggccagggttttgaggggcgaagtttgcctggcagggcagcccgggggcttcggggggagggctgggattgggacaagttttgggcgatcctgttttacgtaacgtgctgctggatcccaggtttgctggtctgatcgggttcccagtctgcgccctaggtctgtccagcggcattacccacccgtggggttgggagtgggaggtccctcggggaagtgagtctcgggacaatgttttcctccactctttggggggagctggggatatgcgaggaagaaaggccaagttgtgattcaaaaagatgttgcagaacaagtttgcagtggggcttgagtccgccctagctccgttgggcttcttcccgcgatagccgatcgtgcagcaaactttggggtgaaagaggcattcaggttgacccgcttacctgtgttgccgaggcattgcggctcatcgattgcgggcggggttggggggggaggtggcgacaaaatgctggcttgaactcgagagtcccgcgagtaaggatttaatggggggctccttaaaacatgttgcttgtcagccagtgttgaaaaagcaagttttaaactcggaatgttccaggactgcggtttaaatgtacatagcaaaagtctatggatgttgttaaatttctttccaacctccccctcccaatttgaaagggtgaagctgctgggctactttttaattgctgaagtgttttgccttctcttaacacgtcgggtcatgttgctctgttttcccagcttgctgctcctgttggtgcagctgccaacgccccagggctgcagggttggggtgcagggacgccgaggagctgaagagtagcatttaaaaagtttgaatttttcagcttccttccctccctgcacattcccaaactccacttgccagcccggctgccagcgctccccaacatttcttccttcttttctcgactctcccgctctttgatctatttctttctttggcccccctcccccctcacgactttttaaatgaacctcattgttgggaaccagctctcgactgggttcctgtaatcctctcggtggggtggttgcagttacagattcccggtccccccctgctgatcctaagggaccaacattagaatttgcacaatgacacccacatgggctgggaactaactcctaggtccctgacctgcaccatttccaaatcttgggtacaatttgggcaggtgaccagggtcctattggaacagaaacctgccattggtggctctgcccccatccccaccacccccaatccgctattgactaggaggtgggtaggggggttggtgctttccttttcctttccatctgcagctttgcgttaaagattaaacactggagctcttatccaagcttgctcttgcagccaaaagactaattgcaaaggcatcttctcagtgaagggggcggggtgggctagggctgagtggaaatggtgagagagattattgtagaaaatatctcttccgggaacttagggcaaagagttttattttcaggaatcacatccctgtctcccccaacctcagaccaggcccccaatctcctccccacaagaaaaagcaaaggcagtctgaaaacctgttgccaaaggaagggaacacttctgaaggaggaagttgagagtcttaggccaggtcttgaaggagggggtatcaattaagcagagactgattggaaggggacctaacgtagcctatgatagactcctttctgaggtttacctgtttttgtcgcgggcggtggcgggggcggggtgcggtaatctagagaggtctgggttgtgtgagatattttgagttgaagaatctatttgactagtaaaaaagttgaactttaaagtggtagctttggggacagaggacatgggggttgcattgcaggagtcagcatggagcagggtgcttgtcacacagtttggatcttgtggtttcttacgcatggggccaaaataaacccaggtgaatggcctatgggagggagagagggaagggagcttgctagagccgaggtagagatgagttctttgagaaagagcgggcgtttgtgattgtgtagggggctgcccatagtggacatcctggtggatgtcctctgtccttaccatcctttctcttctctctccagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccccacccccccacccctgccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaaacattgatggtggagctggttttacttggttttggtttgactttgccagtaaggttctccccttgtataccttgcaagtcctggggagggggaggcggagagagagggctgtggctgtgggtggcggcatctctcatccctataagctaagcctatagctcccttccttgatgctggcagtttgctgcacttagaggggacggggtggaggttttctgcaaaggagcctgtacttcctgctgtattacttctgaaaagactgtgcagtgtgttagttgttggctgaatagcagcgggcccagccttgccgacacttgtgtggcctctgcggttcttctggggagccaaggctcagggccttccagtccgccccgtccagcctgtgctcttcattcctttggatggtgtttggggtgccaaaatgataaaagaggacctagcacttggcacacttgcaggcttggatttgagtgagttcttttattggggtgccttgggctcattttgcccataagaaagaaatttacctcagtactggcctctcaacacctacccgtgtggggagggtataaggaagcactgcctgcttggagaggaatgtccagcggggtgaggggctcagtcacaaggaactgggaactgggactggatttgacatagccttttgggtttggagggctgttaaggggaagtgagtgttaacactggccaacacaacacagcaagtcaccaagggttcccaccaccttagttacaatctcaggtgctatgcaaaattaggtatgtcgtcatcttgggaaaggtggggtctccttggctagatgcacccccaccaaggctagatgaccacttaagaggtggcatttcacccgccggaggagttggaactttcacaaatcttgagtgtgagccttgggaggatttatttggggagaggcagagattgctatttgcagctcacttgcctttggttcctttacacccaggaagttttgggagttcagctgagtcaccatgattccaccaggcctcttccgaaggtctgcagcagacattgggcaggccagggatgtccctgagactcgaagacctacctctactctcaactcatttccctggtcatcagatatctactgggggtcagggggtgaggtagaaaaatagggactattacctgttccagggcaggggctggtggtttaggaaggggaaaagcagcccttcttaggactggagtaaacctaggcctcttgtcccttaaggaggaaatgaactttgtgtgtgtgtggaggtggtggtggtggtggttggtggtggcatgtgatcttcctttcggagtaaaagcaaaaaagacatttaatcattcaccttgagctcattccctgcaggcatacctgagcatgtggcagacacctttctaacttcccctctcatggtgacgctggttaggttcctagaggcccaggcgtacctcctggccagccctgaatttcctctagaggagacagtcctttgactgagtcagtcctttgactttgtctaaccaagatagagacattgactactggaggccctggagggtgggggttggctgtaaagcccaggggagactccttatcatgtggggaagctccatgtccccgggtcttaaccctttacctctacctaagtgtctccctggggaactcactcaggctgggatttaggtaacccaggcccatgtgtggtggccacaagagcctggttgtgtcccattgagtccttaaagttagaggagatggcccttgggaaagggaacagcagaatatttcaggcccattatttctccaggatgttagaagaaggggcctcagcagcagccctgtgctgtagtctggcagggaggccagggaagtgtgagcccagaactggcaagaaacccctatctctgagctcctctgcagctaggaaggataggaactatgctgagggagttgaagggaaggctttcacgagggaagtgggtcaggaaaggccaggccaatcctggggcacaaagccttcttctccaccccttaccctggaggccagggtgtcttgaaggctgggtttaggggcctgcaccaggtctgccatggatgggtggggcctctgtggctactggccctgcaacccactctctggctgttggatgaagatcttctcttggagcagctcaaagaaatgagctattttggccaccgagcaatgcctttcctggcctggaggcctcattctcaggaggaaggctatggttcagtgacactcatgaaaggagggctttgagggccaactgagattgtgggttagtctgaagatgggttttacagtcaactggatcacgaagcactggttaccgaagaggcaggggtcatggcaggggaaggatccagggcgtgaaggaagaaggggtgttgaatggagcccttggaccagggttcaaatcccagctccccttctaccagcttgtgctttggataaatgactcaaccttggatttttcagctgtatctcaaggagttactatgagatcaagcgagccattagtcatgacagctctttgtaagtgccaggtagtcctctaagaatttcctgtgtgttaactcattgaatgatcataatgaccccacggaggaagctctatactgttccttttgtatagatggagaaattggggtgcagagaaattcactaatttgtcatacagggagtcggtgtcaggatttgaacccaggcaggcgacctccatcactatgctagagtgttgtaggctgggacactggagcagtccctggcacacagtaactgcaaatcaatcagtgttagttgccctctcccttggccttttgtggagattctgcatgaacacaggaggcaacgagttggattagatgattctgcacacaccccctccgttgagtgccatgacctcacctcccatgaggccctgcattggcacatttggaggacggagtctgggaggagggggtaggccatccccttggactttccccttctctgcctgccatgaggtggcttctgttaatgatcaacagaccaaagggtgccctagggctgcctcagggagttggctccatgcccttcttcccccggggtcttccacccctgtgtgtagccaaccatttaatcatgtctgggtggactgactggaggctacctgagttcagagggggaggaggtggggaggttagccaggcccctggtcacccccttgctgccttgcaggtggcccttctaaggcctgccacttgcctgctgggcagaaggcagagattctgaaggttggaaagcaaggcaaaatctcagccttttcttgaataaggtcagcactgggggtctcacctcttgataggtaaggctggtgttgagaaacctggcctacaatgctttctgtgggagtcccagatggttacagctgagttaccatcatagaaaaccagactctgaggagccagggcaggggctgcccataagagccagctgctggtcagtggacaaggatgcctcctccacattgaagctgtttgcagttgttctgaaatgttggcaaagcccaggtctcaaagtacagggctgtgagtgatgactgtacctgtgctatcagcttgggttgcaatgaaaataaatatgggcaatcgccaaaactaaggcaattttttcagcacctggagccaggcaggtagcttccccctgactccaaatgtacctcagggagaaggagctcatgaccacacaggtcagcattcatttccgccaatcccagtattccagagctatgggaggctctattgtccgtggtaaggagctggttttggagttacagggacctgggttcaagtccctgtttggcctcaaggtcactctgtgacttcaagctaaacacttagtaagaagttcagatcccagtttcctcatttgtaaaataggatgatggtgataatgatgatgataatgacacctaggtcaatggataaacaaacaaactgtgggattgtcacatcatggaatactatgcagctatataaaagaacaaataactggtacacaacaatgtggaagaattgctaaaacaaagttgaatgaaagaaaccagccacaacagagcacatattgcatgagcccatttgtatgaagttcataaacaggcaacagtgatctatgataattgatatttgattagaggatagagaatacatgtaaaagttcattgacctgtgcactgaagatttgagcacttcactgtaagttatacttcaaaaagacaaacctatacagttgtcgtgagtgttaatacatgtaaggaaaagaaaaagaaattcagtacctggcccattataggcacttaataaattgtggctggtctttgtaatagcaacaactggatgatgcaggtactgttctagtccccttttatagaaggagggaatggtctcagagcaggtgagtgacttgcccaggggatgtggggcttgaatcccaccccaatggctctcaagcttgcacagtttcctactacctaatactgtccctcagtgaacaggtgctgtttctgcaggaaagctaaatttgcagtaacccaggcacaacgaagttgactaattagtaagtgtaatcatctgcattagaaaagtttttctttttgcagatttaaaataagcctccttgctagtcagtacctcctacgccctgtgggaggtaaagggaggccgagttgggggctagctgggctctgagcggccggagagtggagagccttgactgtctggtgggccagcatccagaagccactgtcctgggagccacccctgtgggctgcttgcctgcctgtcctggcctatccctcccctgggctgataagggcttagaggggccttggggaagggctgcctggcccagcccctctttactggccctcaaactcaagggtgcatggaagccttacatggctgtcgcagcaccacttccaccctctgttccattctacttttttgggaagtggtccttggagctccacaggaagatgttcagctcagccagtagatccagccaccccaaggagctgggagtgagttcttgctgggctgacctcctctgtgcagtgtctgcacaattggctcagcctcagtgctctaggaagggcccaaggcttggggtcagacagcagggcaaaatttgaagagatacttactctcagggtcttacgaatgagtgtctcccgaagttgcacacgctaggcttctgacttgctttattctcattccagccctgtcaggcggccctggatttgtgatcctgctcagccactttcaagctgtttgatcttgagcaagttgcttaacctctctgagacttgtttttctcctctacgcatggggtacaggaagcatactcaccctgcccacattatagggctgtggtgaggatcagatgaaatggagaggaaggagctctggaaatgataagaccctagacaaaggtcatattgagagtgtgggagcagcttgcagtcctcagaatgacagagcccttctctaaagatgtttgagtatcaaaacgtggtgctttgccaccttggctcactctctcgattttctgcctcaaactcacatatggtgtgtgcgttataggtggttctcttgaatttatatagtaaaaataataacatgaaccagcatttgtgaagacttaccatgcacactgggggctgggcctccgtcacatggttacgtttgatagtacctgcgagtcagtgctatcattagccccattttacagatggggaaggtcaggctcagggagaactcgctattcccaattgcacagctgtataccactgagccgggacccaggtctgttgggctgcaacacccaggctctcagcctccacttttaaaaggaggcagatgtcaaatggcatgggccacttaacaggtccaggttccgatgttcaccctcccctggggacccatagtcatggaggagaatttctcctctcagcccgtcctttcctgagatgtctccatcacatgtggtcaccctctctgcagcccaggggcctggggtagtgagcagaggttgggctcgctttctgcctcctttacaaacggaaatgctgaggtgcaacgtggtgttggcaactgcgctgggctcacctttgggtgcagcagtggctttgaagccacgcctggtctcagtggtgctgctgcctggttggggtggaggaaaccatattttatcactcacaggggtgttgtcttgcatgatgtgtgatcaggagggaggctgctaagggctaagctgattattttctaatcagttagcagctttatagtctgcttgaaacttgtgaccttggggctggctgtagaaggcaccagcatggttgctggcatcggtgttccctcttttggtgccttgttttctgagagatactgtccattatgattaaactgcattctagcagttcctctccattcaaggaagtcatttattcctgcgattgcagggctcagagggggaaaaatggtagattctcagagctccagccagcagcagaagccagcaagggaggaggaaggaggcacggccagatcagcacagccagcgctcagatcctcccccagctgcctcaagctgggggaaggagggcagggctctgaggcttccttcattggctcaggaaggcctgtctcctaaacagtttttcttcctttgttgctaaccattttactgggccagcctagagggctctgaggcattaggagcagccaggcagttggttcagtcagactattagacttgggtaaaagctgaaatagtgccaactttggtgttgtccctaacccctgcttctctctgtgcatcctgtagcttttgggttggtttggagcaggagctgcatcttcccacacaacggatgacacctgcaacccaaacaatgtgcccacacttgaatggaaaccccttcagcagcgtatggtgctggggaccttctggggagatcgctggagtgcaggttcacatgaaagggagttagggagctgggttttctcttcataagtatgcactaactatctctggaggcttagaagtccatccccacatacaagcaaacctggggcttacgcattgttgcagctgccaccagtttggaggctgaagggaacaagtcctaccctggccattgcttgctgatgaaacttgatggtcactttctatttccaggcttccattttcttctctgtgagatagagggtgggagccaaagagtagtttgtttcatgattccatgaatatcttagaaagcaaaatgcacagagccaaatttcctttgccatgccgaatgacagggcaacggaactggcagtgttgttgctataaaaccccaactagagttacagacggaagggagttggtatgtcctgtcactgatgtcaggtgactcacacagacgggtttgggactctagaagctggctgtcggaacatcctttgaagtggtggttttaaacacttttatgaactgcaggctgaatgtgaacatgtaagtcattctcctggtatgtcgtattttcccaaacacgctatttcaaattgaagcattgcagcaactgtcttaatttaggatgtgctttgcatttgaacatgctacttattagctgactggtttttgtgatgctcagagaatgagttactgaagtttgaagtcacagggaggcagattttggctcagtccggggaagacctttttaagacactgagctggcctttggaggtagtggagttcctgttgttagtaatgttcaaacaaaagctaggtgttccccctacccgactctccctctcctgggttagggacattgcagagtgattctctgacatcctatccaaagcagccccctcctcctcactctctatctaccattctggtttaatatttcagtacttattactctcagaaagtgccaagttcatttaattcttgacttgtctgtcattatctcatccagcttgaaggtaaatctggtgaggcaggagcctgggctcttgttaatttttttgttttgttttgttttggtttgaagcagaatctc

SEQ ID NO: 893 - DNA, 1017 bp, Homo sapiens
atgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaa

SEQ ID NO: 894 - protein, 338 aa, Homo sapiens
MTTTLVSATIFDLSEVLCKGNKMLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELCRPFEENGACKYGDKCQFAHGIHELRSLTRHPKYKTELCRTFHTIGFCPYGPRCHFIHNAEERRALAGARDLSADRPRLQHSFSFAGFPSAAATAAATGLLDSPTSITPPPILSADDLLGSPTLPDGTNNPFAFSSQELASLFAPSMGLPGGGSPTTFLFRPMSESPHMFDSPPSPQDSLSDQEGYLSSSSSSHSGSDSPTLDNSRRLPIFSRLSISDD

SEQ ID NO: 895 - DNA, 111252 bp, Mus musculus
  misc_feature (1)...(111252): n = A,T,C or G
ctcaggaaacagttccagtcaagcagaagatgaagtctggaagagactgactcggctgctcaagggacacagtccacttgagtgtctccagcctcactttccccaaaggctcaaggacttatgaattgtttacgtagaccacagcaaagggaatggcttctgtctgatagggaaactgaggcagagggctgggattttactaaaaccgtatttcctatagcaaataactcatagaaacattggaagtggaaaatgtggacaaagggctcgaacagagcagagaacagtctgtcagctcagagaggtgctctcgtgagtttcagagaatgtgagctcaataacccatttgctattgggtctgaggaccaagctaatttcagccttttgggcctagaaaccctaagaaattttagccttgttgtttgctttctgtcaccatgataaacaccattatcaaaatataacttatggaagaaagagtttatttcatattacagcgccaggtaacagtttatcgcagaaggaagtcagggtagctcttggagacagtagccaaagcagagtccatggaaggatgctgcttactagcttgctctccctagcttctggtgagctggctttctttccagcccactccccttggtgagggatgatacgccccacagagtgccgggccctcttatatcaattagcaatccagaaaattgtgccacggagatgctcacaaaccagtctgattgatttggtcaccacattgagactcttcagatgactctgggttgtgtcaagttgacagctgaggctaactagtgcgacatggtttttcctatctccttctagccttctatggcttgaagttgaatatcctttctccaaagagcttaggactacgaagtgtttcggatttcagggtccccacccttgatatgggagtacttacatatacataatgtggtatctcagggatggagggagtcaaagtcttaatacaaaattaatttctgttgcaaacacacagcctaaaggtaattttacacaatatttttagtacatctgcatgttgactgcagtctatcatgtgaggggaggtgtggaattttccacttgtggtgttatgtttatgtggtaaaagtttcaattcagggaacacttcacattttgagtttcactgggcatggtgatgcatgcctgaaatcccagcatctgcggtgctggagagatggcttagtggttaagaacactagctgttcttctagaggacctgggttcaattttcaacacccacatggcagctcacagccatctgtaactgcagtccccggagagatctgtagttttctgtttcctttgacaccaggcacacatgtgttgcactgaattacatgcagacagaatacaaatacctgcaaataaataaaattccagcacttgggaggtgaaggcaggaagacgagagttcaaggtcatgcttagcaagaggtgttcaaaggcagcctgggctgtatgagaccttgttataaaaatgaaaggggggggggtgctggagagatgaagcgattaagagcactggctactcttccagagatcctgagttcaattcccagcaaccatatggtgactcacaaccatcagtaatgggatgcaatgccctcttctggtgtgtctgaagatagtgacagtgtactcatatacataaaataagtaaataaatctttaaaagataataataaacaaacaagcaaacatagtgtaggagttcagattgagggtgggtactcattctgtgttcaaatgattactgtgcctctgtggtcttaggaaacgtccataggaacccattaaccacccttataaaggaagagaacccaggatacaaagaaggaaatccccagattggtggactagggggcctcacagtggttttagtttttagtatcttataggtcctatttgtctgtgtttcctataaggctctgaagggcccatacctcatattagggcaaagagaatgagtgactatttagaggcctgttgtctaccaggccctaggctggcattctgtgttttttgcctcacttcaaatgtcagtccaagggccagggctgtggctcagtggaagagtacttgcctaacaggcacgaaggcccaggttcagccttcagcagaaaaagaaagaaatacattgattttcagttgctttgacaaattcaagtccagttcatttcctctcagattgtgcccgtctgtgactagctgttgtatggccagagtctacgagaggaagtcccgggtctgaccccagctagggcatttgctctttcaaagccttccagaatactgcctggcatggagtgggtgtgtgtcatgcattcccatggctctcaggcatccctgggcccccttctttcccagggaggtttgttcttctacctagagtaaggctcactcaacgacaggacacctgtggctcccagtgactcacagaaacagctgccctgaacatgaacatgaacatgcgtcctggaggaggaggctgcggcaaagtaggaggtgatggcctctctcttgagcagctccgcagaaaaggctgacttggtgaagaagcttcagggttctcctctttgacaccacctgagcaaatgtcttgcttgggtttcagtcccctaccctctagcgtgtataatggcaagaactcttcccacagcctctgctctttttgtctttgcagccagaaaaatccaaaggatgcagaagagagtaacagctgggcctgcaggagaggtcagcatggtttcccagttgactcttcccactttgcccttcatccatcatcttgcctccattttctctgcacacataactccagggaatgatggggaattgaacccagggctccaaatacactacgcacgcctccaccatggagctacacctccagcccaggattctgttttggcttgtttggtttgtgcctttttatgttacccaggctcatctcaaactcagtcttaaatgatcctctggtctccatctacactttagttgcgctatgggtctgaaccactgggactagcgaaagatatatttcttttaaacttccatttgaaatgtcagctgatgcacggaggtataagactttaaccccagcacccaggaggtacaggcatgtgggtctttgtgaattcaaggtcagcctggtctacatagtaagttctaagctggccagggttatacactgaaatcttgtcttaaaaagaaagaaagaaagaaagaaagagagagaaaacaaaatcaagtgaactgtcattcaaaatagactttatttattcagctggctcatttctactaaagcaaagcaaaacaccttccactcagagacaagcagtcctcacaaccaaccatccattgaacggtcactaaacatacactgtctgttttaagagacagagggttgtgtctaccttgctggcctttttgctttgctgagttttgcttttatatttgagataacatgctgctatgatgctaagtcaagccttggactcaagatcccctgtctttgtctcccaagtgccagcattagagatttgtgacatgacagcagcctcttcactgtgtgtttgtgtactcatgtgtatgtatatgtgtgctgtgtgtgtatgcatgtgtgcatgtttgtgcatgtgtgtgcatgcatgtgcatgtgtgttgttgcatgtgtgtgtgcatgtgcaggttagggtcaggggttttcctcactctaccccttacttcaaggtctcttactgaacctaaagcctgctgattcagttagatgggccggcctgagagtgcctggaatccttctgtttctgtctcccatgtgctgggatgatgggtgtgtgctaccaccatgcccagcttttacgcaggtgcggaggaccaagtcctcctgctcacacagcaaaaaatttattgaaggaaacatctccccagcccccttttcttcattctttatttatagcacagtaccaggcacagatgagtgatacctggtgagtgcatgaatgaatgaaggaatgaatgagtgacatgtggggaattagtgaaatatacatggcaaatagagaatgaattactactggactctctggtggcagggataggtgctatttattaattcagatgatcaatagcacataaaaagtcttacccaaagagagcccactgctaacccaccatattttagaaaacaataccaggtggtaggaggatatgaaccaactgaaatcctcacttcctgctgctagagagtaagttattacagccaatttgaagagctgtttgacaacatttactaaaatgaagcatatgccaaccttgtgacctagccgttatactcggagacatacattcaagagaaacaaatgcttatgtttatcaaaaacacacaaaaatgttcatcgtggctttcttcatggtagttacaaccagcaagcagtgaagatgcctgcagacagttactcaggatatacttgtataatgaaaacacacacacacacacacacacacacacacacacacacacgagctgtgacacaggactggggacataactcctttgatagaatgtggactagcattcacagggccctagtttgtttgtttgttttaggatttatttatttattttatgtatatgagtacactgtagctgtatagatggttgtgagccttcatgtggttgttgggaattgaattttaggatctctgctcactctagatggccctgcttgctctgctctggtcatccctgctccggcccaaagatttattgttatacataagtacactgtagctgtcttcagacacatcagaagatggtgtcagatctcattatgggtggttgtgagccaccatgtggttgctgtgatttgaactcaggacctttggaagaacagcctgtgttcttacctgctgagccatctcaccagcccccaaggccctagttttaattcccagtagtgcatatactgggcatggtaaataaagaagttcagggtcaacattagttacgtagaaaattaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagacaaccaacgctggacatgtgaaaggcaccccaagtgtgttcaaactcaacccacggtcctccccctaaaactttgtatctcagctcacgtggtcaaacttcccacattcaccaaattttccaaataacaaatccttgtcagttctcggcagtagagagagagattttgagtcaggaaattcactgtcatgaggaggctgttgtggctaatgtaggattcaaatagcatcctggctgctatcaactagatgtcaataatcacaaccataaaatgactctgccttgaactcagagatgtgcctgcctcgtcctcctgagtgctgggattaaagacatgtaccaccactgcctggcttcataaaatgattcttgacattgtccttggaagaacagagcttaaaatctactaggattgaaagtcactagattaaaggcatgtatttaggtatcaccgtgcagcttgaacaagtttctactttttcaggctctggtttattttctgctagatggaacttaaatatttgttacaggtaaacctcatggtctgttttatagtgtaccgtgaaaaaatttgcttctctttatatccaattaaactcctgtttgtcgcccagaattgtctctattcacatctttcctaatacagcctggtttcgacaacaggtcttttgggttgcagccagctgtttccctctgacttcacagggcacactaggccttccctctagccctgttttcctttctctgttactgttcgggtctagctaccttgagatggtagacgcggagtctcctgcgcctgtgtgcttgtgtgctaacttccctggttcctctgcctggaataaggacccaagctcatctgactctcattccttccctaaagcttactcaggttctacctggagtcttcctcccgacagggctcagggctcttccaggttctgtagaaccacatcggatctccccgtgcttctgtctcatttgggcacatctttgcttccaagtctgtctctgatgtacttgtggggaaaattgtggatttttcatcattattaaatacacaggatgtctagcttgttccccgacacgcagaaggtattcggaaaatatttatggagtgaatgagcagatagagcaccattattgctctctctgttaggtttagagccatagtttagaagtgcttataaaatagtccataaatctgctgtctctatcccagaaacagttgtttccttggccgagagcttagagaagacacagtgctgacggtaacaatggcatgaacgtgtgtggctgactcgtgactgggggatctgtttacatctccaccattgtgtcctctgtcaaccagaggtactttttccccttccatctgaccattgtgggcttcaactaccccaattcagaactctttctgtcagtaaacatctaacaagtaaacctgttagaccacactagcctctggattaaacagtcgtcctacaaatacatctggcctcccttttcacatttcagaatcttggattgaactaaccacagattaaaagtatcctgagggctggggattgctgaccctggagacttcattttcctgtcaggattttctcaacagcgtgagtagtcacatgacatttcttttccttttatgttttcccccccccctttttctttttggctgcatgcacatctgtgtgatagtattagaagccctggaactggagttacagataggactgagctgccatgtgggtgctgggaattgaacccgggtcctttcctctgaaagagcagtcagtgctcttaaacgctgatccatctctccagttcccgagtcacatggcttttctatttgggaatgatttaaagtgtacagtggctgtaagtaggttacatatcaatcaattttgtgctgttctatacatgtgaggcataagctcttgcagattctggtatctgcagtggttctgaaatgagtcccgagtattaagggatgcctgtataaattaagccctactggtacaagagggatgtatctgttgtccacaccagaatgcaaaaccaactgcaggtttccttgttactgattttcatactcagagtccctcaaaagaccactaggaatccgggcggcttcttcccagaatgcaacagtgctggaccaacacatttccaccctcctttactgagcccagggagtaccgctagcaccaagcagtttagttagtcttgcgctgtttcttcctcctccaaggataataaggttttgtcaggcacaaggttacacacaaaatgggcctgtagagtccatgctggttaagtctcttgtctagctctgctctttgagtctcagtttctccatctattaggtgtatgcatctgctaggtttatgatacaggtagaccattttagggctcttcctagtttcagcaaagtgtaggtagggaagctgtaaaagtggggaaggaggaaactagtctccagaaggtagcttcagctgtgttagtccaccggggaatacctgccaaggaacctgggaagccggacagccaagctgccacacaagaagtccgcagcgggccagtgcacggaaccctagagaagtacccaaggatccttggcgaggcgggaaactcagtgggctgagaaatgccagctagccacaaatctggctctagaaggacagggatcagcctggtcccgaggggcggggcgggagcagtggtggaatcaggaaattcctttctactgtgggccctcccaacccctttccagggtgccgacttgtcccaacctagtttccccgagaaagagaaaacgaaatatgccttgggtttccccgcgccctgctggggtttgtagcttgcgtgggaccgcaggaacaccggtgcgccggagttctgggccttcccgccggcagggaacgggaccaatcctcagcgactcctcgggctccggagcacagtgccatttggtccccgagctctgggaggcgtccccaggctccactccggttcagcttaaggtggtgtcacatgagctgcgggggagtgggaacccagggagtgggcggtggcgtgcgcgcccggagggggccgcccagtccacctatatgcacagagacccgcctgacggatgccaggaattcccaatgagaggcgctggggggaagtttgggcaactcggcctggccaatggagaacctcgggagggctctgccccttctccccgcccccgcccgcctctgctcccgcagcgcgagtgttcactgagagcagtgtgcgtggagattaggtccgagcgcgcgccccaggaaggcagtccgcgagctccagccgccgccggcagcagcagcctctgcgaacagagccgcggcggaagcgggcgcaggggagcgagcccggccccgccagcccagcccagcccagcccggcccagcccagcccagcccagccctgccgacaccctccccacacccgggcagcagccgccgtcgcctggagtagaaggtggaggaagaaatccagctcctagcacgcacgcaccatcatggaccattatgattcccagcagaccaacgactacatgcagcctgaagaggactgggatcgggacctgctcctggatccggcctgggagaagcagcagaggaaggttagcagccacccccacccgctacagccctgagccctgatccgctctggccgctgcactcctgggctccgggttggaaaccaattcccggcgcgcaagagcggaggcggggacatcgcggccactgcgaggtggggtattgagttacaggcaccgggcgggagagcggagcacccctgccctggagcccgcgaacagttcgccgcggcgcggggaggtggcgccgccggagggcaaatcgcctcagagcgggtggtccgggccaccccggtgcagccgaaactgtctccccgtgggcaaggcgcgggggcgatgctccagaggctggggctgagacttaggctccatggctgcttactcgggatcgattttctccttccttctttttcctggcgcctccatatggcgtgcggtggcagcacgcttcctgggccgcccctggggctctgtaccataggggcaagctgccccgactactgcgccccgagctgggtctgcagacagtgggcagagccggtgtcggagggtttggcgacctcctcgggatctacctggaagtggacgttccggagtgcggctggagctgagaatcgggggtcgttcgcgggctcctcagggccttgtgggggcggggtcaggacggtgaacggttttattgctaactcagtgaactggtggctgcaaaccctcacatctgtgttctgcccggttcttttgctggcgaaacgcgagtttgagtagcttggctctagttgggctcctggtggagagacagtctcaggagatatttggggttgttctccgaggatccacggccctgtatcctagtcgccatcagcaaggttcgggatatgctgccccgtctgagctgagaaattggcgatgggtccggagcgtaatggctataggcagggnnnnnnnnnnnnnnnnnnnnnnnnnnnctataggcaggaagaggtcagaaacctctcttgcttggggagggggagacattaaccctgtcacggcttcctgcctgagcagagagcgcgttccttaggcggccacgtaccctgaccccccaacacccaactcccgttcagtccccccccccccacttcgtgatctgggaatgggggggggggtgtacaggatggcgcgtccctctggatagtgcggttagggctgggcttgagggagaatgctcatgtccaaaaatggtaacattcattcccttttttaaacttaaaagggggggagtttagtgagccggctgaaggttttttttttcccccagctaaaggcatcctgtattagctcactcaggaatcctaagccctgaaacggtgcccttttgctcacttcatcagaccagcagaggtaatttaaaacacaccacaatgggcttccttaaacaggcaacctggggccctgcccctgtctcttactgcaacagcaacttaagagcgtctcttggctttgaactgacttctttgtaatgtattagtagcttacagacaccgccctcttcctgtcagcccccccccccccttttctggaaggactgagggctgagggtctttcccccttcttcactctcgaatttatttcctgggactgttgatggaagagaaaactgagtgagaagtttggagatttccagggaggacgagagatgccctccttcccctgcttctttctgtcaaaaaaaaaaaagtttcttaaagtgacttttttttttttaaagtgtgcattgatgttttgccagcatgtatgtccctgtgagggtgtcagatcttctggaactggagttacaggcagttatgagttgctacgtgggtactgagaattgaacctgggtccctggaaagcgcagctgatgctcttaacggatgagccatttctccagagttttaaaaaaaaatctttcttaagaaggggttaggattagaatggtggaaatcttaggctcttctatggagaatagaagtcccttccaggagtccacctttgtgctggaagagacaggagtgatggagttgttgaagatactgagccttgggccgatatgctcactcagtattaaagaatgaatggctggacaaacatattcaatagagttggagagaaaatgatagcctcccagaacacaaacttggtaggaacagacgccgggggaatttggtcatcatctccgggcatatgtaatatatgtaggctgatgttggctaatgtgggcagcatggtacccattttatcttggagatcccagcagccctgtgagctagacacatgtgaggatgagtaggccggttaagagagaagtagcctgggccgagggcgggtgtacagcgcactggaagcagctggaggaaggatagagaactaagtctggcatcccaagccagtaggttttgggataatcagggaatctacattagcttaggttaatagtggcagcctggcagaaggccctctgtttttgactggaaaacctggttcaagattgtggccattggccgttcattctcagttgccttctgtgagcatacgtttcctcacctgagtagtgcttagcagaatgataggacatttcttaaggtgtaaagccagcaccacgtagggtttgctgttcttcctaccgagtagggtgggtgttatatgggaccaccgcctatgagtgaacagggccagaggaggcagaggagaattgaggtgacacggtgcggtgggagccatgagaggcagaggacagcctgattttagccccggtgcagcatagctgtttgcgagactgtgggcaagtcacttccttctctctcctctctctgtgtgtggtgtatgtgtgggtatgcctatgtggtggctagagattgatgtttggtgtcttcctgagtcactctctacattatttattgagatagagtcattctatgccctgccctggctggtctggaactctgcaacatagaacaggctggctttgaactcagagacaccgtgtgcctctgcctccaacctggccaactctccattttgtttttgaaaactgggtgtgtgtgggatgtgtggggtgtgtgtggggggtggggaggtccttatctcatggaatctgaagctcttgactcagtctgactggctaacaaactccagggatttacctgtctctctgccccgcctagtgccaagcttacaggcctgtgcctctgtacccaacttatgtgggtgctagagattgaatttagatacttaatacctgtgcagaaagcccctttgtgactgggccatctctccagctctgagcttttcctagctagagtttggcaaatgcactgtgaatactgactgtgagccaggctgagttctaggtgttagaagtgggacgttgagtgagacagagcagatctctctgttgtttccttacctgtgaacctaatgcgtttctgccccgctccttcccccatttcttacctgctcctctgaaatggtgtggtgggaacgcctccttggtgacggtggatgcaggtagaaaagcctgagcagggctggggagatggctcagcgggtaacaacactgactgttcttctgaaggtcctgagttcaaatcccagcaaccacatggtggctcacaaccatccgtaatgagatctgatgcatctgaagtcagctacagtgtacttatgtataataataaataaatctttgggcctgagcaagcagggttgaccagagcgagcagaggtcctaaaaattcaattcccaacaaccacatgaaggctcacaaccatctgtacagctacagtgtactcaaataataaaattaataaataaatctttggaaaaaaaaaaagaaaagaaaagcctgagcaggcaggaggcatgacttaaggagccaaaagcgggtggagtgactgtgctattccttgtccagagaatgctttggggcagagttcttggggctggtccacatacctccaaatgcaaagtaaggctacggcacagacctctggaccagaggagatacagcttggatcatcttcctgactttcaggatcaggcctgaagtcatctttctttcctaagacagttcttttcatgatgaccaaaggcgtctctctgtgtgttccctctctcgagatcttgccacacccttgagtgtacgagcccaggtgtaaggcaggctaaagagaatattgacttggagtcacatcctggatctatcctctttcactgtgaccttgggccaggtcctttaagcttctgctcaaactccattcttgtaaaagccagcgatgcttgtttgtttgtttgtttgtttgtttgtttgttttttatgtgcattggtgttttgcctgtatgtctgtgtgagggtatccaatcccctggaactggagatacagacaattgtgagctgccatgtgggtgctgggaagtgaacctgggtcctttgggagaacagccagagctaaccacagaaccatctttccagccccctagctgatgcagtctcaacttgagatgtaggatggtgcttctgctgttgaattaattatattctcctcttctctctggtcttggaagttctgggtgactgtgtatccccacaggtgtcagccctggggcctttcataataagacacttaatcaatatttgccgagtatccactagctgttggcaggtaaattaaatgtctgtgaataggactcaaataggctaggtctcagcaagataggctacctcatgcacactggtttctgggcaactgggcagtctcatgggcgcttacctacaattcccatgaatgggcttacctgggaaggattagacatcccaaaccagggtggtacctgttgaaagtgaaattagaaagacttggctcttccatcctcagactcctcatagtctgtcctcttgactgccatgcctgtgacagtgcctttggggcccagaacccaggctgccctgttctttcctgaatttctgatgctgagcacacagggacaggaccactgagactgctgcttggagccatagattctgtttgttctagataaagacccaatcctaggcctgcattctggttccagcctctgcagatgagtgtgcactgggtgtgctggggttccaaatgttggcttcctcattgactagctgtgccatcatggatctacaaggtgaattctaggtcagcttgggaccctgtctcatagcccccctcaccgcccccccccaaaaaaaaccccaccaaatcaacaaaaacctaaccagaaagaaagtacttaaaacttgtgtcatcatatcatagtgcaagaaacacacggagagtagatgtccttttttaaaaaattattttatttatatgagtacaccatagctgtcttcagacacaccagaacagggcatcagatcctattacagttggttgtgagccaccatgtggttgcagggaattgaactcaggacctctggaagagcagtcagtactctcaacccctgagccatctctccagcctgagaatgtcctttaagggccatctagcccaggaatttgccctgccctcacacctcccagcaactttccctaagcttacctcaccctagaactcaatggagctccttcctcttcaatccctgctccacatgggtaggctaggagcaggtgccccttactggttcagcaatggacaaagcctgaagaaggggggcagggaagagttgggctgtcaggccactgatgccatcaagtgtcagctcaggcaggtgtgagaaggcctggcttgtggcccgacaaccagagtttccaaggtgagggacattagaggtggcttttcggggtgaagaggttgacaggctcccgaagggtactcacaaggaatctctcttctctgaggatggctttgggagttgctctctaaaaagacctggcactgggtacctggctgatggccacagactggaaaatgggcataagagcttgtcatacaagatgtactttttatgggtctagagctgagacggggcagccccagcctgagatacgacctggccctggatgttctgctgtgtggctcctggaaagaattcagtcctaatgtcgttgaattgtcaagatgacctaatgccattgaatcattgagaggactactggaaccagttacagggtgttaactgaaaaccctgggtgctctgtcttgtgggttacgacaaccatagtttaggtggagaaactaggggggtggtgggtggctgggggctgggtctcatgtagtccaggctggccttgattatattttgcttacctgagaatggcctcctgcctgtacatcctaagttgctgggagtaccttcgtgtaacagcacatactatggtgctgggaaccgaactcggcttttcatgcatggtgggcaagcattctaccaattgagctatatatccagcccctggtcctttactttctgagagtgatgcctaagccaggctgtccaagcaggtcactagttaggttcctgaggctcacatctctttaggtgctgttggggccccggtaatccacaggctgacatgcagccaaggagtgcctgctctcctggtcttgccttttctcctttcacatctctacagaagcagtcctgtgagctgggcccatctactcagcaagacagtgtcaggactaggtgtgggacccatccttttctttaatgggagacagagagccatgtgcatctgtctacctggcctatgtagttagtgccagaccatccacacagtgagaccctgtcaaaataataatatgctggcaggttctacagctgcattggacagcgagggggataaagaggccctcagaccttctttcaaggccttctttcaaggcttccactggactttggtgggtggagcactgggagttcagcctgcagtaggtatcctgagggcccatatgcacgcgtgtccctctcacatttcccaggtggagaactgtctgaccttttcaggatctcaaggtcagagcgatctgaggctggtggtcccatccccctctgttgttcgctctgcggtgctgcttataaaataaatagtctgcatgcgtaggagcactaagccaagatagatgtatacaaataaaaccccaggggtggacatgttctggaattagactgtggtggtggttgcgtggccttgtgaatagattcaaaattactggattgtgcattgcggaaaatggtgacattgatgttatgagaattatgtctcgaatgaaaatcccaagaaaagactaataatataaagaagaagctgacagctgcctgtcatcccacctcccaaatgtgaatactgtcacaggagttcagatggtatctgccggcctcataacttatccttactttggtaacagtgctcctgagcctcccacccccactccaccccaccccaccccatttcttcttgctcgctgtctgctcctgggctgggatttggaaccatgagctatggtagtagtagcgttcaagagtcatcaggaagagaagcaagttgtctgattggcctcttggaaactgcctgagaatttatgatacataaacatcagaacagggctgggaggaaaggtggttttttccctatctccccaagtccccaccttgtgagggagtcctgtagatgttcaactataaaccctgttggactgtggtcacttctcttctcgccttctgctgtcaccagggtcagcaggcaagggtggctttcctctgggtccgaggcaggaatgggcaggggagccagccccacctccttgggaagttgcctagcaatagtgggtaggtgacttagccctctatagaggtgggaggagaataaaaggcagtgaggatgggaactgggtgtagatggggaggatgctgttcccctggaaactgcctgcttggtccttggctaccatgggcctcccatagggctatgacttgctgtctactgagatggatcagagtcttctccaggattgtgtcccaaaagttccaggatggaggaacccttgcatgccagcctgtcagtcagacacccttagtcaggggcattagcattcacagcagcaggggacagagatgtagggtggtcactcttctaggatgacctgaattcaggaacacagagtaatgtgctcccaggcccacagaggaaggggtggacatgaaggcccaggtgttccattttggtttgaaatgtttcataagtgaaaggtacttaaaagggaaatgtaaacactgtccactttctggggagggaagagaagattctcgagggtggattggccaggagagctgtctgttttgcatcagtcaaccagctagtctttattaacagtaagtaagtaagaaagaaagaccaacagctcacagtgattaaagttaactgactgagatgacctcagtctgcacgcctcttcaaggaaggcgctggtagtctgttttgctagatgggaaactgagacacagagaagtcgcttgcccaggagctgaccggctaataagctgagttatgcacaaagccaggcagattaacttcagaattctgacttttaaccatcagtacagacacaccctctgctgtgaaggggcttatgatttcactgagactggagtcttaaatgtgagtgaacaatgcctcggggtggtatgtaatcaagggctcgttttatgattcatggtttttcacatttatactcttacattaaccgtgatgtgatttcttgccactaatgtcggtgagcaaacgtgcgagggctgatctccattttagggtagagaaaatgagactcagaaaagttaggggactttagccaaggcctggacacaacttgaaatgtttagggggagttttagccaaagtctctggagggactcttagcctgacagatcctggatgacacacagacatttctgaagttacttttcttagttggagagggaggggggaatgtcagtagccacattgtgcacccccaaggtgctcttagccctgactccagcttttggcgttcggcatcccctccctgctgcttcctcctttcacctgccctgccctttgtttatggtcacctgggggaaccagacaggctttgctccaggcagcagggttattttgattgcaggtgtccacactttaagccttgagagtcatgttcagaaagatgtaagggaagttggggctttggatggattttgccatttcagggctgggagtttctggaccaggctgtcctgttggaggacagtgccattgagcattgtagggcttcagagggtctaaaccagaggccccagctgttggttctgggtggaaaggcagccagtcagggactgtgcctctttgcttaccttgcttctgctgcctggtggttggggcctgtggggctgtctggagtagggttgcaggcccaggattgtgttgccaagctatagcttatagggccctgaagacttatttattttagttggtttgagacaggtttttgctctgtagcccaggctgacctggaactcactgtgtagcccactctggccaccaacactcaacagttctgccttggtctcctgaatgctagaattacagacctgttataggtatgagctaccgtgcccctcttctgaagaaagatactttagtataggcttagtcacaaagataaagagagagaaaggcgctcagaagaagataaggtacacctgagagcatgggtgtggggttctcaaagaggagtctcaaaaagacagccgtcaaatacgggtatgagcccttccagagaaagctgcccttttaaaacgttcttttaaagtcatctgcagaggtggaaatgatgggagaaagatggtgttggattccatttttcaaccctctgtaggtgaaatgccacaggggatagaacctggaggtgattgatctccctcaggcaaatctcttcaggtagcttgtcttcccttaggacaggagacccccttcccttttggatggaggggctgtgggagtcaggtgctctcttctcacgccccacacagagaggccaaacagcttgtattttgggaatggagaaaaagtggaacttttaatccctcttcgtccaatgctagcctaggaaaggggaccctgccctgctctgcccctttgtgtctcactgcctgccagcagcagctctgttgtttctggctgaagccttgagtctgggggagtggttcccttcaaacaccacagacatcctccagataatacacgatggcaccttccagtccagttcccgatatttccgaagggcctttctttccaggaacccaaaagtgattttccagactcagctctgagagctgggatgaggggccatgtgaatgtgttttcctggaggcgggaactgggcccggatccctgtttcctgccctctgggttactggactggaggtgtctgtgcacatcgcccacccccttttccctggatcacccccacccccacccagccaccacctttaatgtattgttctgtggttctgggcatggaatatagctaggactttgtgcatactagaccagggtgacacctccactctcttcttttttttaaaaatgtaagttaagcaacgtggggctggtgagatggcttagcaatgaaagactcaagtctgaagcctgagttcagtgcctggaacccatgtgatgggagagaagaactagttgctggaagttgttctttgacctccacatatttgcgcaggtgcatataataagttaaggtgtaacagagtaacatttaaaaaaaaagttaaatgacagtaatcttatagcctgattaattaaatatatatgtaagtttatcttacttgtgtttgtgtgtcgataaatacttatttattgtttttgtgttttgttttgttttgttttgttttgttttgagacagggttgttttttagtcctggctgtcctgggactcactctatagactggctggaactcagaaatccatctgcctctgcctcctaagtgctgaggttaaaggtgtgcaccagcactcctggctttatacatgtattttgaaaattcagaactacacctttgatgcgtgtacttgggcctgtctactactgccctgctgaggctgccaagctttgagtggtagggccactttggcacctgggggtacctgactggggaaccttcccctgggcctttctccatagaagaccctggttgaagagcaggtctaacttggggtctaccatcctgggcttatggctgtgactgttaatgcgtcctaatcccacaaaagcacgagaggtcgtttatagtgctgcgggttggactgggcacattcttggtgtttcccagatgggcttgcatttagggctcacagcacttgagatggaacggctggcaggaagtaaagggcatctgggagttcttggaaagacccgaaaggttcaggtgagcacagcaggggtttctagagtgtctgcttttgaagctagttcttgactagctgactgtagagttctattttaacacattcgacttgagcttcagaacccagcttcttcaggacttccagcttctctggaatcccagtggcttccctggtggcatggacctgtatcctgagtttcatgtttttgttaataagcatatggtcgtattaaccctgtctgggcagctggcatgaatctgtgaccattttgaaacaggagataatggagagatggctcagtggtgtaagagctttggctgttcttccagaggacgtgagttcaatccccagtacccacacagcagctcacactgtctgtaactccagttccaggggatctgacaccttcacacagacatatatggaggcaaaataccaatgcacataaaatataaataaaaaaaaaaaaactggagctaagctcatagctcccatcgaaaccctgcatcccatgtcctgttgaggcttggaggagacattgcctgagcttcattgttccttgcaggtgacagtaaagccagagctcagcttcctgcctctgtggtgggctctctgagggaggatgtaagtaagtcagtctcaacactgtcttttttcctaggcttgttttttggcatcctgactcccatgtgctgtggttacctgctcccatgtcctacctgccatcctggggctttgaggttagggtcttgaggacttatactctctcactatcttgttattgtcttcttggagtagcaacatttctctctctctctctctctctctctctctctctctctctctctcatctatctctcacctatttatctgtatgtatgtaagtaagtatatatgtatgtatgtatcttgatttgcttgagatagaatttcacgtatctcaggttcattatgtagccaagaatgatcttgaacttctgattcgttttctcccatctctacgtattggagttacaggtgagttccaccaagcttggttttcagtggtgatgaggattgaaactagggtttcagaagccagtactctgtgagacagacatgcctgttggaggctcagatgaacataagagttttagaaaatggcagaggcaggagttgtgttaaacccctgttgttcagtcccagtcccagtcccagtcccccaggacagctggacagctagtgggatgacagcatgtaactctccatccctgccccgtttctttgctcccccctcctcttgtcctggctctcagccacttagctgttgcctagcccagttggcacctgggcttccaggatgggctggtgagaaacttggaagagacagatgtgttggcagacttgctaatactgtctcagagcgtcactgtgaaactcttggctctgaggacatttggaggatcagtcacccgaggcggcttgggcagtagatggtgtatgcttgtggggtttcctggagtcccgtagcaagtgtgagtctccaaagacctccctgacagacattgtctagctccctgatgacaaggcacaaaaaaacttgtgtgttgtagctgtttcccaactcactgtgtgcctctggccaaggtggctgggtagcaggaaagtccgacaggaaggccttgtgtgtcagggtctgagtgaccagtgctactccagctatgaggttgtgtcctggcttcaggacagaggtctagttggctccccagattcaggtgtagcttggaaccctcctcctcattggactgtgtcagagtgttggatgatcttagactctgccgtgcctcctgtcactgttccctttgtgttcagtctcaagggtgcagttgatcacctcccagcttccttgaagacagcccagctgtgcttttcctcttagccatgtgcacactccagatttctttcctgaggggactatccatgctcgtccctcccccaacaccctaccactttctccctggaggttggatatttggctgtgatccctgcttcagaaaatcttagcaagtttctggtcctcttgtgtttgcttgggggccccaaaggatgtcaaactaaggtctcagttttccttctccttccttgggctgggctaatgttggttgctctccctgaggtgtggtttgctgtctttagcctgctgtctttagccaccttagctttggggtttggtcttagttagggatcctattgcagtgaagagacactatgaccatggtaactcttataaagaacaacatttaatttacactgacttacagtttcagagatttagtcattattgtcatgacaggaaacatggcagcgggcaggcaggcagacatggtgctggaaaaggagctagcagttttaagtcttgatccacaggcagcaggtacctgtgccacacgtgggcatcgcttgagcataggagacctcaaagcccatccccacagtgacacacttcttccagcaaggccacacctactcccaacatctcccgatagtgccacttcctataggccaagcattcaaacacagagtctgtggggagagtcctattcaaaccactataggtgtgttactggatagaaccatgggacctccagctggctaggacatggtgtccagtaaagccttgtttctcttgctaccttcctgtcggggactttggagagtggcatttgggacactgtcccttttgaactattagctccaagagccacttggcagagtcctgtcctgttctcttagcataggaacactggtgctatgaagtgccagagcctcaggagacccagggggttttgttggtgctgggccagtcagtcatagctgagtgttgcttataacccatgatggttataatcaccgaatggtggtcagagctccatgctggtagttaaaattaaggtggtgctcagggtcttaactggattaccacgtgggaatcatcgctaaggcctggaccttgtcagtgttctgttccccccactccctttgtctgtttgttttgagacagggtctcaactgtgtagctctggctgcctggaactctgtatgtgagcaggcagatctcaaatgcatagaaatctgcctcactctgcctgtcaagtgctgggactaaaggtgtgtaccactcactgttcttgactttttggtggtgggcttttccttttaaggtttgcttttatttttatccgtgtgtctctgtgagtatgtgtgcacttgtgtttgggttcctgcggagtctagaatggatcatcagatcctctggagatggtgctattgatggttgtgagccacctaacactggggctgagacttgaactcaagtcctccatagagcagtaaacgttcttaaccactgagccatctccttaaccatgttggtcccttctgaagggatgctcagaggattcaagctcttcttcaggtgatcttaagatgggcccctggtcttcccagcctgtgcctgaagctaagcgttctgcagtcttacttgtgggaactttctatactctcaggttccaggagtttctcctcacctgtccttcacttacacagaagtcagtgctctataactaggctcaaagactcagccttctttgtcttgactcaggaaatgcttggctagggtgtggccttgagtgggaaaccagttccctaggacatcagagtgagaccttgtttggagttatcaatggtaccttagcttctgtccctgagcctggcctctccaggcattgatataggatgttcaaagaagagtagggactgtctctgcctgttgcaaggtaggctgacacaatcagcccctgtgttgccttggccaccaccgcctgtgtgagggaggctgcttgccctgtgaactctgtgggcacagtgggcccaagaaccaggcaagacattttgcgtggaatctaagaagaatcagtgttgctggtggccttgcccctcactcattcatgttcagagcctgctctcacccttctttctccagcagcagtttgaagaaagcaaaatcctaggatgccaagtcagaagggacctggaaggttatgtggatgaagaattgagagtccatagcggcagtctgacttggccaggggcgctctgccatgatctcagtctgtgtgaggctggctttgtaaaggagtcagagtacatgggaaggaactgtcttctcccatccctgcaagtgggctcaagaacctgagagcggacgggcccagtgctgacacactgtactcagaggcagataaagcttttgggcttctggccagtggccgtggtggtgatggcagtggtagtgacagtcctggtgcttacagctaatactcaactcccacatgcccagtcctgtactgagtccggttcctgaactaacagtgaatcattgtaaccaaccaccttctagagaagtggcactgtgatatttaattccctcttagcaaaagcattctaggctttctttgattgagtcagttgcctcagctcacacaactctttgtgggaggctgaacatgggagctacctgctgtcccggctgtcttccctctgctggggatgagcgcctgccaccaaccctgcctgggatagggacgcctctcagagatggagttgagtttctacttccccaggtccctgtagattctcttttgagtaaatggcacagcacattcctaaggagcaaggaggtggctctgcctgatgtcccaatgtaccaagtggttgacacaggggtagcctggggtcatatgaaggctcattatccctccacatttccttctttggctttcagcaccaaggatggtcttggaagtgaggttttgttgggtcagcttccgcaaggcagcgcttctagctcccaggaacctcctattggccctgttgctgtgggtggccctgagtgaagcccctccctggtgtgtcagttgggcagatcctggtgtgtaggtattccattcctccattctctggagctgctgtggtcatggtgaccctctgttgcagagtctattatgactcctgccaatatactgtcttgtttttatccccataacaaagtagggggcacttggctctctggacaggtgccaaaatcaactctttgagagctcaccgaggctgtcagagcagccagccagccacactaggtctctaagactaacacccccagcacctcacacccagagtgaacataaaatggtaggtggtgcagaaaccgcaacacactgtctaagctggcccgcagcatcctgggcctgtgagggtctccctaggctgtgtgtgaagcagtcaccaggcgtctgggaacgtctccatttgttgcgtatagctgggctgggggctgggccattcattgcagaaaatcccaggcaggtgaacatagtgatgtagagagagccagaagccagactgagactggccctctaatggccttatcttagcgattccttcttttcaagtaaagttttcggtactcaccgtcatccagacttgttgagaggggctatgggaatctgatgggttgcatgtgtcagggtgactgaggacctgatggtcctaataagattatgaagttgaaaacttgctgctgctgacgacaaggatgaagacgatctcgttgcctctgccacctcctttcttcccagttttccttctctttcgcttcctcttccgaagcccatgctggcctccggtgcactgtgtggcagaagatgactttgaatttctgattctccagcctccaccaagtgctagggtcacaggcatggaacgtcacacctggtttaagcagtgctggggatgaaacctgaggctttgtgcatgtcaggcgagcatactagcagctgagctacagtgtcagctcgtgctgggttcctcctccacctctgcattgctgctgtgttccacttgcctaccacagtcagtacagtgctcccgtctgggagcactaggctacagtatctaatctaggtgcacaggaggccagaccgcttagctttgtgtgagtgtaagcgcaggtctgtttacatggtgacaaaaacctcccaacggcgtaggctcagaggcatccccattgccgtgtgatgcagagcaataatggtgattttaatagtaatgttgggtggtgtgggtgcaaacccatctcatagcgtgtggctggaacagtgctctcttctttttacagaaacgttaccccagcaagtacgtcccacataggaacctatccgaggtcttgtaaccaaccatttcacagctggggaaactgaggttcagagacgtatagtgaccgggctgtagctggtaaatgacagagctagggtttgacactaaggaccgtgactcttgctctcttgcttttgtttgtctgtttgtttgtttgttttttgagagagggtcccatccctcaagctcgctctggcctgtggcttactgtgtacactagacttcaatcttagaacattgtgtcttggcagcaaggattacacgtataagccacgccatctggcgtaagaggcctctgtgtgatctttgtttctctcctcaaagctggcatcgcacctgggatctagtgagctctcagaaaagccgtaaggacagaacggagggtttggagccctgacccttgaggaaaagtggcttcttggaaatgcaacatggcacccactgggaatgggaggctcctcaaggttcctcccctggctccctgcagtcactgttgggggtgggggatgaattcaagtttaggtggagtagatggaagtcctgtaggctccttctctgctcccgagttggaaagagaagcctctcttttcctttttcattacatttgggacatcagcatggcccactgtcacaaatgccaccagctagatcattcctgcatggagtgaagatagcaaataatttagaatttaaagaaggtaacaacatctccttggaggccgattctgactcctgcccttacccatgatgcctgtgcattgcatgcatgatgtagaacttacaggaaatttacatgttggcacagaagaagtcatacgaattagcgccagaacatgcctgaaatatgtcactgtcctgcttgttgtagtgtgccgagatctgcatgctcttgtgacctgctgggcgtggctggagtagaaaggctaaagagaggagctgtcatcttagtacaaatgagcatccatcctttccttgtacaggcagttatcaatgggtttgaactaacagcatacatcactgactggtgccacgacagtgtatgaagtgggcgggtagcaggtacatgcagttcttacactcctatgttagcgatgagagcactcgagccagctgtacctagttcctctgctgaaccacatttgctgtggattatttacttctttattttaacttaacattgtttcttttgtttgtgacatggtacatgtgacatggtacaaggtcagagggcaacttgcaggagttggttctcactttacactgtgggtcctgaggattgaactcaggtctttgagattggtagcaaacatctttacctgctgagccatatcctcagcccatcttttacctctctgtgcagtcctggaattctcaaaagagctgcctgcctctgcctcctgagtgtgggattaaagacgtgagctatcactgcccgacgcttgtatttaacagatgtgccgtgtgtcagttcatgaccagaacacagtctgagatctgagtctttaggtgattgtgtcattgttgaacaatatgcacatctgtaacctatgctgattacagtattacggagcagtaagaattttctgctctgttagaggcaccccattgttccttccggtgattatgaggcacctacgttcccttaagcccttgttccatccagataacagccaggtgtgtgatctctgccagtgagtcgacaaatgggtgagagtcacatgctggcatattctaaggagtcagaggtcagcccctgctctgcctgtaggagatgggtagagtgacactgagctaaaatctacaggtaaggaaatagtgagacttggagtccaaatccaactggaggacttgtggtatagttcagtgggggagcatttgctgaatatgcttgaggtcctaggttttgtgtgtgtgtgtgtgtgtgtgtgtgtgtgtgtacaaaaaagcagagcacggtgggcatggtgctgcacacctatgactccaggagtagggggctgagacaggaggatcactccatgttccattccagccttgacagtacagagttctggaatagcctgggctacagagtaagaccctgtctgccccaagataaaagaagagaggaggagaaggaagagggagagagagtgagtcaggcaaaggtgtcggaaaagttgagcagagcgtaaccaagggcaggaacgagggcgcatcaagctctggggacagaggggctgccccagtgaatgtgaaggagtgggctggaacacaaaaagagttgggtagccccaagtgagccctgactaagtcagtagagggataatctctggccatcttcagggaagtagtgatcactagatttgttctgggatctttgaagcacgcagccatccaacttccgtgctacatgttgagagggccacgggttgctctaannnnnnnnnnnnnnnnnnnnaaataggtctctgggagctgtgcagggccgcagcctagctctgagtcgggtatctaatagagctctctagccagggactaaatggatggagtggaattgatgtggtcttggatggactctgtactgcagctgggtggggcatatgcagggagaggccctttactctatgttctaaggatttaggccagagacagtgactgtgggcataggcactccaaggaaggctgtggaggaggcactggcctgttgccatgggaactctctctgctgtgggtttccacttgcaaggatgccctagaagggagtgagctcatcctacctgcaaggtgatgagtcagtcccgcctgcgctgccagatgggagcttgaactgcagacccctgcccctgcttgctctacaggccacccaaatgccccacctgggttgttgtctacttttgtcaccaggcagtgaaagtagctgccagccattcattctagcaataccaaaaattctgaccgggaagtctccagtcacctcagccaaaccttagacctcaggggacaaaccagtgcacaggggacatctggaacaccttagctaacatggactgggtaccagccacagttgtgctgggcctagggttcacagccagggactgggcaactgcagaaagtgagggcaggggtacagggctcaatcttttaataaattgaggctataggaggacacggcactgagtaatttttaggggtgaatgaagagcgcgtccagggggttaggtggtgctgatctacctgatggaaggaagctaaagttttctgacagttataggtacccagaggtccaagggtcatggctctttatctcatctgacatgtgcccagtcgtgagggaggcaaccattggacagggatgcatagtgggaatcagaaagaccgtgattttagagagccaggggcttgtgccattgccatgggggcctgtcatgttccatacatggcagcctgtgaggtgacatgggaaagctgtgctttcttggctcttggttcagtggcttgacccacacgccccctctcccccccatttaaggagataaatgatttcaacaggaaaggactgtctagccctttcacctaaacaaaacggcttatgttttcagcaatctttctggtgatttaatcttctctgtagtgtttggatagcagtaatcatggtggatataaaatttagcttggcttttgtattttcctatttggcattttaccaaatacatatttttttttctttaaaacagaactttgcaacctctatacttcttccccagagagagtgagacccaggactagaggttctcataggcgtgtatttatttgtatatttcctgtctcttttctccaaagcattcaaggtagacgtatgcaaaagcttccgcatagccaggcctcagagtcggaagacccagttggccagggtgaggctttgggaatcagaaatcattgagaaagaagttcgcatgggggacgagagagagagagagagagagagagagagagagagagcgagcgagctcagcggttacgagcatgtgcggctttttgagaggatccaagtttgatccctagttcccaccacagcagcttccaaccatctccagctccaggaagaaactgacactgctggcttcttcggtcacctgcacttatttttgcattagtgtcccttacactgtgtgcactaatttaagaaaagacaggttggtttatttgtagtttcagagctcagagaggttgaggcaagaggtgtgtgtgttccaggctaacctgggctacaaaataagccccgtctcaaagcagtttttaaaaggagtaatggttgttagctagagatggctcagttggtaaagaggccatgcgctaccaagccccaggaactgagttcaatccccagggcttatatgatggatggagagaactcattcctacaagttgtcctctacgagtcatggtgcagccatggctcagtggttaagatcacttgaggttcttccagaggacccgagtttagttcccagcttcaggaattgaactcttacgtagcaagtacctttagctactgagccatctcaccagcctaaaattaaattttattttgtttgattttgagacagggtctcactatgtagctccggctgacctaagactcacagagatcctcttgtgtctgccttgcaagtactgagattaaaggtgcataccaccatgcctcactcccaaaaattaaaaaagaattttttttgtctgcctctggtgtgcctctccctctcgtgtgtgtgtgtgtgtgtgtgtgtgtgtgtgtgtgtgtgtgtttcttcaaagcatggtctttgtagctcagccccagtcctgccccagtctttactctgtttctgaggtctccttcagactccttatatgagatcaagcaggcagcacctttttgtgttgcttatttcacaaaaagctgttggttctgttagtcagcatcagtctctgttttgacccttttggcctccaaaacaggagggaaaactggaataagctgtttatttcctagtatgaggaagtctgtgggctcattcctttatgagcactaaccaccaagggcatgagcagttaggagagaggctcagtggatgtgtggtcatagttcatggaacacacagaaacctcttctgtattcttggttttcaaatgaactcagagtaaaagccaaggcttggtgttcaattgcacttgtctcaaggtgctactgtgggaagtggaggtcatgacatccagcgatgctgtttcttgaagcctaacgtgggagagcacaggtccttggagatgcttcgcagcagatcctgaagactccaggcacagtctgtgtggtgccccagcttggagtccacaggttttctgaggcctttactatgagaagaactgtttgctttgcatgctgggtatcagagcttctattttgttatgaccatgagaacatggccactctacctttgcagcacactgagaggaggccagagctgtctcttgcaggccattttgcatctgcttgggtccacaggtgctgctggcttcggcctcctcacacaccagggtagaggtacttcagggaagcaaccatgtgatcacttgggctgggcatgtcatctttgcctgccatctagggtcccagctgacactgtccaataatgccaccatgatggcatttttttttctttgctgcttttgattgttatagacagtgacttttctttttcttggtattctcagaactgtgtaaattgatgggaagcaatgggtgtgtgtgtctgtctgtctgtctgtctgtgtctcgtgtagttaatgatggtcttgaatttcaatcctgtcttgggctcctgaatgctggtaggaacctaaaggcaggaagtgaagcagagaacatggaggaacagtagcttgcctctaggctcacagttttaacaaccaaggcctactttcccagggaatgctatcaccctcagtgggctgggccctcccacatcagttagtaatgaagaaatcccccatagacgtgcccacggaccagtctgatggaagcagttcctcagtggaagttccatcttcccaagtatgtcaagttgacaaccaacgttagccatcacagtctggaaacaagacaaaaaaaagggtcatcatagttctaccatcccaagagcattggtgaacttactgcctttggcaggcagacctttgaacttgggacaaccctattgccaggagctaggggcacatttttcaagacagggtttctctgtgtagccttggatgtcctagaactcactctgtagatcatgctggcctggaactcagagatccaccactgcctagcatcttaaactatctcatccacgaaccttgggcttatatcggcaggtcctgaaggccatggtccttgtttggtgccgcgttgaatgtggtttagggaattctcagtgttgagagattaaaccaccagtggctgttactccttcaagagcaagactagcaagtgagacatcaagacattgagacctcggtggtggacagggcccagcaagctttggtgggagaattactcaagcatggaatttgtgtccaagagtattgtgcctagacctggctactcaccatatcccctaagtttctacctgttgagagtcctgtctggacaggcagggtatttggtaactttggagggaagtctgggggagcctgagcctgctttctcacttcccttgctcacttctctgagttaaccacaccatgactcaggtgcacactaccctccactcccccatcttcaagaggaagctcctgggcttggggaccttttctgtgctggcaggatggccggctgagctcttgatctcctaacccagaacattacttctcatcagtctactgttactcaagccattatcttctgaatttcccagaagctgggacaaggaggaaatggtaactggaagaattgtttgtcctcaaatagggaatgaggccttgtcttgatttgctctaagaattgatggaacaaggggttggagcttagagcaacttagagcagcggattctcaacctgtgggttgcaacccctttgatgacgggtcaaacagccctttcacaaaggtagcctaagatcattgggaataaactagcaatgaaaataatttaatggtttggggtcaccacagcataaagaactgttaaaggatagcagcattaggaaggttaagaaccactggcttagtgcttaagagaacatatcatagtccccttcacagactgtggtcatcgggagagctgaccctgaggtcatgagagcaggagagttggtcctgcccctcactggctgtagcactgaggagagctggccctgtacctcacctgagcagcacagtagagttggccctgatggtgtaagcaaaggtaagccagcccttcacaggttgtagcacttgggagagtaggtccaggccttgactagatagtacagtggagctggctctggaggcatgagtgttggtgatccagccccaagagtatgagagccagagagctgaccctgcctcctcccagtgttggcctagggtggcctagcaggagcagtgctggagagcttgccgtggagatgtgggagacctgacaggctgatcaacccagctaccacccaggtccagatccagggctttgtgttggcccaccccaaaatctacatcatctatgaactgttggggcatgtgaaagggccagtcccgttgatccaaagctgcagaatctccatgacacagggctacaacagaataactgggaggagtcctgaagacgatccaatattgatggagtcatagacgccaaagactttgaatcagaccagtgactcattgcagtaaacatttgccagtgaagatgtatggacagaggggtatactgtgggacacactgacatagtacagcttctaccataagatgttttctatgctttgttttgttttattttgtttgtttgtgggtgttttttttttgggggggggtgtgggtggagggcagataggaggggataggggtgcaatgtaacttttatttgccagatgtaattgtcatcttgaagccttgctgctgaataagcttaccctttctagttctttctgaactctggctggctggttcaactcagctgttcctggctcaaactcttctccaagctgactgattcaaactggcttttctctcagcttctgaatgaattgctctgcttggcctcaaactaactctggcaacttgttttaatcttccgggcccttcttattctatgtcttcaatggcctctgctgcccagcactgcacaaactgtacagacttaccagaactcaccaatgagctcatctgaactcagctgtgctgctggaactgcatcaactgagctgattcaacttctgctctctctgcgttgctcttaggtagcctctcttgtctgatctcctatcctctagagttggcgtattctatctctgacaattctgtcaaatatctctctgatttgtcactttgtccctcagttagacattagtttcaaacatggctgtttccttctgtaaactaactttatcttcattgtttgggattaaagctactaaggatatgtctggttccagccagagggattaaagatgtgtcattctagacagatcacagagacttagaaggtctttggatgtgactccttaccagagctgctgttgctggattaaaactcctctacaaccaggagatgagcgggactggggtgcatgatcaaaactcacaaagaatcaataaaaagtttttttttttttaataaaatcacatagagttctggtagaggacctgagtttgattcctgtcacccacaatgggtatctcaacattgcctgtagttccagctccaggggatctcatgtttggcccctctggatgtctacactcggatgatcataggcacacagacacgagtatattcatgtaattttaaaaaataataaggataaatgtttaaatccacttagatagcatcaagtgccaaaagtggtgtatgtgctggcacttggtattgtatacacagcagtgactcacttgggtggctgaggcctgttgagtaaatagacacagatacccaggcccctgtcatctgcaactctgattgttccacagaatagaatgggttcggagctgggactgtcacaaagtctacaagtgtcccttgaaagaggaagagagaaatacatgaatgatggtggcttaccttcgtccaaccccctgctctacatgcagcaccctcgctctctcagaggtggatatagaagatgcttggtgtctcttgtcctatgctagccattctagaactgatttccagcgtccagtgactgtggaggatctgagtcatgggatgcaccagagggacttctggccaggggctctttcttaggacctgtgatgaggatactactgcagtgtcttcatcgctgttggtaatgcctgtgtaaagtaatccccattagaaccttgtcttgcctacaggttgtagccacgtgggccagtggggattgatttgttctgtctgtctggagtagggattgatttgtcctgtcttgtttgttaggtactgtgccttcctttcttttcgtacttagagtatcccagttagcactccagaaggcccactaagatcaagttgattatgaagtagagctggcctctcggggaatagaatggcttttggtgggggccggtgaagatgttgctttgtaactatagtaaagggcctcccgtctcatccttagctacacagtcacccattttcagtgaccacagtttgtctgtaggtatatactgttgattatattgtggccgttctctgtcacccaagagcggagtctcacttcaggactgtattctttaaagagtgatctgtgggcttcctgggcactgtccaggcctatgaaccacatggccctgtcagagctcaggtatgtgtttctaataagtatcccatgtcattttttttttttttaaagataaagctacagaatttggcagaggatagtactcctttagtgtgaatatgggatcagttaagctcagcacactcagctcctttactcataactttccctatctccagtgcatgccggtggagccttctctctttgtggctcagatcctgaattctagctgtccccaaatgggaatgaagtattccctctggaccctgagccccaccccccactactaagagtgaaagaaaggagaggggatgtggttgctttccatgtggtcggtcttgctgggtctggagctggtggcctattagacaaatctccaaggctactttaaaagggtactgcagtgtctgcaggggaacctgccctgatggatgtcagtcatcctggggattcttgggcatgtttacctggcagataaccaacactgctcatggatccctcacagcctgtgctgtccccctgcttagcagaaacagctaactgtccttcactgacctgctcagatctgttgtttggtttcctgtggagtaagggctttttgactctgcatcctgccttgcttggttccctaaaccacctttgtgacttctgttcctctagttcctatttagtcaacttctgtcctagatgtctctgtcgtggtagttctggcttccttatggcaacatgacgggttggaggggggtgggggaagattaagttggttctgaacttgcagcttcctcactaccgtgggactgggggtcagacagcagctgtgtttgctggcacagcctcaaactgcctttgtagacaagccctgcgagggcagctcaggaggtacagtctaccaggataccccctgatggtgcactgcgagggactagggcttgtgttggggagttacaagaagaaatgcacaccctggctgcctctgtgtccagggaacttctcaggggagacgagagccacagcacagaaaaggaattggaaacttattcttcagctaatttcctgctactgccttggactctgcggctggtggcctcttgggtagaaacagcttggaaaattcatttattcttaacattaggtatgaactctttgaagtgtacagacttgtcacagagggtcagacatgcgtaagacatggttcgagaaggtgggagtgaccagattaccctgcacaatgaacccatcacccagaaaaacctcagaagggcagcagattccagttggcatggaacagacctgctcagaccgccccaccactgtgagctcaaggttgactgagatgtctgtcatccgccctctttcctagaccctaggacctaagtccaagaagactaataactcttcttgctgtgtccagagccttttgggacagagctgatgggcaggctcggctccttctgcaaaacccctgctagggcagccttcccatgcccaggttgtcctgtttgtccctttatgctggtcgcccctgttaggcactcaggaggccaccatgctcagcgttgggaggactttgacatcttgtttaggtggggatattattaagagtgtgcaagggtgagaaccggaggctctggctctttaaggctggaccttctagtgaattttggcagaggccatactgagtgtttaattttagggccagagagggggctggggaaaagtcccgaagcatctggtttgtgttaagcccttcctttagaaaaaaaaaggctgtgtttatggttaaaatccggcagagatgggtgggggtggggagctggggggtgggtgttgaaagggataccgttatccagcaccaggctttgcagctaaaagacaaagcacatagccactgtcttgtcccctgaccccatctcagccagctggttccaactctgagaaaacggccatactattttcatctctgccattaaagcaggatgtttgccttcagacagcctccagcagctggactttgccaggctgaagctgtgtccctcgtgcctcagcactccctggagttggctgcctgtcagctcatttgtctgcagtctgccgtctgccggccctgggcgggtcagccactattaggtcgaagcaggggccacaggaagctgcagggtggctccagcaggccttcctcctgtgattccctatgtggactgtcagagggcccccaaagtccgtcccctctgccagtagaaaaatagagggccggacaaatgaccgagctcttccaaagtctcacagcaagctagtgtcaaactcaggattcaaaccagactctggactccaatgtcctttatgctccctgtagctctactgggctctcttttgctttgttgttcaaattacctacttgactctcagccttccaggcgcccaagcacaggctctggggacaagagatagggtcttaaagggtctccagggtcttaaaggtccatggagaagtttcaccaggctgtgtccatctcagaggctgtcctccaacagtagcctgtgggagctattgagtgagtgatgagattgcctgacttgggggtgggggtggggtgggggggggtgatacaggtgttccagttggaacccgtgcttctggaggggtgccaggcatgagtctgtactaaagcttgcctggttccaaagccacatcctgtgttctcctgtcttttctcagccccagattaatcacccagctcctccagagacctagaagctcagagctgcctctgtcccatccctttaagttaccgatgaggagactgagaccatcagagcagccaaaacagagtgagttcagaccttgctgatgtctcttccagtgttaggagctgagtgtaggacgctgggactgaggtagagagggaaggctgtgtcctgtccttttgacttcctgtcctggaggatggtgtgtggggtgtgatatctccagtgcaagtggagtgaagtggaatttaggcctccaggattaagttgaatcattctcttgtgtcttcctaaaagggaaaaaaaggcagactggagtggctcacttccttcttgagaaactggagcctgagtcaccctggagtcaggacctggagaggggcccccagtttgcttctcttctggctatgggagaggaacttcccttctgcccgtctgttagagcagagggcaaggcagggcctgaggcggtgtagctgtccctaactccccctgtcttgggaggtcttagtccatttttttggagctggcggggaggaagaggtcatgtgttggtctaactcagggttctgaagtatactcatttgaaatggttttggtacctcgtagaagtggacctgttttttgtttgcccttttctgattggtttgcttcacttcaggcttgtcccagtagaatcctgtgtcagaattaactttttagggctggataatactccattgtgtgttttaatacattctccttatctgttcacgtgttcacagatgtttgggttatttccgtatcttggctacggtgaataatgttgctaggaagttgggtggagagttgggtcttggcatctccctgtgtgtgcccatggcatgaggtcctttgtgcccacaggtggagttggcaagtcaacagaaggccttagacactccattctcttctccccctgactgggcgtatcacggtagctgtcctgtaaaggccagtgggctggccagctgggtccccaaggacacatcatgtctagcttggccgccacacagttctggggaagactgaaactatatagataacttgaagtttcagtatcttctgttgagagaagagttcttggggaccaggtccccaccctctgcctgccttcccctcttctttagccttagacttgagaaaggggctcacaccctcctgggcaccccagggattagtggggacaacccctcccccagtttgctgctgtccccacttccttccattcactttatccccggcttttcctctctcaaggttagccatatgacacatttttggccagtgagttagatacactaatgcaaaacttcctagcttccccaggagctgagcaccatctgtttctttaacagcaggctcctctgtcctgattcctgctctctcagaggctgctgtaaccagcaggtggttggcccctgttttttcagcctcttgatacaagccctttcagacagtcaagtgtaaggcaaaccaaactggtctccgcctgctgctagtgtgggcttaactccaagcagccagtgttcattcctgaccctgctccctgtggagatctgcatgtggtcccctctggggtgcttcatgctacttataaagcttgtgccgccttgatagtgggccgtgccagctaattggagctccctggagtgggcccagtttttattctttcccagggcctagtagtggcagatccagtaacctgtatagatgcttcttgacttgtaatgaggtcagtcacgttcccaataaaaccttgggaagttggaaatattctgtcaagatgcaggtaacacagctgacttacccagcaaatgctatactgaagaataccagttgtgctcccccctttaaaaaagattgtatttatttaatattttattctttttaaaaattatttattttatacatatgagtatactttagctgtcttcagacacaccagaagaggtcaccagatctcattacagatggtcatgagccaccatgtagttgctgggaattgatctcaggacctctggaagagcagccagtgctcttcaccactgagccatctctctagcccttaatattttattctttatttgttcatatgtgtgtgtgtgtgtgtgtgtgtgtgtgtgtgtgctcacgcacatgtgctcaaggcatattggatcctcttgatctggagatccaggcagttgtgagctatctggtgtgtgcgctggggatcgaacacaggtcctctataaggtcagtgtgcacttttaaatgctgagccatctttccagcccaagattaattttaagtgtttgtgtgtggtatatgcatgtgagtacaggtggccaaagaagccagaagaggagggccgatcccctgagggagagttgcagacagttgtgagctgctagaaactgagcttaggttcaatgcaagagtagaataagcccttaattgctgagcctcctctccagcccagttgtccaccacccccacctccacacacacatccttgtgaatgcattacctagtggtgtgatggctcactgccactgcccagtgtcacaagaagatgatactgaaaatcactggcctggggaatgatcaaggttcagaattccaatatggtttccgccgaatgcagaactcccggaaagatgaaaacctgttaagtccagtcataggatggcatcagcctctgtcctgagtggatgcccagagatggcaggaaggcagaggaaattcgtgatctgggaccagcatttgggacatcctatgctgtctctttgctagctatgttacttaaccctccagagtgtcaatgtttccatctctaaaatggggggagtcaaagcaacctacctcttaataaatgtaataaaaccagtaagtgtgaccccccggtataatgtgccgactaaataagggccagctgaccttgatatgtcccctgcactagctgggggaaggctggggagaactctgcgggaaggcggggcctctgcttctcctgggtctgttttaggccaggatccttggctgggctgctttagaggtagaggggacaggtggcaggtaggcaggctctggtgtataaagggaattgtccctgggcagagaggagttactaaactctggcatggggctagctgtgtgctctcaactgggattgtgtgagatggtcccagagtgctttgggcttcattccaatgtgctgtgtgagctctgatcttgaacatccttccttccctccagcgccaggcatttgggggagaatgccagcttctctggttactatgttactgtttcattggtggcctctgcttttttttttccctaggtggcagctccagagcttctgtgttccacctccatgcctccccgtgtccatctctcctctttgcattcctgtgcaggtccttatccaggctctgggatgtgaataggcgacaaagttcccacaggagagaggctctgcagcagacatagggtgtttggaagagagttggcatgttagcagctgtgtcttccagtctcagtttctcttccaaccccctttcctttttttttttgtgtatgtgttcatgtggtggttgcacacatgcatatgggcttgatgtctggtgtctacttagttgttcaaaccgaacctagagctcccagattcatccagggaactagggtgccactcgtctctgcttccatagcacaggggttaccgtcatgtgtcaccaccccaggttttttacgtgggtgctgggaattcttgggcagcaagcgccttactcgttgaagcctctccctaggccccagtttcttcaccagtagagacagacagggatgtgtgccctgtggggaccttgttagaactaaaccagcatgtcggatgtagaccacctgggctggtgtcttgtacctggtgagcgcgtgtagataggtgtgaagatagtgggatgaatcgaactgtgttttagccttctttgcgaaggccgggagccccgacttcttgtgtatgtctttagcccacagttgtccaagcttgcttggttacagggtttgcctggagtgcctgttataatactaatttgtgggccccaccctagggctcctgaactagagtggcatttgtcagggtgggatttctgacagcatttgatataatggggctaatttgagaaatgtgattttttttttctctttagctcactctccctgaataattgatcttaaccagatgcagcgcattgataggaggcagagaggaatcctctgaaagtgggggacattgtagagggaaacctgatcaccagcggtggacccagaattagaactcggggcttctgatgccatgtgtccatgttcctgcaaatattcctttaaaggatggagaagtgaggggtgactctctcaggccatcttaggggcctgtaaagagcagctgaggtgacagatgatgaggtggagccccaggtgtgccttctgaaaattaagacccaggtgagcctggcaggccttgggctttgtcccagagccattgagaatcaataggtgctgggatgtaaaaggatgggaaggcgtgttttacgtggcatgggctaggtagggtgggcagggctgcaattcctgccgaggctgttgaggaagtcccatggatacatagtgtccctttgtccatcttgattggtctggagagccttgtagaagcatgggcaaggttggctccccaactcagatgggaatgtgcgtagctgcttgcagccagtcatgccggctggttggcccagtgcctgggaggtgatctttaggctttctacacccccggtttaccagggggctctcacggctcacagggtggtttgcctgagtgttggttagttgtaggagtacggctgggcatagcgactctgccaccttccccttccctccctgtgggctcagctcagatgtgatgcctggtggggtaggggtggtctctgaactcccctgcctggagtgtgtctaggccccacccacttatctgcattcaccagctgggtttgagctaccttgtcttaggtcacccctttgtctacatctgcttgcagcagcatgaagtctctttgccagatgaaggtgtccttgtgtgctaacccacacccacatctcacacccacctcgccgcccttttatttatttcagctgaaatccgatcagagattgtgagtggcttccattgttctcagggagaataatctcgatgttctgtgggcacccaggttccagggcctctggcactgtgctcacctctggtgctagccacaggggctatgtttgtttctttttgtttttttgagttggcttctgccctacctagagccttggttgttctgtttcttctgcttgaacggccactccccgtaccttgcagcatatgcatgcagctcagttctcactggcgatgtaatacgaatagcttttattatcagccccctcccccttagctataatctggagcgcctcttttgcaaacttttcacctaagtagcactctttagaacaggggtcaggtcagaacccagccacgagctcatgcttctggcatttcctacataggcacttcgcttgccctgtgctttcgtcccctgtggaaactctaggttccgtgacctaggaactggttttattcacttacagtatcagtactcactgagaacgaacgcatgaacaagtgaatgaatgaatgagtcagctccaactccctgagggaggtggggagagaatggggttgatcagaaggatatgtgttggcctgcttccagagaggctgctgacagggggccagcccaagcccaaacagggcgttgctcacaccctggcctccacactgcctgccggcttggctgcctctttaattattcattgtctttctcaatgggctttgtgttcagaagccaagagtcaagaattcaaacccactttctaccgtcccaaaactgagccttagaagagaaccctgcccgacctgacccattccgcatccccagggagccacagggccagcgccccccttctggctggatctgaacattggaggtgatttttcggtctgtgtcctgagctgccctttagcttccctcttctgtctgggaccggggacaactaaaaaggtcttcacgttactgtataccccaatctacctacagggtggcaggcagagctgggtggtcacactgtgtctttacggctagctggctttcctagaagagcctgagctatcccacgaaccacagtaaaggtcttagttcagctggtgctgtagaggttgccgctgcctctcaccccatctcctcctttaatggaggatcatggagccgatcagctgagatgacacatgccttagtgagttggatatgcatattgagtgagccattcactgggtggttctagtagccaaaagcattgattagcttcaaagtctgactgattgcctctgctcctcttgaggcttgaagccgttctcttagccctcagtgtccatccatcttttatgtgaggctgtgacgctgtgctttcttctcaaggtttggaggaggccagagtgatagctgacctgggactccccctgcagcccaggagccctccttggggaatgagtggtggactctgatctcagaggagggcagtgaccatgctgtcccacagatgaagcccctgatcctgctctgggagaggtctctgagcttcccagcacttcagacaaagggtctgccagatacctggttccacagaagtgtgtctgtgtgccttagctgcctgctgcaggtctgtgtgccctgtccctggagtcaggttggtcatactgagggattggccaacagccagggctgcacatctgttgggctgggttcccgatacccctggcagctgatggttctccagaacaggctgggagcacagtgatggtaacaggccccatcaattagaccatggctacttctccttactgaaggggtttaagagtttttatgctgctttttgtgtgtgcgtgcacacgcatgtatgtagttctgggaactgggaacttgaacatacttgtcaacgtctaacatggagctatatcccaaagcctctctggactttcattttgttttgttttggtttttcaagatgcatagcccaggctgtcctggagctaggtctatatgtagaccagactgtccttgaactcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaggttctttgatcatggcctactgtcatcgaggttccatgcaagatgactgactgtttgaccatcacgtttcccctaaagccttcccacaacagagcctctcggacccctctactctttacctaccaacaatgcgatccagtatgcagcaataggcaattgtcctggatgggggttgctgagctatagggtgggtgcacattgagtccctcatgggatgcacaccacactctagaagtgctgtagagtcccctggtcacccagcatcctccgggtgctctccagggttcgcagaatcatttagtatacgcagtagttccgaggggcccaacacagttcccacagtctcgtttattcatgtcctcatccctttcccttcttgcactttagacttctttgactgctggtggcgttctaggctttttgcaaggatgagctccttaaatgtccaccaccactccgcaagaaagatctcctggaaagcagggctcagaaaggtcaggagtctatttagatccccaggtcagtaaagtggcaggccaagagcttatcaggtctcttgtgcccagactcatctcttaaccaccagccctgaggtccttagacagtggggtccacagagtggtggcatctggagaaatagcatgtctccactttcccagagcattggaaagtgggacacatccgtacttattctaactagtagttccggtgtgagtgcaaatcggaggcccgttcccctgagatgcttcctcagtccctctgttttcctatccctccctcctccctttacaacattgggttagcctctgtgagcccatattttggcccaggctgcttttcggggtgcttggtgtctgttaaagacagagatgcatctctgtggagccggaaacctccaggagcccctcccaaatccccaaaagccattggcaggacaggatcccagctgtctccagccattgcgtggagggtggagtttctggacactgggtcaaaggatccagatgagtctgggtatggactgtggtacaactcaaagaagaaaggccagagtgacagagtggagacctggacagtttcttcgtcgaagcagtattttgtccttggaatttgtaacttgtgctgaggatgtggtaagttggtaaaaaaaatgcattatataaactgatgtgtctgttgtctgtaggagaatcgggagttcaaggtcggtctcttacatagtgttaggccagcctgggttatgtgagagagactctgtctcaaaacaaaaccagacaaattataacttgtggtttgacccctggagagcagattccattgagggccttggaatccagtccagctccacaactctggtcagcacagtgcattccacagagatggcccaggaagagatggctgttaacctgatcttgttttctgggccctcgtcagaaatcaagtgtttttccatcatcgcagaaggggtggattcagtcctctaaggtacaggtgcgactgcgtcagttgccgtacttcagcactaggggagaggtgcgttaggggctggagcctgccagaccacagaaccccacattgaagattagcaggcttgtcatctgtgggagttctctgtgggactgggtgacctgtaggtcttaggatccgtgccagacaaaaccaaatgagctcacttttaggtggcttttccttctatggggaaggaatgtgcaggctggtcctgtgggtcctagcttgccgaggtctgtgtgctgtcggatcagcaagggccagaatcactcgagacatgagtcagggacaaccaccatccctgactggcctcccgaagtggtctgtcactctgcttagagaagacttgctcctccagccttccaatcctcatcccgccttgcttgaaggctccaggatagcagtggagtgaactcaggcctttcagtcattagcagtgaaagatcccgggccagcttttgagaccggattcttccagtgggccaagtagacagagacaaaaataaaaagactaatattagcataaaagatttagtggggttctagaatattttacttggtgcgttttaagaaaaatataaatagttttatgggggtataattttataactatgcttttcactattttaaagtgaatgcaaccaatttgagaacatgtaaaaatatatttcatactccttggctattaccaccagctctaagcaaccactgtttaattagttaattaattttggagccagggtctcattatgtatccctggctagcctggaacacactaagtagaccaggctggcctcaagctcacagaaatcttgcctgcctcttccttcccagtatgtgccaccgtagccagccatacttgtttgtttttgagacagggtcttgctctgtagctcagaggttggcctccatctcttaatcttcctacctcaggcttccaagtgctaggccctttgcctagctttaccaatgtactttctgactgtgtggaagggggtggaacgtacacacacacacacacacacacacacacacacacacaccatggaatgaaccctttgtgactgctcacagcagtcccatggaataaggatttttttttctttcacttgtgctggaaccaagactcagagagaccaggcaagtctggtactataaagccggtggtgggcagagcttgcagttgctgggcatttgctgtggactcttctgtctttaggagcagggcagggatggggatatgacactggcagattggtaggtgcagttgactctaagcaggagctaaagggacagactgtgtgtctttattgggattatgtgtcccagtgtcatgaattctcctgctgtgcaggctcaatcttatgttatgaattcttccttgtgcggggcaaggaagaccatgccaggttctcatggtgagccctttccaagcagggatccagcagcccttttgacctgggtgatcccttctcctggtctctggcactgtgtctacttaaatgggctctagacagatacaaactagaaaacacagctctagaagagttctgctagaagctgatgtgtgtttcctcatcaatgggagaaaacagggccccttgattgtcaatacttgggttctctgtgaatgattaactctgattaaatagaaaggggagaggaagtgacaagggacatttattggtttcctgctatgaccagggcactgtgctggctggttagcatgcattgtcttaatcttaaaagccgttaagtaatgacattatttatcccctttgtccggccaggcaattgaggcccaggtggattaaataaggttactcggaccagctgggttggcatttttaagcatctatcagtctgctgtggacagaatactgactatgggtctagttagccccattttacctgtgaggatctcaggctgagttcattgcccatagagtcaaggctagtgagaggttaggtttagtcctaaagcttagcctgtttggccgtctgtactctgagtttccttgaccccagcactcatgcagggatgtggggtggtgggctgggtgacttagagggcagaagagagcaaccagtggttgaggactctttcacagcagcttgcaggtgggtggaaagtaaacagatctgggtggagctgttgtgtggagctctgccttttatctgtgggtgaaccagttgctttgaaaggctggcagaccgcccttaataagctaaccagacactcctgttgacattaccagcacaccaggcatctgagatctctctggacaggtctctgcttagaaaaactacctagaacacgtgccctggccaaactggccgcatgtgggtggactctgagggactctggggagtgaccatccccatgtcagctggcaggtggagcagggaacttaaacccaagcacaccaggaactctggccacagctggggtctggctctgtccagtatccatggcatctcaactagcatggtgcttgctggtggaattgaaagactatagtgtccagtgagggttcgtttgtttgttggttttgcctggacctgctggctctgctcctgggaaggaagatcccaggagaggagccagtttgtataggaagtcccagaccaacctcaagaggcttaatttctcctttgggggttctgggaccatgtggctaaggggctatcctttgactctccccacaattaatcattgtagacttagctgtgggggaaatgtgttccagatgccagattgtcctctgtccctgtgtctagttctgccttttcttaaagggtttcacctcttacttattaagggaatgtttttagagctttctgtctctctcatacgtaggctttttgttttattttgagtcagggtttctctatgtaaccctggatatcctggtacccctagtcatgctggccttgaattcacagagatctgcctgcctctgcctcccgtgtgctgtgatcaaagacgtgtgcccactgcacggctgtcatattctctctgtgtatgtatgcatgcatgtatttaggaggcaggatcacatatagtccaggccatctccaacttaactgtgtaactgaggaagaccttgcactgatcctccagtctctagtcgtggggttataagcctaagtcaccctctccagcctccatttgtttaaatgtgagagagttttccctctatcatggaagccatcagtaatacagtaatagcctagacactctcttccaccaaatgatcccagagaaacaggaagtctcttccgtctcttcccagaagcttatgataatgttgtaatttacacacttcagccagactctctttacatttggatgggtttttaaatagataatgacagcgtgtggtgtaacattcaaaagaaaacaaaaggatgctctgcagaaagcaaacagctctccctccccagttccaaacctctcttcctccaccctagagccagccacggttcccatggcctcctgggtcctccaggcagagtccagcttcaagctttgatttggttggttttgtttttcattttcttgagagagggtctcactatatcatcaaagctaatctcaaaactgaggattctctttccccagcctcgggagtgctgggattagaggcatgtcccaccagtgttccctggacaccaaggtttagcccgtccagtacactagttacagttatttgctgggccaggagggtcagggagctgcagtcttgagaccaaaacattggtcatgttttgagtcccttgaggttaaaccaccagtctctgtggaatttactggaaagaaactacagagaaacaaaagattgttaccaagtgttctattcagctgagttgtccaagcaccagatggatgatgggatttctgggctgagagaggttagcttatcagaggtcacgtgcctagctgagccagggcaggcccatgcttcctgactgacaggaacaatagcttccctgaagtgagccaggactgctaaccttggttccaagagacaaagctgtgtccaggagaggtgtggccggcaggtgaaacctaggcctgtggtaggctgctgctgttctgttcctgcctagcccggtctcatttggctgtagagcattgtttactctgtcctggtgtcactgggagcctctctggtcaggtcacttgagcgtggacagcctggattgtggatggggaaataaatgtctaaaagaagaggcttgccgtgggagaaggcagagagtgtaaccagccaactgtatttataggcagtcgggccaggagagcagctaaggatcctgggaacttcagttcctggagcaccaagtgtgtttgcatttggacacatttggtcttagtcatttgtcatgtctgtgtgattgcacacagctctaaccctgtgtttataagcagtagtgcatgctatcttgtttcagacttctttgttaattacacattcttatgctcacgttatttcagaacctatcatattaatcatctactatgtgggcacatatggtgatttacttaactatgtgccttattattacaatttggtgtcttcctggttttctccacctcagttaggctaaggagcaagttttcatgcataacacctcttctttctttctttctctttatctatttatctatttcatttatatgagtacactgtagctgtcttcagacacaccagaagagggcatcagatcccattacagatggttgtgagccaccatgtgggtgctgggaattgaactcaggacctctggaagagcaagcagccaatgctcttaaccgctaagccatctctccagcccctaggccttttctttatttggcattttatacccaggatagagtcttcgaattggggtgtatagttcaggcctgttgtggttcacattggcaagctgatttcctctagagttgtaaccagtcagcctgcacacagttgtatggggggtgggggtgggggactgcctcgcacaccctctgacaactggaattagcaggaactcgttttgcaaatataattgctttccattgctgtgataagcaccaggaccatgaggaacttggggaggaaaggatttattctgcttccacgtcccgatcacagttcatcagtgagggaaagcagggcaggagccaaggaagatggcctctcattggctttctaaggctcacggtcagctacctttttttatatgtccaagggctgcctgcccagaggtggcactgccacagtgagctgccttcccaccccatcaatcaatagtttagaaaaggcccccatagatctgcctgcagggtaacgggatggaggcagagcctcagttgagcttctctcttgccagatgatcctaccttgcgtcaggctgatcagctaatcggcacagtgagctcacctgttgttttaattcacagggcatgacaggatgtgtatagccatctaatgtcctttgtgagacacatgggctgttgatcagttccagctgaggagtcgtctctctgcctcacagaatgtcagccctctcctctacctttgatagaaatgcccacagctcttgctactagattctcaaatggctgatgtcactcaccagtgttctttaggagtggtagacacaggtattacttggtgcttaccaaatgcaccacatattgtgtttgtatataacatgcatgcagacttagaaaggtcccatgctttcccactgtgggagcagatacccagtgagacttaatttagacttcttggctgctaattcttttttttgtttgtttgtttttttgtttttttgtttttttttggaggcagaccgggtccttgtggcatgcattatattttcagttgtagcagtgtttaaagattgagcagttccacatagaagtctaggtttctggctcttttcttttcctttcctttcctttcctttcctttcctttcctttcctttcctttcctttcctagcaccactgtgaagatccaaggagttaaatgtgacaaaacgctcagaagagtcgtccatcccatgcatgcacgcacatgcatgcttcgtaagcacagttgctatcatgtcaactgtggcatgtatgtttgcttctattagaccagattctctacaaggcgtgctttagggttgtctccattttggatagacggttattaacatctagtgggtaggggccatgatgggtgttgagcatctgatgtctaagaccacgctattcctccagctgcagagtattctgacctcagaccctgaagtgtcagggtcaagtaccctgcttacatacatgtgtggcttcaccggtcactctggtcttaccaatgctttcaggggcttcctggacttttgtagaattgccatcataaagggacttccttactcagctgggggacagcggaggtggggtggggtgagggggtagctgtgtgaaccccttcagcacattcacacagtgtcctcctctgacgtatgacatgtccagctctgggtccctcagtccaccgagctccgatctttcctgaagctatctgtcctttatcctcctgaaagcagctgcctaggctctgtgtcgcagtcatcttccagatatggtcatggagagctgcagaagtgaagtcacctgcacggggtcatttgggtacagctgcagaggctccctgtctctcaccagctgcctgttctgccccggggccgaatcaggcatgcttctttgactatggacgttgagatgacctcctcagacatgtcttgtctcctgctggtcagaggcccagttcctgagtcctgttccttctgcccatctttttctggtctacttccctcctgggtggtctccaatctcttggacattcacccactagcccccttcctcacctctcaccgccatgctccccagggaggctgtctctctcttgccagcactgctgatgctggaggggcttcccaaaacccatgtggctttcattttccagtgactggttttcagtggaatgtcatgaaatttggctcacttgaagtttcagccttggttctacaccccttccccaccctgccccgctatccctgagccacaaagccatatcattctggggagcagaagttatgaggaagttagaatcggtgtcaatggcccgaggaaagacacttaaccctttctggtcctgtgccctccgttataaaatgaggatgttgaactcaacatctcttcaagcctaatgccattgatggagtgtgcttatagtatgcactgtaaagacaatagctttctccctctggcagggagatagtggtgcttacaagcctacaagtagccctattcccccctccccagttcaggtacccccttcatgtttttgttttgagatggggtctcactatgtagccctagctgtcctggtatgtagatcaggctggccttgaactcatggagatccacctgcctcttccttgaagtgctggggttaatggtatgtgccaccatgggttcctccctgggttttaaaaggactctctcatcagaccttctgtttacagtccgcatggtgtcagcattgtctcatgtggctgttggatacctgagttggagcggcgacaggccactcacccacagtgatagatgtggggtctttgtgggcatatctgtggccacctcacctgtgtggtcctgcaattcctgtactgtgcagtgaggccacataagcttgtggccttcctgtgtttgcatccctcttcctactaaggtcaaggttacagctgacaatgacattagaaactcagcccctggctcctgtcatgggaataatcatttgtaccccagtccttgttgggtatgactactcggaggtcattgtgataacagtgggagccacttcagggcccactgtatttcaggcacattaacttttagggccattattaacataaagaaaaactactactttgttagtattatgcctcaggcatgcctggtagttaactgttgtccccattgtatagttctgatcactgaggtatatggagaaggctgtgtggttcacaggagacaggaaggacaccttctcaaataccagagagattctaagggtatattaaaggagacatgttgccatggtagttgttaagggcaaaatgagaacatggtagaagccaggaaactgggacaagatgtatctcaccggccaacccatgaacttctctcctatgtgtccctcagataccctgctccgtggatacagtcttcccttcgtgccaccgttagttaccaaggtcagggatgggtgaggggacccaagttcctcccagttttcaatccctgcccaagatctgaagaggctggccactggacacacatgaacacacatgcatgtttgtgtgtatttgtgtgcatggtggggagaggtataggagtagaggggtgacagcaaaggcactgttccagctctggagtaggtctcagtgtggtccttgcttaagcatggctcctgagaccctgtgtggcacacccttcctctgagcacatttctagagcgcagtggactgtgaaggggctggccatcttctccctctccctgtctccttattagactgtgagatgaacaggctcccagagaagagtgaagacttttggtgtgagggaatgttagaaaaaggaaggccaggggtgcaggcaggtctgtgggtccttgcccctttatttaaatgaggttggtccattaggcctctgcgtgtagcactgcccaccctggttggggccaggagtttctgcagtgggtgtccctttggctgccagcttctcctccttccttgctgaatcctgggggcactgctaaggagatgatctttctgcggggaccttgcaacctggagagaacatagttgggcggtacatggtggtctgtggtctgcggtgatgcacagagttgctgtcaagaatttactgcccccctctgctgttcttcaagcacacattggcaccagtcccaaaggtccctcaggagcacctgaaaaggtggggccttgggtagctttgtggctggaggcagggaggagagagagagagagagagagagagagagagagagagagagagagagagagagagagggagggagagggagagagagagagagagagagagcccagagtggagccagccctcctccccagccctgtcatggtttgtggtggtggtggtggtggtatctttttccttcttactgttaatggcaccctcactatgtggcaggcactttgtaagttggtttttaaaccctgtggacttggaagtaccttgcaatccctattttactgccaagggagctggagttccgagaacagtggattcagatctggttcacaggagagtgcattcttaacattgtattactccacaccccccatgcctgggctttatggctactgcttgtagggttctttaatactttggatgggttcagagcactgagccttgaggctctggggactagggcttttattgactcttccttgcaaagcttattagccccagagctttgtcctggagacctgaacaaacacaggtgttgttttggccaccacagcttccccaggaagtggggtttgatagctcctttctacagcccttcgcctttcacaagccatcgtcttcttacaacagccccttcctccctcagttcctcccccctcttcaagactcacaggcctcagctgggcaactccagtttgtcttccagttgctagcactggccagtttccctggaagctttgggaagcctttggctgagggttgaaggggctaaaggttggaggatgggtctggacggggcttaagaacaaggggttggcagaggcaggcagatttctgagttcaaagccagcctggtctacaaagtgagctccaggacagccagggctatacagagaaaccctgtctcaaaaaacaagacaaaacaaaacaaaacaaaagaacaaggggttgggaggtggtgatcgtggaataagacactcccatccctggccccagagaatgtgcagtgtggtggctcgggtccaaagtgaagtatggacaggtggcagttgggagagattgtgtagaaacagagtaactgtacttactttaaagatctacacattctgtgtaatatttgaaatgtaactctgcgggggtggggagacacctggcgggcccatgccaagatgccctcctgagaaatcacaacatgcaacaaacctaatataagggaggcttgggagaaggaaaggaagagaaggggtagaggcagacagacaggagcagagccaatggggcagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggagcctagcggaagttcctgtaagccaacattcctcctttcttatttaattaaaaatgagtagctaggagggggtaacggtggggcaggagtgaggttgtcctgttctctagattacttcctgatgactgggggtgacaatggctttggggaccctaagaaaattggagtgctggctgcttcactgctgttcaggatccatgagaatatctgcagctgggaaagtgcaggccccgttgaagtatctgccagggtagactgagcacctgtgagtagctgccctggagccgtcctggatgcagatgctgagtaaacacctggacctggcaggacgatggggcagacatatatactaagggcagaggataagttaatgtgaccatatggaacaaccacactaagagtgactatggattctgctgagtgggtggccaccttccctggtcccttcacgtggcttatacgctgaggatggcccaagcctgttgaaggcctttcgtagaacaactgttaagaaagtgtggggcgaggaccctggaagccactgaggcctggggtgcgtgcctcagagactacggtggcccatgaggagactgaccatctgcctgtcttccctttgtattagacgttcacagcctggtgcaactcccacctgcgcaaagcggggacacagatcgagaacatcgaagaggacttccgagatggcctgaagctcatgctgctcctggaggtcatctcaggtgagccggccccagcccaggacccggtggtatctctgggttctgtccacgttcacactggcctccctgggcaccaggcacacatgtggtgcattcgcatacatgcaagcaaaattctcatataataaaaaatacaaaaaaaaagagaattaattaagatcataacttctaattaagaaacatcatcacgattaataaagtagcacacaccacttactctcattccttggagggattaccctaatgaccttagccctgtcttatgacttggagaatcaccatgctgcagccagccaagcttccaggacctgaaccactaggggacaaaccacatccaaataatagcattgtgcatgtcctcttgggtgctcaaagcagtagctggccctctgtttttgctgcacacttcatcttatcttaaaccaagcctgggaccacagactgctctgctctacctttctttccaacttgacgtttgcattcttggctgtctgtttccttctttcatgatccccttcgagccttttgtcctgtgggcttctggtgactcccacctagaggaaaccttgggaaggccgggaaggccttaggttctgtctcctccctgtctcctcctccctgaagtcccgctttgtgaagccgccccaggcctaagatcctctgacagcccaaatatggtcacgttgttccctcgcttggaaggcttttgtgcctccccgagggcttccagtctgggcctcgcattcctttgcagagcccttaggatcatttgagagctggcacctgctttgtttccaaccgactcttcccaaaaaggtagcggacctcaggccctctgccacggctccccagatgacatgccatcctgttccctgtgtttgcgtgacttcgacagattcagttctttaaaaacaacttttcatatttcctttaaagtgaaacctgagcagggcaaaatatacacaatggaaaacataatcattttggctttttttttaaaggggagggattatttattttggctcgtggcttcacacgcgtcagcctgttgtggcagggaggatgtggtagagcggctcagtgggcatcatgacagcaagaggccaagaaacgggtgtgtgaagaggccagagaggtcccccccccccgcccccggtgatattcttcctccaagagccctgccttttgccttcactgacttttaatgatgccatcatattatgaatctgtcaaggcattaacctgttgattgggtcggatccctaatgatgtaattatctctgagaacacccaggcttgtacttgactaatcttggcatctcttaatccattcaagtcaacacttaagactgagcatcacaggctgcctcttgtcaacttgataccggaacacgtcactttaaatcataacattctacccctggaccccagaagactgcattcaatttatctccatgagttcccatggacttggcaattccaacattgttcagaaatctaagcccagagtctctactgagactcaaggcaatcccttagttgtgaacccctgcaataaatacctctaacataccgtggcactaatgagagagctgggggcataagaagggagaatagtactgaaataagaccagaactcagcctggcgtggtggtgcacgtctttaatcccagcactcgggaggcagaggcaggcagatttctgagttcaaggccagcctggtctacaaagtgagttccaggatagccagggctataacctgtctcaaaaaacaaacaaacaaacaaacaaacaaacccccaaaacaaaaaacaaaacagaactcaagagtgaagattgtagccggcacaaccatgtccaatcctggggaggtatggtggtatgatgtgagcttcagtggtcttgggtagcccttccttcctcgtggtttttctcttgtgttggctgcatccactgcctgaggctttcattagcagacattccatattcccagcatgttcagcatccgtggggtttccattatagcgtaggcttcaccccaacagagctctttgtaggtaattcaaccgtgttatacatttccctgcctcccgggccttcctttgaaatcaggatagacactgccatagctctataactcttgaattctgcacgcctacaaaaccagcatcataaggatggagccaagctttctgcacatccccctgtccgaccctgcagtggcttctgagtgcctggatgctggacataggaaagatgctttctggagctgtctcttctcaaaggaaaacttcttttttttccttatgccttgcttttgtgttattattaatttttagtcaccatataaagtaataggtctcactatatacgcatatgcctgaatacttcgttctgattcctctccttcctcattggagggaaggaaagtctgaagcctgtgatgggtggggtttggccagttccttagatgtcaaaggcatctttataagacattttcctcctaacctagtgtaaagtgtttgactttttgtcttgttttggtttggttttgtgtttttaaagagaataagggatattttattctggagctgttttgaatgaccatggcccagaaacacagatttagtttatcccagattctatactgcagcatggatcgtggagtttttgtagtcatacagaacaaagagagtcataaatcaagacagttttaaaatatgttggtggctgcatcagacagacagttacaagatggggcaggcttctctgtaggcccaagatgttatctgatgacattctaagctttgatgggagctagtagtctgctaagtcaatagtgttcaaaagatttctgtcagtcacaagtagttaggtcccacacagtggaagaaggacttagctggggaaggccattaagaaagaaactcctggaggatcttatcaatactgtctgaggcttctttttaacatcgctgatctccaacagtcacaccctgcctgtccacagcttttagctctttttcaggtgtggcttcagggtttccagattgttccatgctgctctttgcccttgattctcactgtaaaccttgctaagagcacctgccaataactatgccacagcctgaatgagatggatgctgtcttgagatttcattagcccattccccttaaacacagcttcccacagagtttcaggtccccctcagaatagactagttctttgccagactgtaacatgaatgcctctagtccattcatgtgccctggcccgatctgcctggttttgtttctgttgcattctggtcttctgactcactcattaagctttgcttatagcatgcttgggttcccctggcccacatctactcctacttccatcttgcttccatgcacctgtttcgtgtatccttttggaggtgtcagctcattgtagcagggaggcatgatggttcttttgataggtccctggacaatgtctgttctcggggtacttttagtggaactttcagcaaaccaaccccatgccacacacacactgtccctcaaattcttttagtctcctgatcttgaaactggaggagaagggtagggtgtgtgtgtgtgaggaagctggccctggagcggagttgagagtgcccacatgaaggcggtgtacgggcacaagcagaggttttccagtgagtggggtcttttcttctttctcctctcttctttcctcttttccttcttcctttcctactggactacagtcacatcaaaggcaggaaactcgtttactcccatattccaagaacctggccggtttctggcatctgttagtaacataacatgtgctggaggaagggagactgctcagtggttaagaggctggctgctcttccagaggaaccaggcttggtaccaaatacccacagtgagtggctcacagttccctgtaacaccagctccatgggaccctcttctggcttcctcaagcctgcgagtgtgcactcacgcacggacaaacgcatgcgcgcgcgcgcgcacacacacacacacacacacacacacacacacacacacacacacacagaggcttgtctctgggtaatggaagaatccaggtagcctcaacttctctctgattgcctgcctagatgacaactgcaaacatctgacaggaacaccatgcgcatgcccatttaagaaacgctttggccgagggggagtgtggctcaccctggctcctggacacttgcacctcaccttcattttcccttcctcttcatcaggtgaacgcttggccaagccagagagaggcaagatgagagtgcacaagatctccaacgtcaacaaggccttggatttcatagccagcaaaggggtcaagctggtgtccatcggagctgaaggtgaggctaatatgctgtgatcgctgtttccttggtcctttctcccctgacttctgggtttgcatgcacctgaaaacaggtacccacatcctccatcattcagccacaccagaactcgcccctttccctcaataaagtctttatgatatgcagttgcacgtggaacgcctcacctgttacaccccacccccacctccatgtcctgcagggtgctctgtgggcaggacagtgcagatggactcctggtggctgacagggccctgggggaaactctgctgtttccaaagtagctttattttatttttgagacagagtctcactatgtagccctagctatcctggaactcactctgtagaccaagctgaccttaaactcacagagatctgcctgtttctgttcctcctgagtgctggggttaaaggtgtgtgcgcccacaaccaccaccttttggggagggccaaagcagcattcttagtagcttctcccatcaccataggtccctagctcttttcccatcacttctgaactgtctgttgaagccattgctcacacgtcttcacagttaaaagaatgcagcagggctcctggcgtacggtgtgctggccctgaaggagcagctaaaatattctaaccagaccctctaatgatgtgacctatgggcacagcccgcgttcatttggctcttgctgggagttgattgacaccatcttaactcacttggttgtaaggaaagccatgctgaaatgctttaagctgcaacactcccccataccccccaccccccgcaccgtggtggaaggtctgtaatgctcacctccactgtaggaaaacatgcttatagatgattgtgccgcttgcttgggtcctatcttctgtgagtggccaacacagaaccccagtccagtccatgtatgacatcagagaaaggcaactgggggatattgcttcccgctaaatctgtgagagcagattgctcatgggtaatgagaaaagtccttttgcttctagacatggaagggttttatgcacatctgtcagctttaacaagggcagcaaactgcagtgtgtggggttgcgtcttgttgacaaaggtcttgatgcacagaaacatctgctcattggcctctctgtcatctgctgcagctttgagtgtcagcagtgaagctcagtagttgctacggcaaccacgtagccagcgaagccaaaccaacttggggggggggcactttattgggaaagctggctgaccccttgccttaccagtctgtgttggtccttaaggtggcagccatacctcggaatcctgacgcccgtgcagccctgaccatctcaagggtagaggcaatgttcctttcaccctgtggccatagctcctagctgatgacaatgggtgtagttcaaagcacgtgtgtgtggcaggtgctcaactttgtggctggaaaaacattctttgcctcttaataagaatgaaaagaacatcttgttctactaggagggattaaagccttggacaattttttttttcaggcagaggaagccaagaaaaatgccactcaatggtctggcaccagttcaggtccccactagggtagggaaggagagaatgtggaaaatggacttgaggaaacaatagggataagtggggactacagtgaattgagagtctgtttccttccaagaagggcaggctcacatagagccgatcaaccgttgtaagtggaaatgcaagactattctggcaggtttaaacaaagaagccagaaaaggcaagacttttagaaaggaaaaactgggggaaggaccaccaaagaggaaggcagagaggtggatgagcatgtcttgtgctagcctgagcctgacccagcaggaggcatcggggattacctcatcaggacaggctgctgaagtgagtttgacagactgtgttttagggtggagggtgctgaggctcagaacaatcaccagagaggcagaatgtcaggtcgtcctgaactatactgcaccttcacgacagagtcaggcccaggcctggggctcaggctccagggccgagttctagccctcttcctattctgataggctccactgtgccccctgacacaccacagcctccccctcccccggcactgctcagtttgccaggccacatggatccttgtgccccactgctgtgctgatccagtcccttctggtcccttcaaccttgttgtaaagtgagatattcgctgtctccttacggtcataggagaaaggctgagacttgaggcttatgaattgaaggccatgaggcagacctagaagggagcactcttggaagtgagaagaatttgaggaccgctaaggaccacatgtggggagtggaccctggcaggacctccattccagtactagcactgaccgaccaggcctagcagagtgaccctgtgtgtagaccagtcctggagagtgtagagcagacctcatggaatggaagccgtgctcctgtgggcctgccttgtccctggggtgtctagatggagccaagttcacatcataagcagagagttagaaccaagccctgggatttcttctgctatgtttgtgcctgggacatctagatttcatgaagtggaggcttggttgggtaagggcttggggtttaaccaggggagagggggacccaagcaggacttttaaattttgagatttagaggaagtttgatgtttgggtgccaagagcttggggccatctctacagttcagatctgtcaggacgggggcgtggtggatgcagaagcctgagcattggcctgaagctagggctctggggctccagacctatcacgtcacacggggtcgttctgctctttgaattcggcaagtgattcctggagtggggaggagaaacggaatccgagcaggaaggatgtgagctgggtttagctcaccatggacctggaatggcagtgcgctccattctcctgaggagcccctgtcatcaggctgcctgtgcggtggggtatccctggtctgcgtgtgagctttgaggatggtatgaggctgacagggctgagacagtgagggatggattctgaacacacctcactgtccttcctcttctctgatgctagccttccgcctcttcaccgtgccttagaatccactaagttcttcgaagtaggagaggaattattaggaacccaaaaaagaaaccacctgtctccctaggactttaaaggtccctgtgggagggcagtttggccctcatggagccgggcagactaggagagagcaaccattctagaaagggctgagcttcaatgttatcactttcataagcttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactagcccaaaagggccttgtgctggccctggactctgggtggagtggaaggtcatggctttgagcagaagagaggggtggtggggctcaggggatttaagtcactctttgtactttgaacatagtttccatgataaataactgaacaacaggttatttatacagaaaccttactctgtactgcaggtctttggccagggacagagatagaatttcagtgccagaattgaaagctctgagatgcttggtccctgttgccagctttttcagcaagtttttttttgttgttgttgttgtttgtttgttttaaagccagattatgcttctagctgcagtgtaataatgtgtgtgtttaaatttgtgtttaaagttaactaatgtaataatgtctggggacatgatagctgatttcatgttctgtatttattcatgtctctctcgcctgtttaccgatgagagcttagactctgtgcatatcaatgtaaacctttttagcggtacggatgacaaagtactggaggttgtagatcaatggttctcaaccctcctaatgctgcaaccctctaatagggttcctctggttgtggtgaccacccccccaggcataaaattatttttgttgccacttcatagctgtgctttttgctactgttatgaattgtaaatatctggcatgcaggatagctgatatatgacccctgtaaaagaatagtctgacccctaaaggggtcaagacctatgagctgttgtagatgaaagctgtcttttacaaaggtcattatgaggtggggcttggtaacacacacctgtaatcccagcctttgggaggtggaagcaggaggagcaataggccagcctgggtacgtgaccccccccccacccaccccagctttacagactcatctaatgcctcccctgtagtagttcctgcagagctcgggctgactgtcctgaaggggaaacagttgtctcccaccacagctgtctgggactctgacatgagcctgtggcccgtcactatctgtggctctgttaacaagttacaacatgctttgtgtcccaagtgaacactggtgttcctttgcccagcacactagtgtattgtggaggagaataagtaagacatccctcagatactttgttcttcactgagagcagcttgccatgggcctgcggcttactgtcctgttctgcaaactggtttggattaagaagcttcagctgagcctcacctttcagcccacaagactgaaacagctctgtggcttaggctaaattatagttttcatttgttttaagttgtccttacttttatttcatatgtgtttgcctatatgaaggtctgtgcaccatgtgcttacctgcagaggccagaagagggcgctggatcccctggaactggaattgcagatggttgtgagctgccttgtgtggatgctgggaaccaaactgggtcctctagaagagcagccactgctcttaacgcctgagccatctctctagtcttgatttatatttttattcttgaaaccaagcctagaaatcaagaaaaaaaaaatggaaagaaaggaagggagggagggagagagagagaaaagaaagaaaggaaaatgtgatagaatttgttgaaaagtgcaagtactaaatatggcagggtgtctgagctgtcatcttgagtgcgttttaaaacaaaaatctattttaaaacttagggcatcttgaggttgaccaatcagagggttgtaaatggcacctcttaaaatggacgtgtgtagctttcttttccctccagctctctgcgggagtggctattttgagagctgtgattgttcacagaccccatttcatcgacctccccctccccacctacgtgagggcttagaaatccatcccctcctatcctcagactgggtgaccatggttccgggtgtacagcatccttcctgatgaatacactgtctcaagagaatcacctgtccctccctcacacctcaagtaacctctcctggccaatcaaagtgtctgtgtggagctgggtgtggcttaggagcggtgagatctgtgtgtgctaggtgtgatgtgtgtgagtttaatcccttgcgcaaataaacacatgaatgaatatgtcagtaatttttttttccctcctggaaatgggcggtttgtgatgtttgacgtctaagtggcgtgacatggcactgtctggcttgctgcgatccacctaacgtgtcctgccactgttttctgtagaaattgtggatgggaatgtgaagatgaccctgggcatgatctggaccatcattctccgctttgccatccaggacatctccgtggaaggtgggtttctgctttgttctgtcccttctcaaactcttctccccctgccttccctaccctgtcttcctctctctaggcccatccagaactccctcatatgatttcaaataacccccaaaagtatgtcagcccagcggcatttctggctttgagaatgccaaggctgttgtggttaagtgtctaaaagcctcacttgggcccttagtggcaaaggataagaaacagaacttaggaaagtgaggggagccccatgcccactgatgcgttcattgctccccctggtggctaccttccagatgtgcacaggttgccctggtatgagagagcaatctctctgtattccttactcagccttttaaaaaagctttgtgcctgatattctgcttatatcacatactgttcagacttttctatgtacatgatatatacatacaataaaaccacacctttttaaacgatgagattgagataaaatgcttttaaaatatacagatttaattttttatgtgtatgggtgtttttacctgaatgtgtgcctgcatattgtgtgtgtgccttgtgccccagcatccagaagtgggcattggatctcctgacactgggattacagttttcagcttcccagatgtgagtgctggcaaccgaacatgaatcctgtaagagcaacaagcactcttaaccaccgagccatctcttcagtcccataaagatttattttatatgtatatgtatatgcatatgcatctgtgtgtggttatacaggtgggtgctggtgccctcagagggccagacgcattggctcctggagctggtgttataggcaattgtgagctattctaacatgggtgctaagaacccaactcaggttccctgcaagggcactgagccacttctctagccccatgccaactcataagtagatctcaccatgtacctctggttagcctggaagctgctgtgtagaccaggctccccttgaaccccaagagatctacctgcctctgcctctgcctctagagtgctaggattaaaggtgtgccgcacacacctggctcccatgccaattttataattggttgtttgtacttgaatcattataacctttgtgctgattcttttttttttttttttttttttttttttttttttttttttttgagacagggtttctctgtatagccctggctgtcctggaactcactctgtagaccaggctggcctcgaactcagaaatccgcctgcctctgcctcccgagtgctgtgattaaaggtgtgcgccaccatgcccggtatttgtgctgattctttaacattattttaaaagtccattttataaattaaatatgtgaggtcactcgggaacaccactagtagtaaaggccaccacctgcagttcacagatctgaacacacgggggcagtgcagcctgaagccttggagctggtagttcaccatccccttgggtgcctggcttttcagatacctgcccgatccacatacaatgacagggcaccagagccagatcagtgcagtaacaggaagaagccatgtttcagccgagcctggacaggcatcctttcttcctggttctccacgctcaccctgtcaaggggcttctggtcatgtaagcttcacgggcgcttacagctgtccttgggacagccaccagttgctgacttaccttatattacagtcatctcttgaatagaagggagttaggcagatagcctcagaaagctgctgctgcctggacgttttagtctatggtgtgagtggcttgcttttttttttttttgtttcttaaataacttttccaactttgcccaacaaatagacatggcggcctagacttcctcctgcctcgtaacaatggaattgagctcttgaggttcctgtagggcctcttatgagcagtgtcctccctcccctgggtcagcccaccgacctccttcctccaccctctttccacagagacttcagctaaagaagggttactcctgtggtgtcagaggaagacagccccatataaaaatgtcaacatccaaaacttccacatcaggtgagtgctgcagccaggaggaggctggcctgtctcctcaaggcctcccctgccccacccttggttggaagagagttggtgggggggagggggcgtcttcttgggaagggtatgtccctttgaatctgccatccctccctgtggtgtcttggacctgactgctgcccatcacacctctgttgatatttgtgacactgtcaagacccccaagattgtatcaggaagcccagggttccagatcaacagactaaggctttagtgaacgggttgggtaggtgggtgtggtgggttcatctcgacttgccaaccactcagaaaaccttgaccctaatccctgggaatgtggcaggcagaaagtctcccttcccttccctgtcttctaaatcctacttcaaagggttgcataataaacatcagaagtcatgttcctcccccactctctccctggacagttggaaagatggtcttggtttctgtgccttgatccaccgacaccggcccgagttgattgactatggaaagcttcgaaaggtacttgtgctcatttgatctcatgctgtcctctcttgctcaatgactggtccctagtgggtggagacgagctgagggaagacagaacgggaccacttctgggaccccagtgtccagcctgaaagttgttggccttatggaccagctacactgagccccatccagaagcaagcaggaaaatgctttttctgttacccagcgtgcacatcccgggtccctttgcacgtatatagtccacctataaagctaccaccagcactaaggtggccgtgtttgagcaatggtatgcaaggtttctcctttcccttacttctggtgtcatacagtaactgtattaattcatgatataaaacatctcttatccagagagacattttttgtccctgtgtccctggcaggcactgcaggtttggtttcttgtgttgccccctcagttttatttaagcttttgagctggtgatgggttttactatattgctcaggctggtctccaactcctggactcaagtggccctcaaccgcccaagtatctgggactcttcagtcgtgtgccattatgtgaccttcatttctatctgggtgtcagctcacttggtgattttcttgtgtgagacgtgtatgttgaggggtgaggaggtgaggctgttgtaaacgcatgtcggttgtgagtgttcaagctggccagtgggcactgacctagacacctccgtaaggtctgtcctggactattttatctgccatgaaaccggtgtcatgagctctgcccagctgtacattgatctggaatggaatgaaaatggaacctgtgggcgtatagccctcttggcaggtgatcttctagaatggacaagcctgtttctcccctttccccaggatacctgagggcagtgtctagcctactaccttgtgcagacacatctgtgccctggggcttcttgctaaccaggaaccagaaaagccctgatggctcctacccaggcaactggtggtggtggcagggcctctggttttagggtagattttttttttttttgtgagaggtggacagagtagatttccaccctaatggggaggagcctgaggcctgccctatgtgcagggctggagccactgttctcaagctaccctctaagggagaagtgagtcccagcctaccagctcagctgctttggcatgggggagaatgtcctgtatgtcacagactgtctcatatgtcatgtgcatattggagagctcctggcttccacttactgacccgtgagcaagactgccctgaattccagtgcatacatctctctgacactccggtctcaattctttgggtgcctctcagaatcccaaggactgctggatccagtgggaatcccatattaaatgtttttcaacattttttgagattattaatataagtacatcatttccctctttctctctctaaatcttcccatgaatcaccccctctcccttttgctctctttcaaaaccatggccaccttttctttaattattgttgttgttttctttaattattgttgttgctgctggtaggaatggtgtgtgtgtgtgtgtgtgtgtgtgtgtgtgtattcctaagtatgtaaatacaagctgctcagtccatgtgttacctgtaggattctgtcttcagggctgaccatgtggtatttgataactacttgctgtgctcttccctggcgcaggctgtttctgcagctctcattgttccttagccgcctgcagttctctgtgtagggttgtggctttcctccttctgagttagcatgtcgactcgtgttaccgttgttcaggtcacatataggcagacattgtagtgaggttcatgtctcaggaatagcttctagcatttataggatgctacagtctcacagtctacagtctcacagtcaactcttcggcttttacagtctcccctcccccagccccctgacacaataatccctgagccttatgcaggagtataactttttgaggaccctccatgccgccctccacagcagccgcaccatcttatgagactgactgagcagtgtggcctgctgggctgaggaggcacctaactccattttacattacctccatgtttgaagtacactccgggatgcaaggatcccagagtccccaacatcctttgccagctctccccatttagctttcgagaaaagatcacagaggcactaaaaaagccatggctacttagaataacccaacacatgggaatccatggtgggtcagcttcaacttctcactaatctttatgagttaagagcacctatcccaactattgagttcagacaggaaggggaggggggggactaagtctgagtcatttacccatgtctcctgccagaactgatggctctcaaccccacttcttagttctttcctactccaactctaacatcaggcctatgtattctcttcccccatttccatactgaagagtgatgggggaagagaatgtttcaaacctctaactagtgacccctaaaaaaggccttgaagtcaccctttcttacctagaacctgagaagggctggtacacacacacacacacacacacacacacacacacacacacacaccgcccatctcctcccagctgcgatgcactgtgacctgtgcctctctgtaggctcactttgtgctttctcctttaggatgatccactcacaaacctgaacacggcctttgatgtggcagagaggttcctggacatccctaagatgctggatgctgaaggtaagggctttcttcaccctcccccaccccagcccccagcagctgaggcatgaaaggagtgggtctgtccactgggacctcagtttgaagagcttgggatccctcccctgccggggattctgtgtggttcggaggaagaggcactagctgacagcacgcaagcagcatagagcaagtttttctggagaagggaaggtaggccttcctgctctatccttgcccttggaagaagcaggaaccatggccactatcccttaagctctccttagtcctaatgttcatgtgccttttacgtgtcttagcctcacagtgaggagctgaagagagtctagggtgggcagtgttggcagggggattgtccaagattgcccccagctctgttctcctgataaccctttatatttgacaatttcttcaagaagattccaaacatgaacggaagcatacgatggtataacacctaccgtcccaggaggacttttgacattccatcacaccttttttttttttcctgtgtccttttgctgtctttgttggactgtgctgaatctcaaacctcatgtcaccgctacctgcttccgagtacatgccttaaagataatgggtatttttgaatgtaattaaaatactttctacagaccagttgtagtgacatgtacctgtaatctcagcactccagggttgagacaggaggatcatgaatctgaggccaacctgggttctatcagtgagactgtctcaaaaacaaatcaacaaaaactgtttcacacctagcaaatatgacagtgattccaatatattcttgtcatgtcatgtgcatgaccagagtcccctagtttaaaatggccactgagggtgggttggctgtgcccgtgcatattcttaggtggtgagctctataggccacattctccttcctttaaccccatctattgatgcccttaaccttgtgattagaggagagctgccaggtagggtagccttggttgcctcctggggtatcagatcatccatgcctctgtgacccatgttcccgttactggaagttgactctgaaagctggctagattcagggtggaccttctggcaaggtcacttcacagtatgccacaccccttgagagatgtgctatgtgctcactaaggtagctttaactgcagctctttctctgtctctctacagacatcgtcggaactgcccggccagatgagaaagccattatgacttatgtgtctagcttctatcatgccttctctggagcccagaaggtacctggggcccctactccttctatgcccagcacacctcatgccagatcctagccatgctcctgccccctccctccttccatccctccatgttccagtgcaggggtctggacagcctggttctggtcttgtgggtagttagctgtgtttctgaagaggtcttgtttgcctcctccataactcagcaattctgctgtctcttaccatccatcagtactgaaaacataaagtgctagtcctctgggatcagctacatgacccaggcagaagggtggggtgtgtgaaaggtcctggttgcaggagaccgtaagccgaagtcccacccctgtgggattgacaggcttcacagtactgggggggaggggggcttcccgttgggctgtcgtacacttcctctcttcacttacccagtttgcaaaggtgtcatataccttccccctcaggcacgatttaacaagtctgtctccagccttgagccctgtcctgcttgggatccccatgtggccactgtccactgtgttcttagacagcatggcctgtgggaggaggggagaggatataagcggcagtgaggccccttctggtaccctggcccagaatgctctgggaggcagagggtataaagccaggtccggttcctgctgtgggcattggaaaacccaaagttgtcactcactaccatgcttaactagggcagcagatgtccctcccagaagcagcacatggctgtgaccacagaaaccttcatggctttggtccctaggcctgccacatgttcctcgtgacctctgagtgacctgtcggaagtgcatgatgggaggttctgcccccacccctgcctcccttgctcatttccctgtctgctcactgtcccttctggcccgctcctctcctcctgcgccctcaccttctgtctcgtgctctctgtctgctgctgctgtttgagttggctctgtactgctctattctctcctcaacctcttctccttctctgtgcagatgtgtaggcacgctaaggccggaggggaaggccatgtgacctaatgtttcatgtcactgccacgccttctcggtgcgcagaaggtgagctcgcccttggccttgcccactctcccggctgccctttggcccatcttgtccccctccacggacagcagtagtagttcccgagtgagaaagcgttagacgctctcagagccctgacaagcacacttagggatggcagagaagcccagcctcttggcagccttcctttttgtttcggtgaacactgggcatagtggaccctccccagaggggaaggcagacaagctgtcagtgcctgaatcctaagccattcccttaaatacccatgattcctgtcacttctgaaccttccttcttcctgcatgactaaggccatcaatctaggcagcagccagggcagggagaggtcttctgccttctccctgatgtctaggccagagtcctgatgccactcgccagccaggcctttcatggatagttagttgcaaacaatataagaataccacttgggtgccatagactgtggagctttgagcattcattactaaaactaccctgcagagaacagggaagctattcttttttcttttcttgttttttctttcttttttcccccattggtctttttgttgtttttgttttgttttgttttttgtttgtttgttttttatttgtttttgttttttaagacagggattctttgtgtagcctttggctgttctagaactcaatgcgtagaccaggctggccttgaactcagagatccacctgcctctgcctcccaagtgctggggttaaaggtgtgcaaccaccaccatctggctttttttttcccccttcatgttggtgctggggttgaacacagggccttgtgcttactagataagcattctatcaccaagcttcatgtccagcagtaaaaatgtcttataaaaaaaaatcagtgtgcctcccccacctctctctttctctctctcatagaaatacctttaggaaaaggcacctctaaaaattgcccaaagacaaccagatgagctggcagcagccctggtacccagcggatgggcacctggacctgcctttctactgactgcagaggacgcagcccttctgttggctcctcagtggccagcctccagcttccaagggatcctccctgctggcctcccannnnnnnnnnnnnnnnnnnnccccccccaagccgggatagaagcagcctctctgcttgccttggttggggtgtttacactcagcctgctaaccacatagagtgcacggccaggctgacttgaggtggcctctcccctctgaccaactatcctgatccttcttttttatggtcttttgcctttaaggattctgcccagggctccatgcctgctgacactggctttgcctgtctttgatgccttctctgtggcctggctgatgacaatgctcaggaggggtgtgtgtgtatatgtgtgtgtgtgtgcacttgtgtgtgtgtgtacatgtgcatgcacagatagatgcatggcatggaagggtatctcctgtgtgttggggagagagtgggatttttgtggcttttcctctgaaatccccccccccctttactgtgctctcttccctttcttcatccctgttgccaccatttcatgcttttgtccatacctcagagtgggagcacagacagtgtggcagagtgtggggtgccctgtttgatccttgggtctcctggtcagagacctcaacaagactcatcctgcagcacctgtctagaaagatctgctctggagggattcgaacttctggtgggagggtgaggagatgaaggagcccttctgcatcccacactcttgtcttgactccctctgtggcgagtcaccatgacaaacaccttccagaactatatccatggctcgccctcctctccacacctttccctggccagtcagacataatagaagtagaaagatccccactaatagccatgtgcaagtgtctgtgtacattgatgtgcaagcatatggtggccacagctgccgagagactgccctcattgggtgaggaccgactgcggtttggcaggctgggttgggttctggttccttgcttcccttccctgcccaggtttaaggatgggtggagagcattgttttgtttgtcaaggttttgtttatgctgctagtgctgttgggggtctcttgggagctatttctaggactggcttttgaatgggaagacttgatttgatgcgggtgtttctggttgtttagggacaggtggagctgcctgcatccacccacctgtccatcaaccactcgctccactagtgtaaaccttctaagggataaagagtatccccgttcacagatgctatctgaggcagtgctcagagcagggcttgcactgcagcgggtctgtgctgaagagacagctgtggggctgcgggatgctgtgagcatcggcttggagcttggaggcttacacagagataaggtgctcccaggaaaggcttgggtaccactagggacgggcagagaccatcactaaggagttactaacagtggtggcaaaggtcagcacagctaaggcagaagcttcaaggtcaccactaggtcactactgaacagggaattctggaggaaattgaggcacaggtagaggaacagatatgtgtccccaaacctatcccagcctgcttgtcttggggaagttcctttctggggctagaagccatgatctgctgggcttagcaaacccaggggaagggtagtagattaggcaggggaagggatagactaggcagtagtagttagcagactggggaggatggaaaggtaattcaagctggaattagggaaatttactacaagcatcaacaaggagatccctgtcgtagtcatacatacggactgtggttaatggagccctggtatgtcacttggccgagtttgaatatttgataacaccttaattggtgacagcctctctatagatggacctgtctcaagtgacttggcactctgactatcagggtggaagtttggcatgggatttctaagtctctaagaacaatggttcatggctttgaaaacaatcataatataaaattaaatgttgtatggccaggtgtggtgagtaataatgtctctaatcccagcacttgggaggcagagaggcaggaggatcgctgagctcaagagcaacctggtctacatagcaagttctagaacagccagggctacctagagaaaccctgtgtaaacaaataatttgtatgttaagttgaacacatagtatggttgaaagtggtcacagagactaaatatgcacatctggccccttcctctggagtctttttttcagctcattggcatctatgtttgcttacatatgatctcaagcagtctgtcatctggaaagacttgggcagcctggttcatgcatgggttttagaatagcccattccatcacagaaaacccaaagtcagaagccagcctgactctgaggtggcttccatctccgcctttctctcagggccatttctttcctctcctgggccaagtccctccctggtgctgctgttgcccccctaccacaactccagctcccaccatgccatgggcttcttgtagctttgaggaggggaagtcagatgtttgggatggctgctgttgccgtctgcagtctgattcccttcattccatgagtgagggctgcagggccagctaagctgacttgtctcgcctctttgactgaggttagttggttgtgacaagcctcccttcattaggaggccgcctgagagcacgtgtcacctatgcccctggaaggcttattcagggttgccaaggaagtggagaaccagtgttctgaggacagcctctgtctttcaagaacctgcttctcaaagatcagaggactactatccctaaaggtaacccacaggtgttcacagactgaccctttataaagaaagcactcttgcgttctgttggcttgacttcactgaaggcaggaaggctcttctggcatgctggtagaggcctcaggctctctctcctgatgaggctagcccaaaaaggacaagccaggatgtaggctttgtttgtaaaagggtaagatccttgcagaaagcctccaggagttacaggtggaagtcttccccagatttcatccaaaggtgttgtctttggctgtggaatggtccacaggccttggcaaagctgtacaaactctagccagtcagtggtggtgcacacctttaattccagcactagggaggcagaggtaggtggatctctgaattccaggccagcctggtctacagaacaagttccaggatagccaaaaaatagatgcaaacttagaccctactcagcctaccaacttggcaaacaagtggaagtttatggctgtcgagcccaggatttcagggtgcatctggaggacagcacatttaaggtgagatttatttctaattacattagaaactatagcagcaagctaccgtggtgctgcacacctgtaatccctgttctctggggtatgaggcaggagaaccttaagttccgggccagcctgtttatctacaatgggggtggggggtcctacccatgacttgttaatggcagtccctgcagttgtagcacctcctggttgcctgtggtcctctgccctaacttgagcagcagtagttttggtaacaccaggcacatcatcacctcagccagcttcatggatcctgccttttggggcaggctcctgggaagcaacagtttcctcagtgcctcaggtaattcaccacagttactcactggttctcaagacggatgacaagcaggacatctgtgtgacaaagggccatgccatctccaggacagggttgagttgagggcagggatgatggctgaggaggccttgctttcgtgagagtggggagtcccagagcccctgtccagatgactgttagacccctctgcttactcccatgctctccttctggagtcccagctgttctagcgcccacactgtaggatggactcttgatgtttcccttgggagagctttaggacacttttgctctgtcccatcccttatgggtcccagaacactcacccaccaggtatgggatttagttggcatttcctctttgaaaaactcttctcggaaaaagccacatgtcatagtctttccatccggttcctgggaagttcttcacactcggtctcattttgtgataacagaagatctttttgttcatcaaccaaatttgggtttttcagccttttctcttacaccaggtcacctgtcctagggtctcagagttcaaatctaccttctcacaggctcataggcattgtcccttatacctaaactgtctcctttctaccttgtggtcccgaaagagctttgaaatcaaagtgtacggttggcatatgtataaggaagcaactcaacttcagaaccactcaagtgggccaggcatggtagcgaatgcctttacacccagcacagaggcagaagcaggcagagctctgtgaatttggggccagccaggtctacaagagttgagttccaggaaagccagggctatatgataagacactatctcaaaaaaaaaaaaaacaaaacaaaacaaaaaaaaaacccaaccaaacaaaataaccaaattcacttcattgaagtggatttggagcacagggtccctgctgctgttgaatacagagcatcttttccagcctccagaggccgagtctcatggggctaggccttgtggctagttacctttccatcccttgttcttctctatgctgaggacaatctctggtctgtcgtggcccagtgcttggtgcacggtgtgatcttagttgagtcatcagtatttgctctgggtttcctaggcttggcaccagtgctggtttatgccttacatcttatcctctgtgcactgccacaacattggcttttctctaaagggctttgagccaggagtcctgactgagagacttcactatcagccagcactttctcctcaggctttcagacttgaagactcacatcttcaaaatcccatcaaatccagctcaaaatcccaagtcctgtgactcctggaattccaggctgggcatgagtttcttcgtttttccccctggcctgagattttggatgcctcagttacttgattcatttcttcccagcatgcgtgatgaaaatcaacccttgtccagggctggcaaagaggtgctgatgcagaagccagtggagggaggggggatgtgacttggagcctcaggggcttctttccaaccgcataggatagcagggtggaaggggttgttggcacaggtgtgtctaggtacccctgctgctggggcaggctggtcatgactttctctatctcgtttccaggcagaaacagcagccaatcgcatctgcaaagtgttggcggtcaatcaagagaacgagcagcttatggaagactatgagaagctggccagtgatgtgggtacccctctgttctaccttggccccagctaggccatgtatgacaccctgagagagtgaagctcccaggatctgtacctgtattgtcattctgtgggcacagtcccaggctggtgtagtgcatgatccaatcacagttaacacagggcagcttggttctgggcctctgggagagcagaagtgaaaacaggaaagatggtctctgggctacagtgggcctgggaaatgccttcgcctctctggctcttgctttttctttcacttactgaatgggagttgagacctgggatcttagaagcatttgcagtctggtaaactgccccttgggaagttttgcctgaactacatagtacagggctatgccaagtacttagaagacatgtgcctgagagggctcagtactgtctcaggcttggtacttagcagtacttagtacttagtagtcaggccagcaggggacaggatgggaagcagtcgatcagctgaccagctaccatttgggctaaggtgcttcttccgtgacagaatccagccctttgacctgctcccctggcctttcggtggctttgccctccagctgagtgagagccagttgccctggctttaatccctgcttcactgcttcagccagtcaccacagcaggctgcgtgacctggcagagccttgggcgcctcctccatagtgtgggggtgatagtagcacttgactatgtagtattcctgtgagtcactttgtgggtcatgcctggcatcatgcaggtgttcgtatgcttcctgtcatccatcctggatcttcttcctctccctcaccatggctccaggctagaaatataggctgtcccagaagccagcctctttcttttggagccagaggttcccattctattacacccctgcttggtgtagatgaagaaactgaggcctggctagacttaagctcaggtctccttgctcttagagaatcctgtggttctttggttcttcccgtatcagggcagagaagatgaggggtgtgggctctgaattgaccatatcctggtcaacttggaggaagcacccagaagccttgctgcaagccatggtgaggtctttgtaggtaattggaagggagagtggaagaaaggcaagctggcctttgcgcatccttaccctgtgcctttcctctgttttgccactgtagctgttggagtggatccgccgcaccatcccatggctggagaatcgggtgcctgagaacaccatgcatgccatgcagcagaagctggaggacttccgagactatagacgcctgcacaagccgcccaaggtgcaggagaagtgccagctggagatcaactttaacacgctgcagaccaagctgcggctcagcaaccggcctgccttcatgccctccgagggcaggatggtctcggtgagtgccaggggcaagtctggggcctgcctggccacctccatcccccaactgcatggaggtgggttttcttctacctacaaacatagtccgtgtttcttatattctaccacacatgcgtgagcccaagcacaaagggacagccactttccccccagactgttctagctcaggtttgtccaactcaaccccagagtattccaaacttccctacaccttaaaaaaaaaaaaaagttttaaacagaatatgtggtcatactgaaccaaactgtaatgttaatttttaatttcatataacctcgagtactttcaaaataaaataacaatagcaaaaccaaagcaaaacaaacctacttttgttatcttaaataaaaatcatttttttagtatggttctaatatgctaataagtaaaatatttaaaattagaagatgtttataatcttactacctactatatactttgttttaattagaaaagatttttaaaatttattttcttcttactattactattattttctgatcctaggcactggatcccagtaacccaggtcctcatgaatgttaggcaagtgctctgatataaggccgaattcccaggccctatttttttttttctgtgagaatagggtcttataaactcatccaagctggcctaagacttaccctgtagcccatgaagaccttgactttggattctcctgccttggcattccaagttgctaggatttcaggcctatgctaccaagtccagttttaatctttatgtataaatataattttaagtggctcttaaagtatgttttatataagattctttcaaacaagaacacctataacaagttgggtgggacacatgtttgtaatcctagctcttgggagtctgaggcaggaggatcacagcaagcttgaggccagcccaggatatatagctaggccttatctggaaaactaaaatgaaaccctaatattgcaatcaatcttctgtatcatgagtgctcctccattatgtccccttttgtctttttgccatcccttcatctttatccttctccatgactttctgagccaggaaattacagggcagagtcatcgaggcagaaccttttatcccttcaaacaacgagtaacaataataacaaaaacagaacaaacaaaatccagacatactgagcaggaccagagaggacaggccaagtgggaggaggcaggagcaaggtggtcttgcacagagaaaataggcctgtgtgtctgtcatgcaagcagtttggaataccagtcctttaaagtccagggcttaatcagatgttttgggggttgttaaagtcactgtgagctaacaggtactcttgagaaatagagggagtgcctctgatgtggggcaaataaatgcctggtgtgtggccaggagaatggtgctcaaactggctctgctctagctgtgccagctgggagccttatgcaaagggcacatgcatttctttctttccgtgatcgtggctgattctctcatccaagctactctccagagcctgatgtccaggatctgggtcccttggcttaattggatgatgtaaatcttggatctgtgtatcagattgcttccttcttaattggtctggtcctctgacttgatcttggacctctgagactagcagggatcctgttggaagctggtcaatgcaggggggctccatagctggatggcccacgtggactcagattccactccctatccaagagtcagggaaatgctaatggctagaggagaggtgaggcagttgactgtggtgagcacgggtgctaagatctggaagcatctcttcctggaaggctgtagccttctccaggttctctgagcccctgcctcccatctctgcaggatatcaacaatgcctggggctgcctggaacaggccgagaagggctacgaggagtggctgctgaatgagatccggaggctagagaggttggaccacctggcagagaagttccggcagaaggcctccatccatgaagcctggacggatggtgagnnnnnnnnnnnnnnnnnnnnnnnnnnnnnnnnnnctgcagagttccctggcagtagacaagctcactaacctccgttgctttagtttctgtgtttgtaaagtggggacattcttagaactgacctcctaggactgtaagggtttaatggcgaggtcgcaggcatgctgagaagaatccctgagagcagttttgtgagagcactacttgttccttgttcgctttaccaccattaatttttcccaagtccttcagggtggctctcagtccctgagaagcatgatcaaattgtctatttccaaatttctgaccagtaggtgttaatgtccctcctgtgtagttgtctaggctggccatctggtgtctgcttagtgatgatctaggttaactgaagagagagtcatacaggacggggcttttcctcagaagctggtttgggttagagcagttgttctcaacctatgggtctcgacccctttggaggtcaaacatccctttcacaggagtcgcctaagaccatcagaaaacacagatgatttataatccataacagtaccaaaattacggttatgaagtagcaccaaaaataactttctggttgggcggggggggggggggcgctcaccacagcctgaggaactgttattaaagggtcacagcagaagtaccgttggtgtagagtgtagaatgtctcctgcccattttctcgcactttgcctgccatattggctggagcccctgaggcagagccagtggtcactggtgccatatgaatgctttattcagccctgggtcatgttcctttggtaaactgggaggatcacattctatagccatctgggagtggcctggcttgataagaaaacacccagctaagtgggcggattgaggatcccatataattaagtacacatgcaggtacagagtggacaggaatggtagagatggccctgattcactcatttgtattttttattattattattattattattattattattattattattattatatgtaagtacactgtagctatcctcagatactccagaagagggcatcagatttcgttacagatggttgtgagccaccatgtggttgctgggatttgaactccgagaccttcggaagagcagtcggcgctcttaaccactgagccatctcaccagccctcatttgtattttttgttttactttatttttgttttgatgtgaaacaatttcatcatgtaaccttggctgacctagaactcacagtgaagaccaggttgtcctggagctctgtagaccaggctgtcctggaactcagagatccaactgcctctcccccctagtgctgggattaaaggcttgtaccaccacacccaacaggaattcatttcttgagactaaggagttaaccctaaccatggaggaaattgtgtgtacacaggggtatccgtggtgatatccacctcaggacaagctggggaggttgggtgtggtaccccaaagagcaatgggaagctctgttggagacatctggccaagtaaatattcacatccatgagttctatgtctctggatttaaccaactttgaagcaaaacactaagaacaaagaggaattatggctatgttgagcttatgttttcttgtcataattcctaaagaacatggatggacagctggctatatagcatttatactgtaagcaacctgagtggtttaaagtataggggagaatatatggagattagtgtcattttatataagggatttgagcatgttgggattttgatattctgagtggtcctgaaatgagttccctacagatcttaaaggaccactgtacccaggaagaccatgaagccaaaataggaattctgatagtgtgtgctgctaaatagttttaaagcagaaaacataatttatattgcaatagataaatgggtttatttgtaaattaaatctaaacttactgtattatgattttaaaggggaatgggggtgggggattcaataccataaagaaatgctttactattgagcacagctcttagcctcacggatcaagaaggtatgaacatcctgcggtggcccaggcacagaggatgttacacgtaagcaagactaagtttgcccctgccctgagagggtccttcctgaggcagcttggaagctttttagggaggtcatttttcatccctaccttcctcttctgagaacaggctcaaaaatacaagagctgcccttgccctaggctgggacattggtgatggtctgagaagtctctagccaccagtggatgtgagcagcagagagtgcagatcactgactacactgagaatgtctgggacagcagaccccccgcagggctctcaggactcacccacaggaccagggacattctaaacctgggcactgatggagtgcttggcttggtttggtttggtttgggttttcctggttattctatacagcatatattgctgtgtttcctgatgttagaaagtgaatgtctggcttcatgcatctctccatattcccgtgtaaccttcatatacaagtagttttaatggtctggaaatcttccatgggtgcagtggcctttccagtccctccccatagttggacattcttgctgcatgtcgtccctgtagattgctgcacagtgagcacctccatgggaaataccctgacaagcagagcctctgggctcaagagttggacaactagactaaacatttttgcnnnnnnnnnnnnnnnnnnnntgctggggggtggggtgtagagttgtgcccatgtgggaaggaggcaatacggaaggcagggccccttcctggtgagagagagcaccagccatttcattcttgtgcagacatttggttatcacctactaccggagcaagaccaaagggtgcccacaccctattttatttgatttttgcctgttaattaatagtttttggtttgcaaaaaattaatggggtttggttaccacatttttttactttttgctttgtttttaaattttgtgtgtgtgtgtggggggggtgttatatgcatgccatgatgcaatggtggtcagaggacaacttgaaagagtggttccttctctctgtttactgtgagctccagggcatcactcaggtcttcaggcttgcacacacgtgtgccttttcttggcagcccagattttgtattttggttttctcttgagacagggttcaaactgtagcctaggttggcctagaactcaatgtgtagctcagggtagcctcaaacatgcgacaatcctcctgtctcggcctctcaggagagtgctaagatgacagacatgagtcaccatgcccagctcccaagccttggtccatggttctgaacttttcttttggaacctcagcagtttcctgtcattggtcgttagagtcaccgtcaactttggttggagcagggactgttggggaggggcagccaccgtccctgcttccagtagaggcagggatgggagggtgcaaatggtgtgtggaggagagcactttcagttcccccagcactgttagtgctcctaacatgcccaggaacaggaacaacagtcccccacagctctctagttgcccacctgtgtcactgtcacttaaccctttgtctcatcccactccacagtgagctggactactatgactcgccaagtgtcaacgctcgttgccaaaagatctgtgaccagtgggacaatctaggggctctcactcagaagcggagggaagctttagaggtaggaccctcccccttggttctttgcctttatgagttcccatgattccctgcaccatccctagctcttgacctgttgttggaatgactcactttgaccagaatgtgtgagtgtagatctgttgctggactttttttgggctactttgtgggtacttctttcttccactcttctctacccctcttcttccacctcttctaccccctaacactaggtaggagagaaaagggatagagaggaaagggggtaatgttactggtagaccacttcctgctatttgggggcattgagctctttgggccaagtttgatcttcgccttcaaaccttcattaggttatctaacttcttattgtttcttctttgtacacaactattttaacaaaccacaacaaccactgacctacaacgcctctcggggccctggcatttatataccctgtcagaagtccccagaatttcaaatgtcacacatctgcagaaactatctgcagctcacaaaatcacacccctgctagaacacgaagggaaattgtagccaactgctgtggacaacctagagcagccccgggtccacacctggggttgcaacaggtgcatattctgtgtttttaaagaaaccagaattctcaccgcagagaatttagctcatcttgcagctccagccctccaagagctgtcctactctgtaaaccagaccctcctggggccaggacatgcgattctagggtgagatgccctgtcaattgacaaccaagactcagagccactcaagagccggttctttctgcctcatccagtcccagtgctcctagaccaagatgctggggttgttgggatgctgactctgggtgtcactctgctaaacattccaccccccttgatactctcagcgaacagagaagctgctggaaaccatcgaccagctctacttagagtacgccaagagggctgcacccttcaacaattggatggagggagccatggaggacctgcaggacaccttcatcgtacataccatcgaggagatccaggtgggtaactccaagagtctggtccttcttaggataaactgaggggcaacgtcctaagggttccatagattaatagtgttagcatatgaggtcacgcgtttgtaaagatttctttatttttatgttgtgtatatggttgttttgcctgtctgcatgcatgtacaccacttacatatagcacccagactcccctggtactagagtctcaggtggttgttggtagtcatatgtgtaccgggaacggaacattggccctctgtaagagcaacaagtgctcttaactgctgagtcatctttccagcctcttacccctacaggatctttgtatccactatgtgcttctgggaagtctggagcacattatctataccatgctggcctcaaactcacagaaatcctcctgcctctgctgcccaagtgctgggactaaaggagtatgtcttcatacccagtccagcacttgaattattttgataaggtatatatgtgtgttgtgtgtgtgtgtgtgtgtgtgtgtagtacaatatcttttttttaaagatttatttattatttattatatgtaagtacactgtatctgtcttcagacacaccagaagagggagtcagatctcgttacggatggttgtaagctaccatgtggttgccaggatttgaactcaggaccttcagaagagcagtcgggtgctcttacctgttgagccatctcaccagccccgtagtacaatatcttaaagataaaggggtgctaaggcaaggtttctttcccataactctttctggccccctgttcccctttccagggctaagtagtatgattagagtctctgtgtatacagacaaatgcatttatctatgtgttctttgtaccttttcttttgtgcacacaaaaatgtagactttattatataccatatcctaaatcttgagttctaacattaaccttggagctcccattggctcccatcttcctcaatcttttatgtcactatagagtattagattaaaaagtttgcagggactaaggatatagctcagttagtagcatgcttgcctagcatacatgaagccctgagttcagttccaaccattgcataaaatgagtatgttgatgcatgtctttaatcctaacattctcaaggtagaggaaggaagagggatttttgcaggaagatgaaggagctagtgttataagaggttccctaggaagcagggctcgccccacccccacatgactgatctgatggtatggtgttgaacattcccagtggtgacaactgagtgtaccagccctcaactcagaacacagctgtttcctggctggctctgcctttgcctttctcaggctagcctgccttgctggttctctgccataagaacctggtttgatgcctccagctcttcactaggtgtgggacttgctacctcttagattcacttcgtttactgtgtctgaggagaggagcccttcctcccttgagtctcagtactaatcatgccatggtctatctagggactgaccacagcccatgagcagttcaaggccaccctcccggatgcagacaaggagcgcctcgccattctgggcatccacaatgaagtgtccaagatcgtccagacctatcatgtcaacatggcaggcaccaacccctatacaaccatcacgcctcaggagatcaatggcaaatgggaccatgtgagttaataggctgaacggacaggcataggctaaaccatcacacatttcttaagggcaagatttttatctttatctcagtggtcttcatttctttatcagtgaatgaatttctagaccaagttgacatcttcactcttgctgcattttgactttccctttcccttgccactcgaatgacccccatttcctcacctttgaggtatctggcccacccacagagttgctggttgttcccaccccaggtacggcagctagtgccccggagggaccaggctctcacagaggaacatgcaaggcagcagcacaatgagaggctacgcaaacagtttggcgcacaagccaatgtcattgggccctggatccagaccaagatggaggtgagttttacattgggaagcaggctggaaatgttctttctcttcctacttaacaccattacagccagtcacctgcttactaggaaggaccatgatgtcccaggtccaagcctgtgattattcagttgcaggggatgctgactgctgacagtttgctccctttgtcagattggagcaaagtaggacactattaaggaactacctatgaaaattccacaggaagagcaactgagtaccttggtcagctcaggccctctctgggttttcttgtctctattaccgctctcctgtcagtgagcatgattcttttcagagagccgagcctctcgacaagtatagaaatatttcgtaggatggagaggatcgatcagggaaggagtgtagccaggatgtgatcactgaacatcttgtacacagcgtccatgccaagtttgtgtgggtgtacacatacgcacatacatgcacacacgctcatggacatggatccccaagactctacttgtaaatgcttgataagtttttaacaggactgagccgaatgaacaaaactgccttcaccaagaaccacttaaatgagtgagtggctggcagaagtatgcattaggcctggcacccggggacgaatggggatcagtaggaattggacatccatcctaggaggcaaaacagcagggttatagagaagacccatcaggggaactgagaaataagaggggccctgctcaacatagatagatgggagatggttgggtataagtataggatgcagcttccctatcaaggaacgtccacgctaaatagctttccctgctctgtattgccagtgctaacctctttagggcttggaagatagctaggagaggtgactagggactggtccctgccccaggagtgcagagtaggctggtatgacaagacatctccttctgatgagcaggagattgggaggatttccattgagatgcacggcaccctggaggaccaactcagccacctgcggcagtatgagaagagcatcgtcaattacaagccaaagattgaccagctggagtgcgaccaccagctcatccaggaggcacttatctttgacaataagcacaccaactacaacatggaggtaaataggcctggcctcttcctagcctccatttggggtagcatctcccaatgaatcaggctggaggaggagaaggagggttatgctctctgcccctgaaactctgcaccttcaatctgctgtaccttctggatgccagacaacttgttgcaagtatgcacatctggtccctagctggaactgaatgagccttggtttgtaacaagcactccccagtgattatgatgctatgggctcaagacatcactggcttaggtacttcctaaatgatgtgagctcttcatcccttaataacaggatatgttctgaggtttgcctcgttaagtggtctcctctttgttcaaatatcagagtgtgctttcattggctgcagtgttaccatgcagccacttgagaccaccgtggtgtatttgacttgtcactgatcagaaggccattatgtggtgccagctgtgtgggtttccctcaaaggtttatttgtggatgtatatgtctgtatgtgtggctgcggggtaggtcttgctgggatgggggcattctggttttttagcttttcccaccacaaaatctaccttccttcactagcagagttccaatggtaaatccggatcttgtagctttttttttttttttttttttcaggcaaaggcctgttctttctggcctctttcaggcctcccatcctgatagggtgtgatgtgtccctcctgatggtgatactgtaactatagatagaagatcaagttaaatgttttttttggttttttttttttttttggtctttatcttatggctatgagtactttgcctgagtgaatgtctgtgcaccgtgtctgttcctggtgccggagaaggccagaagaggatatatcccctggaactagaagtatagatggttgtgagctgccataggggtcctacaattgagcctgggtcctctggaaaagcaagaaatgctcttaaccactgagacatctctctagcccctacttctgccatgtttgagttgggaggagggatagttagttggacagcctggagcccagacctggcgctcctttctgatgggcttgattcttgcttctagcatatccgtgtgggctgggagcagctgctcaccaccattgccaggaccatcaatgaagtggagaaccagatcttgacccgggatgccaaaggcatcagccaggaacagatgaacgaattccgcgcctctttcaaccactttgaccgggtgagagccccagttcttgttcacctagagtggcctccaacccccgacccagagccctggagggcattgcccagggcataagcctggtccttgggtaggtgaggaggaggaggaggacagagaggaagaaactgtgaacagcctgccctgactcagtatatcccacagagccaggctttctgagctgaccttagcaatcccactttgccctgtaaaccttcacagcgttcctagaaagaatgggtgaggaggggaaagcccctcttcattcttgactctgtctcctgtgagaaattaacccttggaaaagatactgccagagccaccagtaaagctctgtgcctgtggctgtggggactgtcccttacctctgccttgggacaaaggaaccaaaagagatctgctcttacccaggctgctttgggacctgttgaggacattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtcacctggggcacttctgggaagcttctcacccttgtggctcatcatgttccccctctggccctgctttcccgagcaggactgtgttccagggaacagggcccccttctggagccttgtctgtgtgtctaactgtgtgcatttttatttcccgtttcccccacccttcccctccaccctctccatccatccgcatgcctttgtccccgtgtctccccacacacaccaccttccaccccggggcatggcccaccctcccccacccccctcacggcctcctcttccctggcaccgcatggctcgctgcctggcgcaccacggccccaggatcactccggcacgttgggtcccgaagagttcaaagcctgcctcatcagcttgggttatgatattggcaacgacccccaggtactcgcctcctgcatggagcacgctcaagggtggcctccggggcgagaaataacgcatttctcctttttttcttctctctctgtctgactctccctgtcccccttcctgtgggccacggggctcatcctcttctgctctccctgcctgcccactgtccggttcctctgacttctgacctctgccttcggctatctttcctgggaacctgcttgggtgtccgcctcctctccctcgccacatctcatctgtggactggacttctgcatttctttgctctgacctccttcaacatgttcctcctacattcttcggctactcctattcttcgtaccataaactgggtcattcctttccactgtcttcctggcctctggctggcccctcctcctcccacctgtctgtccctcctgtgtcttggcgccactgccctacagaagaagacgggcatgatggacacagacgatttccgcgcctgccttatctccatgggttacaacatggtaacgtaaaccccctcctccgcctgccaggctttctaaagttgccttggccgggaggcagccacctgactggagaagctaagtcttagtaatggtggacaaaggctcttaggttagaactgccctcctcgggggagtcccttatggccatccttggggaagatggcacctgaaaaccagaccacccatggggccagggtgtggctgggaggcttagcctcctcatcatggtctctgaaccagtttatcttatggtactttctgtggagaaagggctttttcactcccacagtgaacaccagctgtggacggccaaccccaaggtttatagaatgataattctactttgtcttacatgacaatggtggtttatacttctgccctggtagtagctccatccagacctgccaccactcggtcttgacccaggcctctcgctaaccttgttttgtcccctctgcatccagctgagctggataggaccttagctggatagacaggtgtccactgaaccaagtacagagcccatgggatgcccagcagggttaaaggctagactagaagtatactccgtaaattccacattgctatcaaagcttgtggtctcagatgtagtgaggaaacctcacaacgtggttgtaagagttaaataaagtgatcacaaggactgcgtacttgtctggcacacttgtcatgttaaggaaacagcatatgttggagctagactgcctgcgtcctaatcctagctccctacctcctagccatgtgaccttgggtaagtcacttaccctgtctgggcctcagatttcccatacaatgggaatactatgattttattcagttgtgatgataagatgaatttagaatattagctggcctatataatacatgctgtatgagtgttagttagccattgttgaagttatcgtcattataattaatactacccatcattttctgtaagtgaaacccagagctctgcagggggtgggaagtcctgagactcacaacgtttgggtcactttctcaccctggggcaacccaagccagatcagatgtctgttgtgcctcctgttccaaccataggcaacttggagctggaggtacacttgagatgccccagtaggccgttagggtgacaggtgtgggttggttgtctcctccagggagaggcagagtttgcccgaatcatgagcattgtagaccccaaccgcttgggggtagtgacgttccaggccttcatcgactttatgtcccgagagacggcagatactgatactgcagatcaggtcatggcttccttcaagatcctggctggagataaggtaggatgtgctgacgctgagacagtgggtggttactgtaaatcggtaggatgaatgaaaaagtccgagtgaaataggtttggaaggaagttgaagtagatactaaaatggaaaacgtgacgtgtttaaaataccatatacaagtgatatattacttgtaaatatataatatgcacttaaatatatatatgtacatacacacggatgtctctgttatatgtatgcacgcacgtattctacagatcaagtagagcgaggaaattagaacacgggtacttaacattcccggcaagtttacgacctaatagttgcggcaacgccgcgttgctttccggccgctgccgaggtttccgaccctgaccatgctttctccgcagaattacatcacagaggatgagctgcgccgtgagctgccccctgaccaagccgagtactgcatcgcaagaatggccccctacgcgggcccnnnnnnnnnnnnnnnnnnnnctcctcctcctccggcccagtctggctggctgggttcattattttcagctcagccaccaagggggcagagctccgacccaggcggcatcaagcctccctgcccacaaagtgacagtttacaaaattattttctgcaaaaaaggataaaaaaaaagttacgttaaaaaaaaattttaaaaagaaaaaaaaaaacaaacaaaaaactacatattttattataaaaaaaaaagtatttttttctccaccagtcttaaatggaaaagaggaaaaattaactatttgcaccgaaatgtttttgttgtgacataggaaaataaccaagcacaaagttatattccattctttttactgaagttttttcctcctacctgttctgtctgctgtattcatttctctaatttcatgcccacttgggggtggggtaggtgggtactctcatcagaggcacattggtgcatgtgtgtttgctagctcacttgtccatgagaatattttatgatattaaagaaaaccttttgaaatggctgcttttcaaagaagataattcatggcttctcatttttcagtctcttcaaaagtgtggctggcctgttttatgactgcagagttgttatgttttttaattttgaatattgcctattaaagataggacaaacttggagattatgatgttgcttggcacagactgtattaaaacaacactcccgtgacattactttgcttgttcctttggctgacttccagaagtgggggtgggttgtgtcaagaatggtgtggggtacctgtcctcacccacctctagatttctgagcctggtttggtacattctcacttctttaagaggagaagatggcctcctctatgtacaggggaaagctaacaagcgcatgaaagagcccctgacgaaaacccccagctttcttggttctctgtggctgtctgtgacttctctgtgaccccgaccattttgtttttgctgcaggggacagcttggattgtgtcagggttgtagtcctctttcctactctaagtgttccatagagtactggggcttggtggcagggtgtacaaccagcctatgccaggccctgaattcaatcccttgagaccccaaaatgtgccacagatagtagctgttggtcattgcagggactcaatgacaatgcagattgccagcattccccccatatccaaacatatatgatgataagctccaatttatcatttgttgtctaagaatatatggtggtggtgggagcctgttgttagaatttccaagactacagagcagagcaagagcgatcatggttaaaataactttgcaagtagagatatgtcgagttggggagttctgcctgggggcggttttaaaatccctggctgtgcctcctgaaaatggtgggctggctctttgccaggttcccattcattaagtggtgctgttataaagtgatggtaaatgggtatggagcatgagtgttggctgtggccaatctaaagattctgttcagaagggagaatcacttgaaagtaggtcaatgggtaggcccctaccgccaagcctgaaggcccaagtttgatccctgagacccacatggtaaagagaaccagctctcaaaagtggtcatctgacacgtggatgtgcacacacatgctcgcacacactaaagaaatacatttaagatttttttctttaaataggataatccttagtattaactgcatttagggggactaaagccatctgaactttctgggctaagctagagaagtctatggtgaaaccttgtagggattggttcaggggacattcttgagctctcagtctggtctggcctctgggccactgaggatatcctaggtgagggattggctcttaccttgggaaacttatgcatttacccttaaaaaagtaggaatcgtggaagataatctatgtctgtggagaaagcactagtagtagggtggtcctggtttcaaaaccttgagagggcagagatatttgtttttagctatttttatgcaaattatcttaagataaatgtaggctttgggggaagaaagtcttttaactgaaagtttttcagacccaggatacaagcattctgatgctccagtttctaaaggtgtgggtagtctatgtccttagcagggctttaaaaaaatttttttttaagcatttgtttactggaggacaggggtcgtgtgtataccgcagcaaatcaggaggtcacaggataacttggagttggctctttcctccagcacgtgggttccagggatcaaactcagattaacaggcttggtggcaagagcctttacttggtggctggtccttcatcagtgtttatttttaacgatcacgtaagtcatttgaacaaaagtgtgcctgcccaccaagttatcccgtaaattagtttttagtctgttgaggataaagaattttaacctgggttctccttcagtgctgagcatggatcccagggccttgtgtgaatcagacaagctctaccacccagttagcttcttcccctgttgaaacgggcatttaaggccatcatacgcatcttgtgtgtgtgtgtgtggtttttttaatcatttgttcattttaacagatttagttcctcccccaaaacaaccccatttggcaaacctcattaaactcctctgaacattttaaactataattacaagttttaatggttttccccaggatattaaactccagggacatcttgcttagcacaaaacaactgaaaatgttataaatacaataaatcaattcctgtgagcaatctaatgctgtttgactaactgatcccctccgacttccaaaattaaaatcacgtgccttagtcatgtattttagactaaaaccacaaaactgaggcatggcggcctcttttacttgttcatgacagtaggtcattatgcggacagatcacacaccaccagagcgtcgggtgtacttgtttatttattttagattcaaagtcctgtgctacttgcttctgcttttgaggttgttacagatcacatggactttgtaaacaggcataagacaaccatcttcagggctgttgcatttaaggtcattcaaggtgaactccatctcttaatagaaactgtctgcctgtcaccaggtggtgtagcctgccttttatcagtggacatcttttgcattctattcttggtcgattttactctaaatgcttggatgaaattcccttctgtgacccagctagccgctagctcctcctctgtgggaagcatctctttcctgtctgcgtggatggcacactttaagtttacatcttcatccatcttagacccatcctctctggagactgttgacagccccacaaggctggtctgtggataaggcacctctttctgactctcgccggcaccttcacggccaacccctagtgactcagtgctgttttcattgctagaccatctctaagtttccctctggccacaaactcagtagccagagcacagtcacatggctagtaagtacagagtgtgttagccagctttctatcagtgtgatgaattacacagagtaatctatacgagagacggtgactcgtgaatccgggggtttcaggccatcctcacttggccctgttgcctctgggcctatagcaagacagcagcacatcaccgtgaggaggcacatgctgaaggatgtgtgtacctgctacagccaggcagcagatgtttccttctacacagctccagttcctatgggtccagccatgtccccacagtaccccaggctgtaacagggccgtcaatacatggcctttgggggacacttctgatctaaacccacagcaccaggatggagagtgccagctgcctcagaggtagaaaggaggcgttggagatgccaccagttccaccttttgttttatccacaggtgggctgcaatctaaaaagagtagagtgagggctggcgagatggctcagcggttaagagcactgacagttcttctgaaggtcctgagttcaattcccagcaaccacatggtggctcacaaccatctgtaatgagatctgatgccctcttctggtgtgtctgaagacagctatagtggacttatgtataataaataaatctttagagcgagcagggccaaccggtagtgagcaatcttcattcccaacaaccacacgatggctcacaaccatcagtacagccacagtgtatccatatacattaaataaataaataaatctttttaaagaaaagaatagagtcatagaaacaacaactgtcaacatgagggggtccttttgtcaataacatggactatctagccagctcagcaatacatggtaggcttcaggatgtcatggaatacaggaactagagagtaggctccacataggaccagacacaggatctgggaagccctggggtcctgctatctcttgctgttggcctgccccactcatgggtatctcttctctcaaagtcccactttcgagtcatgtgctcatgacttcctggggacagactcacagcacagaagctagtgacaatccccaatgtccagaacatgttggatggtgactgttgctcattggtgaggtagggtataaggggaccttgtcagagctatttccatccctcagtttcccatttcatcaactctgaaactgaggtgcaacttgcagccagtcttaccagatgccttcaacaagacatgtggcactgtcagaacttgcagagtggatacccagtaagaacagggccctagacaacctgctgactgtcaaacgcagcactccaagtctgacagggttgggctctgagcttgatggcatggtgactgttgacacacgtatcgaaataggtcaaaaccaggtctgatggtaagcattgagtatgcacaggcgaatacaggaatgatactctaaatatggaaagactaggttatagtttaactagctacactttcgttggtcgtttgagacagggtctcatgtgatgcaggctgcccttgaacttgctaacaggttgggaaagttgctcttgacttctataggatgtcaccctcataaatgaaaaaataaaattagaaaccagctaggcagtggtgacacacatgcctttaatcccagcaactgggagacagaggcaggtagatttccaagtttgaggcctgcttgggctacggagtgattttcaggacagccagggctacacaaagaaaccctgactcaataaacaaacaaacaaacaaacaaacaaacaccaatttttaagaaagctagactgccagcattcaggaggcagaagcagcctggtctttaaggccagcctagtctacatagccagttctgtgagaccccgtataaaaaaaacaaaaaccaagcaaaaaaatcaagatatccaatgacagtatagaacatggggatttggggacaggaggtgccaccctctcagaggagaatgggaggagggactgggagagggggaggctagggggcattgatatagatgcaaaatgaataaaaaactatttcatgtaaatgagtgttttgcgtgcatgcgtggtgtgtgtgtacccatggaagccagaagagggtgctgtaactctaaacctggaggtacagatagttgtgagccactatgtgggtcccgggaaactgaacccaggtaatttgcaagaacaaacatttttagctgctgagccatctttccatcccctggaaaggacacacattgtgtggaatttaaccacaaattaatttcaacattttattatacactttgcttttctgagatagagtatcatttagcgaaagctagcctcctagttaccatacagccgaggatggcctggaactcctattattcctgcctctatttcccaatgctggggtcaccgtatgtgctaccacaccaggcttaacataaacttcctctttatcacttgctggcagctctcatttccagtcatgctgtcttaattgtaagttctcttgagctctgcttttccaacaacacgaggggtttgctaactcatcttctgaaagtcattttaaaaggcgttatgtgatagatgtggtagggtaggtagcacagatctgtaattccactactccacgggcagaagctgagacaggaggactggcagtttgaggccagcctgggacgcatagcaagaagtcatttcaaaggcccaattcctctcccctaagacttgtaaagacatagggagccaggtatgtagcgcatcccagtaatcgcaaggtgctcggaggaggtggagatgggaggaacaatcgtgagttcaggacaaatcgcaccggaaacaggtaggcgtagagaacccccgggctcagcctagctctatgaagacgctgctgcattaatggtttttacccgagaggaaagggtcggatgcggaagtccggggaaggtacagtacgaatccgtctctgctcttccgaagtgcgggccagcacagtcagtggctcctctctctagagatctaagtgactaagtgagcatgctcagctcgatacagcttctctggttggtctcctcttggtcaacacgtttctctggtgttttggacccattaaatccacagccctgacaaaaccaataaggcaaacgggaggatgagagctgaaaaagcgcccgggccatagtgatggtcacaatttcataaaagtatgtattttataagaataaagtgaaggcctggaactgtaatatccaaaatgaattcaaaaccacccagtactttcccccttcaaaaaggacttcccaaactgtccttgcaggccaagtgcagagccagataaggaagctggctgactaaacaaatgtaaaaacagagttttagtggtcaaaatgattaagcctgcagctaccaaaacaatattagctgttctcaagagaaataacaataacaagattagcaattctcctgccccctgccccacactgaattctgacaaagaccacaaaccaccctgaccttgttgcaagaattcccctgacgttcgttaatagctgtgacgttaatgtactattactttgctgaccaaatcataataacccaccatgggggcaggcaaagtgagtcactaggccaaagggttacttagtcactatacaaaccaaccaatgacaccaatgagaaccctgttgctcaaatctgccccttacaaaggtataaaaagtgtgttctttctttgttcttggtctctctcctctggcctgcatgccgagaggggagtccccaacatgttggatcaataaaattcctcatgcggtttgcagcgatggcggcggtctctgtggtctttctgagtaagggtcttttttttaaaaaagatttatttatttatttattatatgtaagtacactgtagctgtcctcagacactccagaagagggcgtcagatctcgttacggatggttgtgagccaccatgtggttgctgggatttgaacttcggacctttggaagagcagtcgggtgctcttacccactgagccatctcaccagcctgagtaagggtcttttgacgaactccaacagaacttggtaaaacaatagcaaagcaaacaacaacaacaaaacaaacaacaaacaaacagaaacccacctcttcaaatggaaagtgtccccacaggattctgaatttaatgagccacagtgtgctgaagcacttaactagatctgctcctcaacttggaagtcactggtgtcacctttccgcaccctaccacgtctgcacaaggtccttcctaattcaagcttacgtgatttcaatactcatacccagcaagggaagtgggacacacccaataatacaaaaatcaaggctcacggttaacttggtactttgtttgggaattagaatggtgtcttcttgcccattcagaatattttgtctagaagaacacctacaaggctctactgaaggcaaagtttcacttggtaaagtgagaaggggcggagcctagcctggctacagagagatggggatggacccagtgtggctacagagggaacgcagtaggaatacagagagttagagcggaggttcccaaccttcctgatgctgtcacctttaatacagttcctcatgctgtggtgacccctaaccgtacaatttcttgctacttcataactataatttgctactactatggattcataatgtaactatgtttctgatggtcttaggcaacccctgtaagagggtcctttaacccacaggttgagaaacactgggttggttagagacttcattagcttggccaaattcaaacacgaagggaaagaaaatggctgcgtggagaggcctgacagcccagcccggacctttctgttgacaagtggggacctggagtgtgtttctaacctaccagtaggtaggctatggcagagctaaccccatctcctggaaagctcaatgcacgctacacaatagcaaagtttgaagccaaagcaagtgagaggatagaagagagccagcaggagtctttgggtttcatagaagatcaggaccagatgataaaatagttcatcaatggcccaacccagtgacagctgtgacactctataatcaccggttagaatcctaaccaaagctggtgaagccaggaccgtttactggcttaaataactgatgtatcagggtaatgctggtttcccataatgctcaggcaggagtcaagcaacagagcagggtttcattctctctggtttgaccccattctcaaatacctctctccccaaggtggcaagatggcagctgctaactctagcttccccaactttccatggctagtaaagaaacacatgggggtgaggggagtgatatccactgtgggcatgcaataaggcaaccccaaacagagcataggatttgcttgtaggcttggcctcacttaggtcctgtgcacatcttacagtggggtgtgcagccccatcccagccacgtggattcacggcaacatcttagggctctgcaagcagccaaaagatgttcaaaggccagcatgtaccacagatacccacagtgacgggggatgaagggatttctgtcctgggccagaggctgtggctggaggaaaggggagctgggactgggtggacagctatagggagcctccagctgctactgacaccacaacgcctgtaccttcgtacaggcccataggggagcacagaagacacccagtctgaggaccagcaggctccttcagggatggggtatgagtgcctccacgtgcttacatcagggattggttggtttctcactgtgtccctattcatagtccagtccagctgtctactgtggtagctcatagctcaccattatccaccactggctggctacctgtctgtccctcattctctttccatgtctgcctcttaacctcccacatagacctcatgtagtggtggatgcccaaatggacatattgaccattctccaggttctgcttggagagtggctatcactgggaacctctgtctagctcctgagatgggaacccagtccttccaagtgctagaatggtttgattctgcagggtgggaagccattcctggagcctggttgaggtgggaaccctgagagtctagaaggagctaccaccccacctcccccgaggcttcctgtatatttttccacacataccccagctggaagggtggagaatggtagcctgtgcagacagaaagtgggggggtattttggtgtgcagttgtgtggcactgcaatgaccagtaaactgtcactgggcatgtgtgggagaccctaggcttaggaacaaaattgttactttataattcgaggcattgggaaaactgggttttaaagaaaagtattttagggtattatataaactgtattttaataagctgtgtgtggacttgtaggctttatcttaagttacagtagtcataaaggacttcttgaaggagggtg

SEQ ID NO: 896 - DNA, 2770 bp, Mus musculus
gattaggtccgagcgcgcgccccaggaaggcagtccgcgagctccagccgccgccggcagcagcagcctctgcgaacagagccgcggcggaagcgggcgcaggggagcgagcccggccccgccagcccagcccagcccagcccggcccagcccagcccagcccagccctgccgacaccctccccacacccgggcagcagccgccgtcgcctggagtagaaggtggaggaagaaatccagctcctagcacgcacgcaccatcatggaccattatgattcccagcagaccaacgactacatgcagcctgaagaggactgggatcgggacctgctcctggatccggcctgggagaagcagcagaggaagacgttcacagcctggtgcaactcccacctgcgcaaagcggggacacagatcgagaacatcgaagaggacttccgagatggcctgaagctcatgctgctcctggaggtcatctcaggtgaacgcttggccaagccagagagaggcaagatgagagtgcacaagatctccaacgtcaacaaggccttggatttcatagccagcaaaggggtcaagctggtgtccatcggagctgaagaaattgtggatgggaatgtgaagatgaccctgggcatgatctggaccatcattctccgctttgccatccaggacatctccgtggaagagacttcagctaaagaagggttactcctgtggtgtcagaggaagacagccccatataaaaatgtcaacatccaaaacttccacatcagttggaaagatggtcttggtttctgtgccttgatccaccgacaccggcccgagttgattgactatggaaagcttcgaaaggatgatccactcacaaacctgaacacggcctttgatgtggcagagaggttcctggacatccctaagatgctggatgctgaagacatcgtcggaactgcccggccagatgagaaagccattatgacttatgtgtctagcttctatcatgccttctctggagcccagaaggcagaaacagcagccaatcgcatctgcaaagtgttggcggtcaatcaagagaacgagcagcttatggaagactatgagaagctggccagtgatctgttggagtggatccgccgcaccatcccatggctggagaatcgggtgcctgagaacaccatgcatgccatgcagcagaagctggaggacttccgagactatagacgcctgcacaagccgcccaaggtgcaggagaagtgccagctggagatcaactttaacacgctgcagaccaagctgcggctcagcaaccggcctgccttcatgccctccgagggcaggatggtctcggatatcaacaatgcctggggctgcctggaacaggccgagaagggctacgaggagtggctgctgaatgagatccggaggctagagagtgagctggactactatgactcgccaagtgtcaacgctcgttgccaaaagatctgtgaccagtgggacaatctaggggctctcactcagaagcggagggaagctttagagcgaacagagaagctgctggaaaccatcgaccagctctacttagagtacgccaagagggctgcacccttcaacaattggatggagggagccatggaggacctgcaggacaccttcatcgtacataccatcgaggagatccagggactgaccacagcccatgagcagttcaaggccaccctcccggatgcagacaaggagcgcctcgccattctgggcatccacaatgaagtgtccaagatcgtccagacctatcatgtcaacatggcaggcaccaacccctatacaaccatcacgcctcaggagatcaatggcaaatgggaccatgtacggcagctagtgccccggagggaccaggctctcacagaggaacatgcaaggcagcagcacaatgagaggctacgcaaacagtttggcgcacaagccaatgtcattgggccctggatccagaccaagatggaggagtgcagagtaggctggtatgacaagacatctccttctgatgagcaggagattgggaggatttccattgagatgcacggcaccctggaggaccaactcagccacctgcggcagtatgagaagagcatcgtcaattacaagccaaagattgaccagctggagtgcgaccaccagctcatccaggaggcacttatctttgacaataagcacaccaactacaacatggagcatatccgtgtgggctgggagcagctgctcaccaccattgccaggaccatcaatgaagtggagaaccagatcttgacccgggatgccaaaggcatcagccaggaacagatgaacgaattccgcgcctctttcaaccactttgaccgggatcactccggcacgttgggtcccgaagagttcaaagcctgcctcatcagcttgggttatgatattggcaacgacccccagaagaagacgggcatgatggacacagacgatttccgcgcctgccttatctccatgggttacaacatgggagaggcagagtttgcccgaatcatgagcattgtagaccccaaccgcttgggggtagtgacgttccaggccttcatcgactttatgtcccgagagacggcagatactgatactgcagatcaggtcatggcttccttcaagatcctggctggagataagaattacatcacagaggatgagctgcgccgtgagctgccccctgaccaagccgagtactgcatcgcaagaatggccccctacgcgggcc

SEQ ID NO: 897 - protein, 842 aa, Mus musculus
  VARIANT (1)...(842): Xaa = Any Amino Acid
HARTIMDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAERFLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQAEKGYEEWLLNEIRRLESELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEECRVGWYDKTSPSDEQEIGRISIEMHGTLEDQLSHLRQYEKSIVNYKPKIDQLECDHQLIQEALIFDNKHTNYNMEHIRVGWEQLLTTIARTINEVENQILTRDAKGISQEQMNEFRASFNHFDRDHSGTLGPEEFKACLISLGYDIGNDPQKKTGMMDTDDFRACLISMGYNMGEAEFARIMSIVDPNRLGVVTFQAFIDFMSRETADTDTADQVMASFKILAGDKNYITEDELRRELPPDQAEYCIARMAPYAGX

SEQ ID NO: 898 - DNA, 135800 bp, Homo sapiens
aagaaaaggcatgtgggcaggagtgtcaggaggggcatgaggtaatgttcccagagtgctctgagccctctggttaaaggacatttaaccacagattattatactacctattatttgtgtctgtaataactgctatgacaatggatgctgcaaaggtcagccctggggcttctgttgtctgatgcacttagtaagggttgggggtggaaaagagttgatgaggcttgctattgatctaaacacttttcagctggccaaggccaaggtgtgggggggggcctatgagaaactccagatgaaactgatctcctctgggactcaggcaaggatggcagctgaaatttaacttgaatatgtgcagggtaagtcccatggtgtaaaagctcatctcagcatctttttgagtgcaggactctccaccctgagaggctggaccagccacagagagtaggcactcactcagttcagggcagaggcctgccttggtcaccaagcatgcagcatgccaggtggagtggggccctgggctctgggctcctgaacagttactaggccccacaggagtttggactgccctttcctgtctagagtcatctcagatctcactgagcattgcttggtaggactgtagcaattccaccccttcaccttacatgaagagagggaggatcttggaggagaaaagtctcaaaaaaaaaaattaataataataaagagtttgagaccagtctggccaacatggtgaaaccctgtctctactaaaaacacacaaaaaattagctgggcatgttggtacatgtctgtaatcccagctactcagaggctgaggcaggagaatcgcttgaattcaggaggtggaggttgcagtgagctgagatggcacaactgcactctaacctgggtgtcggagtgagactctgtctctaaacaaacaaacaaataaataaataaataaataagctgggcatggtggtgcatgcctgtaatcccagctactcgggaggctgaggtggtaggattgtttgagcccagggagtcaaggctgcagtgagccataatagcaccactgcactccagcttgggtgacagaccctcaaagacaagacagagaccctgcctcaaaggaaaaaaaaaagtttcattgtgtgtccttcattcagactgggtcccatgccctaagccaatcgtgtgctctgattggctaggcctgtcatttgcccagccctgttgactaggggtggggtcaactctccctgaagcccagggattggagcaggggaagtgccctcccagaggaatatcaaggtatggttgccaggagggggaaatggttgctgggcagcaaaacagcagttatctattagacccacatttgcattgtacttttcagtgtgtgtctcatgtgcattatttcttgctagctactgtgacctcttggctgctcctggaatgctcatgttttctcacccctttaggtcttcaatgttacctactcaacaaaccttccctgaacaccccatttaaaatatgtaacctccctctacctctccccaaattctcaattccccttctctgctttatatatacattctttccttagagcttaacactatcatattattttacttctttattttcttaccaggctctcccagttgaaatgtaagttccatgaggtagggacttgtatccattctggtcactgctacatcatctgtggcaaaacagtgtctggcacatagtagatactcaataaaaaatagttgactgaatgaatgaatgtgcacagccatcctgtgaggtaggtgggatggaggtgattctctctgtgttatagataaggacattgaaatttgagcaaaggatcctgttggtacaaagatcaaaaaaaaatttttttttaactttaattgttcagtgctaatgagaaaacagcagagggaacttgattcattacagtgtgttccaatcaagtgaaggttaaatgatgccctgatgcagtagttcaaatagagaaagtggtaggagaattgagtcattgcctggcacgtggtgatataggcatccccaacgcagaaagaaccacctgcttgatcacagtcagaattaaatcatgctgggagtagcaattttgtttcagcaaatagcaacagttacatttaaattagtgtggctaatttgaatcttactggttttatagtttcttttaaatagaatttgtaagcttgttttcattttgtagttgattgtaaaccccaaatgttaagaagtgttgtgcctagttttatgttcatacacatttaaggaacattaaaataaaaattaagtaactttgtgaggatttgtatcctttcaaaaggaacttgcttagtattcaagatagagaaacattgtttcagaagattcaaatcatcctctcactggagataaaaaggaggagttgcagaaagacattcttagaacagtgctcagaactttattaccaggagcttaaagactgtctggtgaatccagccctgtcattttgcagataagtaaactgaagcccagcgagctcaggtctccttgccttgtcctgcttctcacataaggatatctgcccctgaaagctatcccatcatttccatggaaatgatctggacagagtggcttttcagctagtggctgctgtaattggtaaggccaatgctgtgttgtgggggaggtggagggttaggcatcaaattgggggttactgattcttccaatctgtgaacataataaatcagctttccgtttatttaggtcttcacattctcagctgtgatttgggtgtgttgctctgatttttgctgggaacaagagacagatggggaagagctcccagccctccttggagggcccaggctgggcagctctcaagcctgactagctctgctcccagagctgacctcaaggtagccatctaaggtagagatttctgatggtccaggttggtttaccctgggtatctgggggagataaatatgcctgatcactagggaaaagagtgtacctggcctggcgcggtggtgtgtgcttgtaatcccagcactttgggaggccgaggagggtgtatcacctgaagtcaggagttcgagaccagcctgaccaatatggtgaaaccccatctctacttaaaaaaaaaaaaagaaagaaattagctggtgtggtggcacatgcctgtaatcccagctatttgggaggctgagacaggagaattgcttgaggcagaggttgcagtgagctgagatcatgccattgcactccagcatgggcaacaagagtgaaactctatcaaaaaaaaaaaaaaaaaaaagagtgaaccagacaggccagatattctctcacctgagaccctagagctgggcagaggatgggaagcacaggaacttttctgccagcctcttattagagatcccgcacgagggaaactgctgagtgtctcctgccctgcctcactggtctctggtgggagagagaggaattgaccctagggcaaactgttccagtgaagcagaagctggtgtggaggaattcatcctggtgggtgatggctgagtgctgctggctggggcatcggagtagggacagccaactcaatttcaccaccatgggcttcatgagcttctcaggaggcccaagaatttgggaaatgcttgtgtggaccatggcaaaggactggcctccccaagcctcccatggattgatggagaaacaggcagtgagatggaatttggctaatgccatttttcatttcatgaatattgaactggaacacttattgtgtcctaggccctgtgttacactgagtgggggaaagaacagggttgaggcttcataaaggcagtgtgagagaaaaaatggacaaaggactaaaataaagcaaagtatactctcttagttacaaatggtatgctatgggcgtttggggaagaggagtctattaactatattgctactgggactggggacaaaactgaggtttctgatttcccaagcccaaaacccaaaaaactatagtgatttatttcctacctccttctagcattctacaaacactctaatgactaccatgccctgggctcttaggaagagctcataggagcctatcaccattaggctgtaaggttagagaagaactcaggatacaaggaaggcaatggccagatatctaggtgggaggtccatagtgcttttagtttccagaatcttgcagatcctacgtgtctatgtctccccacagggcctcacatggtcagtcacccatagcagggtggaaaagaaattcatgagcattgaggtggcctgctgcatgccaggcatggggctggcactctcccttctttatgtcacctcatgtgtcaatccagttcttttttttttttttgagatggagtttcactcttgttgcccaggctggagtgcaatggtgtgatctcagctcaccacaacctccacctcctgggttcaagtgattttcctgcttcagcctcccgagtagctgggattacaggcatgcgccaccatgcttggctaattttttgtatttagtaaaggttgtcttatactgagactaaagtccccagtatcatttcacagggtggtggccatgagtgagaagatgggtcagtctgttaccttggtccatctcaggacctcccttattgagaagataagttcatcagttattgtttcaacttacttccttaccgtcttcccacacactgtgggcatcctcacgcatcataactcccccttttctttcctcaggctcagatgagggtctttcttttctttttttttttttcttttcttttttttttgagaccgagtctcgctctgtcacccaggctggggtgcagtggtacgatctcagctcactgcaacctctgcctcctgggctcaagcgatctgccacctcaacctcccaagtagctgagacaacaggtgtaaaccaccatatctggctaatttttgtatttttagtagagatggggtttcaccatgttggccaggctggttttgaactcctgggctcaagtgatccgcttgccttggccgtccaaaatgctgggattacaggcatgagccacctcacccagccagatgagggtctttcttcttgttcaatggcccatcccttagcctgtgtccttgaacccatatggtcctatctcctcaagaactttgtgctatccctcaactttccttttttttttctagacagtgtctggctctgtcacccaggctggagtgcagtggcccaatcgtggctcattgcagcctagacttcccaggctctagcaatcttcccacctcagtcttccaagtagctgggaccacaggtgcactccaccacgcccggctaatttttagtatttttggtagagataggtttttaccatgtcacccaggctggtttcgaactcctgagttcaagcgatccacctgccttggccgtccaaagttctgggattacaggcgtgagccactccacctggctcccttaactttctttagcttacattttcaactttttcctcttaactgaattcttcttttcaaacagctcacattttccagttttaaaagaaatcttcctttgatctcagtacttgcgtctagctattgcccctttagctacttctttttcccctctatattcagtctccatttattcactcctaatgtctctttaaacttacagcttttgccactctgccaaaattccattggccaaggtcaccagtgaattttcaactgtcatatccaagaacactgtttaggccttattttccagactttttgaatatatctgatattgccaattcctcttactttgaaaccttactcctttgacctcctcaacgtcatatactccaggccctcctcgttcctggatgaccattttctttgtctccttcaggggttcttgttctttgctgtccctttctaagtgttgttctccagggttctgccctcttctcatgtccacctgggcattcttcatgggtggtctcctggtgttaatatcatccatatgcagatgactctcaactctgttttgcctgaggtcagggctatgcagtcaaactgcctgctggtctatggaatctggacattctaagagcactccaaattcaatgtgttcaaactcaatccatgattctgttcctaaatattttccttttctgttctatcttaattggtcatagtgccaccattccccagatcatctaaactataaactcatgattaaagcaggattgctcaacctcagcactcttgatattttgggctggttaattctttctttctttcatatttggctggttaattctttctttctttcttttttttttttctggacagagtgttgctctgtcacccaggctggaatgcaatggtgcaatcatggctcactgcagccctgacctcctgggctcaagcaatcctcctgcctcagccccccaagtagctgagaatacagattcacaccaccatggccagctaatttttgtatttttggtaaagacgggttttcgccaccttgcccaggctggtctcgaacccctgacctcaagcgatccacctgcctcagcttcccaaagtgttgggattacaggcatgagccatcatgcctggcctggataattctttgttgtggggatgctgtcctatccattgtagaacgtttagcagcattcccaacctgcatccactggatgccagtaggaacccaccagctgtgataacccaaaatgactccagacatcaacaaatatcccttgtgagggggagctgttaaaatatcctagagttgagaaccactggggttaaaggcacaggtctgggagtcacatgtactggtgccattttggactagttactacctctctgagcctcagtttgttttctctgtaagacagagaaacacctcataggaggaacttaatataggtaaagtgcatgggatctctcaacaaaaacacttatcttttctccagactcctaggtctttcagttttatcccctaagtatttctggtctatccacacttttccatttcgacctggattattgcaacagctttgcaactggtgtcaaagcttccagccagccttgctccccttagatccacactccacctggcacatgaggccttcatggtctggctgctttgcacctctctagccccgtctcttgcccctcccggccttggatttctagtccagccacgttgagatgctagacattcctttgtataccatgcagtttcctgtccttgtgcattagcttgtgctggtccttccttctggagtaacttcccacactctttatctggctgactctcattctttaacgttcacttaagtttcacctcctccaaaaagttaagcctggagcctcctttcccacggggttcagtgcccctcatctgttccaacagtacacttgtcagatctctctccttgcgtctaactcatgacatcatatttttgtttctgtgtctgtctgctgggctgtgtgcgacagggactatggctttttcatctctgtatacatctagtacattccctgatatgcagatggtgctcagcaaatatttattgggtgaatgaatggatacagcactaccattaccctctgtgttaggtttagagccacagtttagaagcggtgataaaatggtccataaatcagctgtctctgtggctcagaagcagtgcttcctcagccaggggcttttggaaggcacagtgctggagggtaacactcatatgaatatgtgtggttgacgaatgatgcagccagagacaccatccgatatctgctcacaacagcagcagtggctcttctgagaaccagggggcactttcttcaccttttccatgggtggctttcaggtatccaccatcgcctggagagaaggtagaggacaaaatccagcccataattcagggcccttcctgtcagtgaacttcttcttctaactccttcactcacttctgaattgacatatttgcattttaaatttaaatttaaatttaaatttttgcagttgatgcagccattcatcctacaaatacagtcctcccttagtattggcagggtattggtttcagcatccccatggataccaaaatctgaggatgctcaagtccctcacagtcagcctgggtatctgcgggttctgaagcctgtggatataaagggccaaatgcatatatgtatgtatatattttgagacagtcttgttttgtcacccaggccggagtgcaatggtgaaaatgcacctcactgcaacctcgacctcccaggctcaagggagtctcccgcctcagcttcccaagtagctgggactacaggcgtgtaccaccatgcccggctgatttttgtatttttagtaaggacggggttttgccacgttggccaggctggtctccaactcctgggctcaagcgatctgcccgcctcagcctctcaaagtgctgggattacaggtgtgagccaccgccaccgtggccagcctcaaatccataaattaagctctactatgtgctgggtgctggggtggaagactggcacatctgttgttcacaagacagtgcataacctaggagaggtttatttgctactgttcttcggaaccgggatcccatagaggagcctgccagaacgcgaggcctgctccttcccgggcattagcgcgtttagactctcctcttactaagcccagggaaaggagtcctggcaggtggcaagcagaagttagagctatttagtcactcccgccctccatcctcctccaatgacaataaggttttgtttgtcaggcataaggttaccggattggcctgtgaagtccagaagctctttccgcgctcggctctttgagcctcagtttccccatctgtcaggcgtgtgtatgtgggaggggggtacggagtagatttacctagatcactcggggttgtcccttccagttttgagggtgatgtcggggtgtctgtgaggaggagggaggaccctgccacgcgaaggtagttttggtcgcagcagccagccaagtgtgcccgcggagaccggcagggaattccgggaggccccgctgtggagcggtccccagagcccgagggcgagctagaagagttcctgcggcgaggcgggaacgctcggtagcctctgagagcagttcgctggcgagaaaccgggttcctgcagggcagggatcagccgggtcgcgccttgtagggtggggtggggtggggcggggccggggggggcggcggtggagtcgtgaaattcccaagaaattcctttccattgccccactccgccccctttcctagggtgccgacctgcccagacccaggttccctgggaaagagaaaatgaatgttcttcgggtttcctcgcgtcctttctccagccccctcccaccccggggtttggagcgcgcgtgggagcgcaataacggtggcggggaacgggtccaatcccggcggctcctggggttcccaagcgcgctgccactcagtccccgagctcggggaggcgtctcccggcttcggtcccgttcagcttaagctggcgtcacatgagccgcgggggaacgggcaccgcgggagtgggcgggggtgtgcgcgccgggagggggccgcccagtccacctatatgcgccgcagcccggctgacggatgccaggaattcccaatgagaggcgatggggggaagtttgggcaactcggcctggccaatggagagcctcgggagggctctgccccttccccccgcccccgcccgcctcggctcccgcagcgatagtgtgtccgcctagttcagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaaggttagcagccgcccccgcccgctgcagcccccagcccccagcccccagccccgacccgctctgcctgccgggctctcggctccgggctctgaaccggttccgggcgcgcacgggagggggcgggggcggtgcggccgttgcgaggtggggtgttgggttacaggcgcctggcggaagcgggagcgcccctgccccggttagcccgggaacgccgggccggagcgcggggaggtggcgccgctggcgggcaggtctccttgggggtccgtggtccaggccaccctgcggctgttgcaaccatccccgcgtgggctgtgctcgggggcggtggtcttcaggctggggctgagaccccggctcggggctgcttgctccggatcgattttcccttttcttccgcccctggccacctctccatatggcgtgcggtggcagcgccgcttcctgggccgccctgggttcaacctgagcggcgggcctcccgggaccctgctgccccttaggcggaggggagagcgccggagagatcggcggccgcctccggatctgcctggagaaggaccagctggagtgcggctggggacgagaaaactggggggcgtacgcgggctcccccgcgggccctgtgggggcggggtcaggacagcagaccgttttattgcttaactcagtgggttggaagctgtaaccccgacatgggcttgcgctacgtcctgcccctccgacccccgggaaaggtgggcagctcggttcgagttgaggggctgcagaacgagggtcagtcttaggggatatttggggccagtcactggggatccctacttagccacggagctgcatcccaggcaggcgcggtgtgccgggtgcgcgccccgccacgggagctgggctcggagctggcgatgggacccgggcacagtggccagtggcaggaagaggtcagaaaccactcgtggtggtggggggagggcgcctcaaccctaccgctgcttcctgcctgcgcggtgagcctgtgcccccaggcggccacgtaccctgaatacccctttccctccccctcctcccggctgcccacttccatccggtccctccccgtttcataccctccccacccccaggctgatctgggaatggggttttgggtgggggggggacaggatggcgcgtccctttggatagtgcggttagggctgggcttgagggagaacgctcatgtccaaaaatggtaacattcattcccttttttaaacttaaaaggggggtagtttatagagccgactgaagttttttttttcagccaaaggcatcctgtattagctcactcaggaatcctaggccctgaaacggagcccttttactcacttcatcagacaggcagaggtaatctaaaacacacacaatgggcttcctcaaagcaggatgacctgggccgcggtgcccaaggcctatgcagggctgggccctatacagcgacatcggtcatctacatcggacatgggaaggtcccctgacttcgaactgacttctttgtaatgtgccagttgcttaaactccccctcttcctgtcatcttcctagtaagagctgaagactgggggctgcagacagtcccccactcacttggcttatttcctgggaccatgggtgctgtgggtggaactgaaaagtgagtgagtaatttggagatccctatggggcaccaggcagaaggctctttaataatttcagggtgaagccttcttgagaatggattttaaattagaagtgagattagggtggtggattggggtcttccctgggggttagaatcgaaggagaaatccctgcttagggagcacctgctttgtgcctgggaggggcaggagtaacagagctgcctaggaactaggcccctgaaaggactgtgagaccaagttcctaggggacagacactgagcaccggcctgaacatcgtatttaatatttctgaatgaatgaatatattaaacgcagtggggagaagaatatagattcccagggctctgacctgggtggcagtgggtgtgccccaggcctttgggcagccaggtaggaagaggtggtctgggaaactgggttatcctggaggcaaactcaacagtgccaagaactggcatttgctgatatgtgccaggcacgaacaaggactaggaaaccagggccagagaggggaagtaaccagctccaagtccagactgtgtttggtggggctgggatgcagccatgtttgggactggcagcttcccctcacttgtccctccttggcaagggaggcaggaaagctgggcctcgcagccagagccagagcatctgggaaccaggagagccgacacgtgctttgggcggggttgatggaggggccatggcagaaggagctctgggcctgactctgaagattcagatccacattttttgtttgtttgtttcctgttaattctctagattatctttcgtgggcctcagtctgcagaatttctggcctgcctagttctcagtagggtgatattaaggaggtggtattacaggtgagggataagacgtaaggtaaacgtgttgcttttgacactctttctactgactgggaggcggggtttgtgtgggaccagagtccacaagtggacagaggctgatggttccagagggaggcaggggagtgagtgtgaggaggggaagaggaggacacagtgtagagggatacaaaggtcacccggtagaaggcagaagaccctctttttagctttggtgcagccatagctatttctgagactttgggcaagtctttccatttcatcgagcttttattagatcattcagcaaatactttgtgagcactcattctgggtcagacacagttccaggtattagggatggggcactgagcaagacagaccaagttcccgttcttgtggcatttccattaggtttcctcctctgtaaatgggacacatttctgcccgtggagccctcaggactcttctggggaatcaggttaaatgatgcattgagaagtgcttccttggtgaaagtatggcctgatgtggaggcagggagaagtctgtgcaggcaggaggcatgactcaagaagctgcactggcttggccgaggcttgtccctctttcaaagaatgcttcggtacggagttcatgggctggtcgccatgcctccagacacaaaatgcagttatcttccagacagagcacgtggattagaggcatttcctctacttttccaggtttcataaccttcctgatctttgaggctgggctctgaagtcacttttcctaggagttgctgttattttcagggtgactgcagcccccagttttctcccttatgtaatttcgctcacattcttaggtgtatgtgtgtacccagtcaagctggaggtaggtcaagctggagagagcatcagcttggtgtaggatcctggctctattattttcaggcttgtgaccttgggcaagttcctctctgagtctccaattccctacttataaaaaagagctaatacctaccttgctggcttgatgcgagcagatatgtaaaatggcagcttctgctgttaaattttattttctctcttccttctgaagtcctagagattatggtttaatgtgtgtttccacaggtgccagcctgtggccttttacatgtaggaacttaatcaatacttgttgagcgaatggatgttgaaacagagaggcagcgttggcaagtgcatagaggtggttgtgaataaggcccacatcccgattctgcagacaggtgaggctaggtcacaggaagaggggacacattgtttgcacttccttctggacagcaaggccattgcaggagctatagccaaggccaccagtcaaggtggaggactacagagagaggaaaatctgcaggctgtgtcggacttggacaccccttttcatcttctcgaggaaggcatggggctgggcacctggctgggggccataaaccatcagtctggctcaaagacttgtcacacaagacctgggggcctggagccagggtggggcagctggagcctgagatgtggcctagtcacagatgtgctatgtcgggtctctaggaaagagcccagcccttaacagggtgagaatgtagacagttccttctcatgaaggcaatcagtagatgttcattaaacccctgttaggtatcagatgctctgcttgctgtgtagagtgtggaaatgaaggtttaggtagagagggaaccagaaagatgcagagttgcaacaggctctgccaataatggccattggcaggagctggtggaattggaggtgcatctcaaaggaaggcggttctgctgggagccttacctttccctggcatttcagccacgtgtgtgtgtgtgtgtgtgtgtgatgttgtaggacagaggtggggagaggggagatgcctgaaagggcagagcagagcaacagtgactatccatgctggggagcaccccctcccattctcccttatcattcttctattatagtttaaaatttttaaatttatgttttatagagatgggggttttgctatgttgcccaggctcttggcctcaagtgatcctcctgccccagcctcccaaagtgctgggattacaggcatgagccactatgcctagcttcattgttcttttccatttgttttgcccctcccagagctgacctctcacctttctgcgagagacggccaggccatctggacaggtcacagaccagattctcaagtccacacctctctacagatattgttgggatcatcccagccagttaaccccacctgagctgcctccatgtgtaacccacctgtggttttcctggacttggtatggagccaaagggtaccttccccactggccctgcttttatgccctctttagagtgcatagagagatgttggtaggcccatgtctctgctagaggggcctgtgggttgggctgagttactcgccatggacagtggtggggtcctggaacccaccagctgagatggtttgggcggttctagtctgcacctccccagagaggtcatggcagagaggccaggcacagaggaaacccgctgagcctgcttccttagttctggcagatgggtcagcccccacaggactcaggattcaatttagcccggggttctggctccatctcccacagtgccggtgccagtggcctcctaagtactgtttggccaaacctggctctgactgagacaaggagccttaggagtagtagggacaggagacacagcaaactagggctcagagccaccctggaaccccttcttcctccctcttcatgcatgaccaaggtttctgtatttgtccattctcatgcttctaataaagacatacccaagactgggtaatttataaagcaaagaagtttaattgactcacagttcagcatggaggcctcaggaaacttaaaatcatggcggaaggggaagcaaacatgtccttcttcacatggctgcaggatggagaagtgcagagcgaaggtggggaaaagccccatataaaaccattgtatcttgtgagaactcactctcacgagaacagcatgtgggtaaccacccccatgattcaattacctcccaccgggtccctcccacgacatgtggggattatgggaactacaattcaagatgacgtttgggtggggacacagccaaaccctatcagtttcccacctatccccaggctgggcatcaagtccaggctcccaggaatccttctcttctcagcagatggggggaaacgcatggagagggttgcccaggctcccccttctctgcctctcctgctttccctcctttcatgtcgtaccagggggttatctggcgggcaagtctggttatctgggcatggtgagtctggtctagtgatgggcaggccccaaagctgtgtgtggcaacgttcatgaccccaactggccccttccgcatgcaccattctgccataaagttaacaagattccttttctcataataattatagtggctcgccctttttgagcacatggtaattatcagcaattgtcctaaggactctacatgcatgagcacatctaaccctgtgagatgggtcctcctgttatcccattttgcagatgagagagctggctcggagcagctgcggaactcctccaggcccacgcagccagcaaatggtggagctgggatctgaagccaggcagtcgggctccagcatttgcactccttctcaactttgctctgccgcttatacaacaaatgcttgcgtgggtagaacatttaacccaagacaaacatatacaaacaaaaccccggtgatggaaatgttctggaattggatagtagtggtggtttcacaacctcacaaatatacgtgaaaccactagattgtacattttaaaatggtgactttatggcatggaattttatctcaatttttaaaaacctaagaaattattaactaatataaagaagaaaatgacaattgcctgtcatcccacctcccagaggtaaacaagcattcacaggatttctgatggcttctgccatccttgtccctcttcccctgtttgtgtgtccccttctctgtcatgcccactttttagagctggggtccaggtttatgatgagtgagaggagtttagaagaggaagataagggcgggagcttttgtagaaagcgggatgaaggatgtggctctttccttggaaactgaccaggaatagatcatagatatgcacaggcaaacagaagactgggtgggttggggagagggtggccttcattttccaagtctcagtccttggggaaaatttctccctaacctctgtctataaaccctcttggcctgggattgcttctctccgtgtgctctccccagggttggcagggtgggagtccaagtgaggcagctttccttagggttgtaggcaggggaaggggagggcagggccagggtgccccccaaaggaggcagctgtaccactcttggaggttgcctagcaatcgtggggaaaggtgacctagcccactacagaagcgggaggagaataaaaggcagccaaagatggaaatcgggcgtacattgcagaggaggctgttcccctggaaactgcctccttggtccttggctacagcaggctacttctggggtggggatctgttctccattaagagggagtggggtcttccctaggcctgccacccacaggtcagggctgggggacctagggaaacccttcttgcacatggagtgtatgtcagatgcgtttgtcagtggcttcatttaacgttgacaacagccttgtaagatatgtgggatgatgacacttcatagatgaagatcctgagtttagagatagagaacaacatgttcacagccgcacagcgagagaggcctggaaatgaaggtgctggcacccttgactcttaaagggagccattcattttgcttcaaagcatttcacaagcccaaggtactcggaggtaaatgtaaacactgtccacctcctgggaagggaacagaagatgagagagggaaggctggaaaggtgtgttacctgttttatatcaaccatccaaccaaccaaccaaccagtacttattaactatgtcttggttttccaagtaagtacaaagacgaatagttcacactgattaaatgctgaatggtttggagtacctccacatgtcaaacaactctttggggaagggactgttagttttcttggtacagacagggaaatggaagcccagagaggttaagaaacttgaccaagattaggcagattgacctcagaactcggcttttaaccagaagtacagacacactctttgctattaaggagtttatgtttgaattgggaggcaaggcttatatggaattgaaataagagaacaactcattgtggcgcatttttaacatttgtgcttccatgtgtggctttctcttcagtaatcatggtgagcaaacttgtgaggtcttatccccattttacatgcagggaaagtaaggctcagaaaggttaagcgactttaccaggctttccgtagcctggaagtagagttggttttcaatccaggtctttgacgggagggtctgtgaggtttaaggggatggacataggcctcagtgaaggtacttttcttggttttaaaggtagtgaaggatgcaagttgtatttctctgtgtttttcagttgaagcagtaactgtcaggaatagactcaaatcccctgaacctggaggcctccccagtcccacgttcctggtggcctcttctggtgctgaccccagcttttgggagctagcttcccctgctttaagattcagcagcaccctccccttctctcttgttttggttccttcagtttcacctgttctgtctgtccttccctttgtttagagagtctcttcctttgtggtcaccacgggaaccaaacaggctttgaaccaggcagccgaggctcaggtttattttgattttaaaagcctgtgcacgtgaaacccgtaacgtttgaggttcttgtttaagccttgagacgatttagaaagttgatgagggagtgggggacttaggttggcttttggtgttacagggctggggagtttttgtgccaggtcagagatcagcaccaagtggggggcagtgccatttcctgacccccagctttgaaccttccaggcctaaatcagaggccccaaatgttcagctccaggccaaagagcagtcggctgggggaagggagcctcctctctgttaccttgtttttcctgtttcttggtggtgggtgatcgtggggctgttgaaagcatggtcacaaggcctgtgatttgaggccaggccagggcttgtaggggagcatttttatgggcctgaagatttattttttaaaagccatctgcaaagctgattataattgatgggagtgagacagcatctgagctctattttcaaatcatctgtaggtgaaatgacgggaggggaggcaacttcaaggtgggtgggctccttcaggccggtcccctaatggaacttggctttccaggctggaagaggcaccaagccttgcatgtgggtgggaggggttcttaaaatcagactctatcttttctccttatgtctgatgtggagatgtccaacgcataacagcctgtagtttggggatagagaagtggagcttttaattcttctgagtcaagtctcgacacccccaatatggggtcttggtccaggaaaaagagggcagcctccaccgaggtcctctgtcttaacacttgtgtctgtcgggtctgtgagcaggggtgcctgtctgtcagcgtttggctgcatgtgtctctctggctccaagaagcccctctgttgtttttggccacctccttgaccttggcagaggagtggctcccttttaaactccgcagacatcctccagataatagataatggcgctttccagtcgagttcccgatattttgtaagggcctttctttccaggaacccaaagtgcttttccagacttggccctgggagctgggagatgcaggaggtggcttatgaattgtgttttcctggaggcagggaaatggggccagacccctggtttcctgtccttcatctcggatactggtggctggggctgcatggaggtgtttttgcatgcatgaagtcctgaggcctcttattagaaatctgcatattttcccaactttagctccaaatgaagttttgctttgtagctttctttttctcttcttctttttcctctttctctcttttcttatatttagaggttcattgtgtatagtttctttaaggaatgccacattggggtctcagttatatagtgggcccgtgtgccaccccctcactgagtctgcttggcatgggcaaggaggccacagtagcacccaaaggtgcctggctggggggcctgtacctgatgccttttccccagaagccactggttcggaagcaagctcagcataggcccacattgctggccctgggactgttctgggaatatggagctgagcatccctgcgtcccgctgccctgcccccagcagcagccagccctggtactgtgctttgggccaggcacatgtctaagtgctttgcagctattaatgtaatcctcacaatacccatatggatggcttagtaggaggtaaaggccatttgagggtatttggaaagacctgaaaggttcaggtggttacagcaagtatttctagattttctgaccttgaagccagttcacaaagaccatgttggcttcagatttttattttcaggaaagagtaccttgtagagttgcgaccgcagtgttctccctgatcccgtaaccttccctcaccggagttaaccgctgttccaagtttggtgtttttgttcctatacatttcttgcctatatagctgtctgtatctttgtgcctgttttaaaactttgtgtagatggggtcatacccaatgcatcactctgttcattgctccttttgctcccacatctcctttgccctggagctgtaaaggtagacctgtgggagctctgccatccctgttttgtggctgagactgctgagttccaaagcacttgcccaggtcacacagcaacttgtaggtggcaggtgggactgaacccggcttcctgcctctgcggtggcgttcgtatgttacacctgccaccctgcaccccgccagtgttcaaagacttgctgatgtttgatgagggagggcaggagacgtcagtctcagtatcttactctctttccacccacacgtgtgtgtggcatctggtgtccgtacctatgggtccctggtcccttgcctgctgccctcttttcctgggcttgagattcaggttcctagggacctatgccacgttgccatttttttcacctcccagggtagtagttgtgcttttattacttcttgataaagcaaatgtgtcatgacgaaaaggtgcgtgaatttgggaatgcttctaaatgagtttatattttatggctcagcagcctcttgtgccatttggaagctggctgtgctctgcaagacaagagactgctctggatatgaggcttgggctgcatgtagagttttggaagaggccagatgtggggagccacgatgagccccactccgccaggaccattcctaggcttcaaggacaacaagtggggtcccagttgagtggcctttgtccctgtctgatttccctcctcttgccttcttatcttctggctctcagccactcggccattgccttgcccagttagtacctgggctaggagagtcagaaaggacagatatgtggcagcctgcctgccttcattacactttcttggggcactgttgtgaaactcctctctaaagacatttagaggattctcaggggatgtcactgatctgtaactgatctgaggctccttggatgatcaaaggtggatttgtggagtctcctggggtccccctagtaatggactttcaggagctccctgatgagctcatcccagcaccccaaagagcaggtaagcacgaatcaagcttgcacatactaggtattcactgagtatccagtgttgatgaacagtggtggtgagggcctttggacaggagtgtggcagctgtagtcctgcaggagacaactgacagatgctgagggcctgggtggtggtagtctgagtcaccaaggaccaccccagagatgaggttgattgctgggaccagggcagaggcccagttggctcctcaggactaagaggtgtgtcctggaatcagaaggaggacaggggccagggaagctggccttgtcattgggatggggtcatagcctaggatgacctcagcccctgccatgctgctcagcgcccctctctgagctggtgcgtccaatggtaggctggttggaactggcacagacctcccagctccctaccagccagcctagctgcgttttttctttggctaacagcccatcagattccaaggtgctggccatactgacatgtccctcttcatcctgccccttcctctctggagggtggggttattgcatttggctgagccctgcttcagaaaatcacagggaatttctggtccttttgtgtgggtttgtggaccttaaaggaagtaaaacctgggtcttggttttccttctccttccagtccctctgctgagggttctctctggagtgttggacgtcagcagcccactgtctttagccacagtatcccgaggggtgtggatctagataactgtggggcctcagcaaagctttcacctgcctcctgctccctttctgttgggactttgggagtggcatttgggagtggggataggtgtgaaaagactgtcttctttgatttattaggccagagagttgtttggcagaaacctatcttgtcccccaggaacaggaagaatggttgtgtgttaggtaccggggcctcaggagacccgaggtcttgtcctagtgctgcctgtggccactttgtgatgctggataagtcacacctgaaaccacctataaaccgagaaattggatggtaggatggtggtggggctctgttctaaaggctgtacttggattatcacatgcagatgatctctggggtctgcggtgatgccaacattctgtgtttctgccctcttggacactcagcagagttaagcacttctttttttaaaaacaaaattagttacttttttattttttgagacagggtctcgctctgtcacccaggctggagtgcagtggcatgatctcagcttactgcagcttctacctcctgggctcaattgagtctcccacctcagtttcccaagtaggtgggcccacaggagtgtgtcgtcatgcccagataattttattttttttgtagggacagggtcttgctgtgttacccaggctggtctcaaactcctgggcttaaacgatctcctgcctcggcctcccaaagtgctgggattacaggcatgaaccaccatactcatccgagtcaggcacttctaaaggtgaccttgcagttgactcctgggctttgtagcctggccctgaagttaactattcggcgaacacagcttctttaggagccctctgtgtcttcagctttgaggagtttgttctcaccctctagggaggatgcaagtggggccaggtgaatgtgcttcctttatagacagacccagaagccagtgctcttgtgtgtcctgggctctgcattcactctggctctggaaatacctgcttagggtgtggtcctgagtgggaggccaggtgcctggggaggggagaatcagggaggcactctcccttgtttggtgttggtgaagggtaacttagctctgccttctagtctgggtgctccaggtgtgtctgggggtggggatgctggaggtggctcaggagaattgcaaggtggactgatcataattggtcctttgtgtagacttggctgacccacaggcctggtgtgaggaggctgcttgcctgtgggctcagtgggtctgaaacactggctggagccagggagcaaggctttcagcctggaatctgcccaagggactggtgtcaataggtggccttgtctttcacttgtttatttgcagagcccagctctggcccttctctcctttgcagcagtttgaagaaatcaatagaatgcccaagccagaagggacctgcactgtcacctacccctcttctccctcagataaagggatgaggtccatagtggtgatctgatttgtccaaggacagtctgccatgagttcattccttgtggggctagatttggtaaggattctttattctgggtacacgtaagccatcttctgaagttatccttgcaggtgggctccagaacacctgcagatagatgcacatggggcgggcctctgtattctgaaggcagatgaagctgctggggttctggctagtgtgtgggtggtcaatttcagatgaatttcacacatgcaggcagctgcaccctgccaagttggaggtagtgatccacatgcgggcccttacactctgatgttcctgggactggctcttgcgtttgcagttgaggagggaatggagagatgagcctgcaggagagaggcagcctggtggcggcggtgatcttggtgttaacagccagcacttattaccgcatgtccagcactgtgctaagtccattacgtgcattataccaaggaatcatcatagccgccctatgaggaaaaggtactgtgacatttttagtcccactttacagaaggaactgaggcttagagagattaaatattttctcccaactcacagcttttagtggggcagttgggctttgatttcagggctgcctggccagagtccacactgctaacccctgtcctagttgcttcctctctgctagctcattccttctggtagcaagcaccagctgtcagccctgactggagaagggaggcccctcatgagagatggagctgagtctccaccctcccgggccccatacacttctctcctgacccgtacattcctgtgcaccagggaagtggcccctctctggtcgtggagactgaagtccccgtgctgtgttgagcagtggaggtgggggtggctcaggtagaatggagggtacttgactcctgttttttgagggaaagttgcctttaagttggagggatgctgttggcttcctgcagctgcttgctgccttttgatgacgcccctgtgcatgggggccttcaagtgtaggtggaataggcagggttggaaaggctcttttctccccacagtccaggagaggcagtgctggagccccttatttgctgttcatcctttgatgggtcagcataacctttatgttacaaatgccaatagatatttaattcctggggtggcataaggtagcaagcaatttagaatttaataaaattacaaattcttggggagatgattctgatttctctctttatccatgatgcatgctagttgcatgaataaatgaatgaatttttttaaaacttatggaaaattcacacacaggagtagagagaatagtatagtgatttcccatatacccattactcagcttcagcaattagcaacagaattgcctgtaatatttaatcatctgggctattttattggcactgagattagtgtgctagtgtgaactgctaggaacttctcaagtgagaaaggacaagcggagaagaaatgatatcatagtatgaataaaaactcatctttgtggtgctgccatgctaggcaagttgcaggtgctcaccggagggtttgaactaactgctctggataactggccaggtggtgttgggttccagccccaggtgggaggaaagtttctgaagggtgagttcagctggatacgtgagattctcaaacacacactggggcagaaggcactgcagccagccctagttcatctactcaactcatgtttactgtggatcatctttttttaaagttgacatttcaaacataagaaaaagcattgagaatcataaaatgaatatctacctgcttgccacccagacttaacaaacataaagcagacattctttccagatgagggacagatgcatggtctctgtctctaaggaggcctgtgagtgagagacccagggacgggcaatttccttgtcatatacaaagatatcacatctggtatagagaatggagttccaaggaaggctccagcccatcctggaggagacaggtaggacttcctggaggaggtgatcatgtgagctaaaaatcaaatctggaatatgtgagtcaggccaagcgggtgcgggggcagggtcaaggggaggtgggcctgcaaagggtgtaaccaaaggtaagaaaaagggagtgcaaagttctggggagggaggggcaggaggtgagtgaggagtgggctgggtgcagctggagtgaaagatatttgggagtgggcaacagtgaggactggtgaatcagtgagggacaagctctgggcatctttagggcagtagcaggcaccaggcttgtcctgagacctgctcagtgcgtggctgcctgaattagactccacacattgagaggattatagaccaatataatcccatgcaaagaaacccacacagcgggtgcggaagggcagaaactgtatcaggactatttgattgacctgggctgcttagagcaggctccaggctgtcatttgaaagaggggatgtgttgggttgacccaatggggagaagtaggacttggtgagagttgtgtggacatggaatctggctcagaatagaatttctaacagccttccaaagaagggatgcatggttgggcgagagtttcatggtcttaaatgtgttgaagtagtctcaggttggaagcaggcagggctggggtgtggagggaggagggctctgcattgcctggccttcaaggcctctccttactctgagttctgagatttaggctggggagggtgggtaagtgacctgtgggcacaggcaaatggtgctcctgggaaggcggctgtggaggaggtgctggcccgttgccatgggaaccatcactgccgtgggtttccagttccaaggatgccctggaagggaatgagctcactccacctgcgagctggtgagtcagccctgcctctcctgcttgctcgccaaggctaggcgggaatttgagcagtggaccctgcctctaccccctcctcagaccacccaggcgcccgtgccctggatgtgggctcttgtcgtaaaagatgcagggcaataaaggcagctgccagccattctggcatcagtggggatcctgactcggggaagctgctagcctagttggctaaaccttggctgtgttgcagagggtgagccattctctctgccggccactcagctgatgtgggctgcacaccagccacagctgtactgggccagggcttgtggtccagggggtagatgggtgccgagggcaagctttcagggtgtcttgtgaaggagaagtacaggctgggtgggtgtgaatgcctgtcggtcgggcgtgggggtagtttctggaggtggatgaggaatgcttcccgtggggagtggcttctgatctggtgctggagggatgaggagcaactagtttgcccaccaagtcctaggcatctgaggccagccagggtcatggctcctgcctcctccttctgtgcccctccccagatgcccagttgtgagggagtgatcagaacatgtcgggggtattgcaagaatctcaaacagctgtgacttgagtgtacaagccatttttatccaagaccctgtgaaatccatggcaccacccactgggggctggtccctcaggatccacatagggcctatagcccacccccgtgcccccgcgccctgtgccccgtgtggcggcctgtgagatgcatcagaacacccaggggaacactgcgtttctagcctctgcttgccttacttgcttcacccacatgggcctctgtttccatttgagaagatagataagttaggggagaaaaatgaccatcttagaccctttctcctaaacataaccatttatattttcagaaacctatttttatttttaatcttcatgcctgcattattctgatagcggtaatcatagtgtacataaaaattagctctgcttttttatttccccacttggcattttatcaaaaacactttttcttatatagttacacagcctttatgttccttgcctggagaaagtgagatccaagtatagagattgtttcataaatacatgtttatttgtactttcctgcctctttccaaaaagcatttgaggtggatatattaaaagtctcgtgtataacagggttttttgttatttcgttttagagacagggtctcactctgttacccaggctggcgtgcagtggtgctgtcatagctcactgcagcctcaaacttttgggctcaagggatcctcccacctaagcctcctctgagtagctgggactacaggtgcatgccaccatgcctggctaatttttacattcttttgtagggtcttgctatgttgatcaggctggtttcgaactcctggtctcaagaagtcatctgacctcggccttccaaagtgccaggattaccaatgtgagccaccacacccccttccttcagaagttttttgttgtttaatttttttttttttttttaatagagataggttcttgtcaagtcaccaggactgctctcaaactcctggccttaagtgatcctccccgcctggcttcccaaaatgctgggttgacaggtaggagccactgtgcctgggccagagttttaaattaaagttagaagatccagagctatgtcatagtggaggtgagacaattgttaagaaaacaatgttaaaagaggttagtttttaagaaattttaatgtaattcccccagctttattgaggtaaaattgaaaattttaaattatatatatttcagttatgcaatgtgatgatttgatagacatgtacactgtgacatgattaccacaatcaagttaattaacacatccatcacctcacatagttgtcattgtttgtatgtatgtatatgtgatgaggatactaagatctgctgtcttagcaaatttcaaataaacaatatacaaccgacccttgaacatcacaggtttgaactgtgcaggttcacttacaagattttttttcataaaagttataccgactgtgcctgcctctcctgcctccccttcctcctcctccacctcttctgcctctgccaccccgagacagcagtagctgtcctccttcttctcctcctcctcagcctactcaatgtggagacaaccaggatgaaaactttcatgatgatccacttccacttactgaatagcaaatatagtttctcttccttatgattttcttaataacatttttttctgtagcttaccttattttaagaatgcagtatgtaacatacaacatggatgtcgatgtgtttttaatcaaatgtttatgttataggtaaggcttatagtcaacactaggctacaacagttaagtttttggggagtcagttatatgtggattttctactgcatagtgggagtgtgagggtcgttgcctcttacccacatgttctggggactcaactgtaggattattagaaatagtaactatcctgatggaaggtttgtaccctttgaccaacatttccccatttcgttcaacccccctggctctagtaaccaccattctactctctgcttctatgagtttgatttttttagattccatgtacaagttagattatgcagtatttgctatgtcttgcttatttcgcctagcctaatattaaaagaggttagtttttgtaagtcaaccctgaccctggttctgagcttcctggcagccgaagcaaaaagagaacttggaagtatcaagtgtttatttcttagtaaaagaaagtataccagttcacgagaaaggggcactttttgtaagcactaaaagctgagttttaccattttaggagagtggtgcagtaaacagtgctgtcagtattagtttcatggaacacacagaaactttttgtatacttgtttcttaaatcagctcccattgaaagccacaggtatggtgttaaatcacacttgtaggaaggcatttctgtggggagctgaggcaatgaactcgagctccactgtttccagaggtttaacctcagagaggcacaagtcctttgagatactcttgagcacttcttggagactctgtcgtggcagttgtttgacaggagctggagagcaggctgtgtggactcctggctctgagttcagaggttttctgaggtcttcacagaaaagagagctaataggttggtgcaaaagtaatcgcgggttttgccattaaatgtaatgggaattttgcaccaacctgaatatttgttttgggtgctaagcatgtgaagggcaaagctgcttttttattatgaaaatgagagcctggcccactctccctttccagaaggatggctgtcgaggccaaagttgtcttctagaagcagtttgggatctgcccacagaactgggatgaggcccttcaggaaggaaacagtgtggtcagtcggggctgggcctgggcaagtcccccttaccagctgcctcacgccctggctgctggcatgtcctctgctaataattcttccattattggacacttccgtggtttccagttttggcctatcgtagataatgcctctataaatattcctttcatgtggatgttttcctgcatttttggataatatccaggagctgggttttttgatcatactcggaaaggatcatttctgagtccttttccatgtgaatcaattgctttcaaaagactgaccagcttaatgtgccacctgtttttttttttaattgaaaaggaaagtaatatttattgtggaaaatttggaaactacagcaaactacaaagaagaaaataagaattagcagaaattctaccaccctgagagcacagaggtgtgtggcctggtgcacacacctggttcactgctgcagtgaactcgtctcttgtcaggcaggggtttgagcctcggacagtcccctgctagtagtctgtctaggtgcatggggcacctgattttcctctgcctcaaacggtcttctcagccactaatttgtctgcctctgagcatacatttctaaggttttgaaggccctgttaacctattaatctgttaatcatagaaagcggtttagaaaacttttaaatgtctaaatgtttgggaggaaatgttaaattatcactgattggcttcttagtagattcctcaacagctaccacctgccaggcgtgaaacccaagaggtcgggaccccgggctgatgcgcttcggtgtgagaagtggtggaatcgcctgggaaagttttgcccagatctgactcctgaccacgttcctcaagttcctgtctggctctgaggcttgtctggagagccagggtgtttggtaaaatggaagggaagtgcgagcgatcataaatgagaacctaaacctgccgtctctcacttccctctcttcacttcgctgaaccagacattctctgggccaggtagacacgcccctctactcccctgtcattaggaggaagcttccagggcagggagaccccttcccatgctggccagatgccttgctgaactcttgaccagggtactggttgtgggctgagggttgctgaccccctgcaacccacagagttgcttctgttactgggtagctccaccatcacctaagcagttacatgtcagactgaatttcccagaatatggggcaggaagaagatggtccattcgtggaattacttgacctcaaatagagagcgaggcttcagtccttaggaactgtaatgactgatcaaagagttcccggatggctttaaatgccagaatgggcatggcaggtgtgctgggcactgtgcacacagcagtggcacacctgatggccgagtcattgttcagcatataggagctgatgcacagaaggccccctctcctgccactctagcagtttcattgagttgggtgggatctgggcagggaccacagctggaggtcacaggtgtctcttgggggaagaggggatgaatgcctaaatgatggcatcttatccaaacccctcttaccatgcatggaactctcagacagactctgttagagatgtgccttcaagatagatgctcgatgttcttagagctgtgtatcctccggccagcccatctgacacatagttgcaaacagctttcagttttccaatttccaggggctgtggatgattagaactttggaaccatgggattcaccagagagaatcttggtttggggatgtttccttggggcagagaagggggaagccactggaatgtctcagctgctgtttgtgttgtttgggtgaagagctccctgttgggatctcgtgatgcctccagcttgtggccatgtggatgggctgggattgatttgttctgtctggtttgttagacactctacccgctttgtctctccccacccagaaaaccacaatgaactctaaaggctggtccaactaagattcatggtaactgggagagagagagagagggacttgaggagacaagagtgacttgtgctttggtctgtgaaggagaggttcctttgcgatgaggattggaggtgggtcatgcaatgaggggcctcctgcctaagctgtattcagtgatcattcgctgcaggtgaccacaacttccttgtagatattctagctcccctgggtatgtccaccctctgctacccaagtggagaggttcactccaaggctatattccttataggatggcccgtggaccacctaggtttgtgtaaaactgtagcttcctgggccttttccagacctcctgaaccaaatgctctgttagagcccagaaatctgcatttccagcaagcgccctacttaatttttagataaagctagataaccctatgaaggattatctggaggaatattattgcttcagtctgaatggaaagagtttagctaaatgaactcaattcctttacattttttccccctttaatgtttttcactttttatgaaaatggagacagggtctcaccatgttgcccaggtgggtctcaaactcctggacttaagcgatccccctccctctgcttcccagagtgctaggaatacagaagtaacccactgtgcagcctctttttttttgtttttgagacagggtcttcatcgttctgtaacccaggctggagtacagtggcatgatcatagctcacgacagccttggacccctggtctcaagcagtcttcctgcttcagactcttcagtagctgggactatagtgtgtgcgccactgtgcctggctccagctgcttcactcttatttactcttcctccaggaccttcttaatgaagctttgtctccttgtggcttagaccgtaaattcactagccacccccaaatgtgaatcaagtatttcttctggacgccaaacccccatgacttagagcaaaagtgaagaaaggaaaggcaatctgttattgctttcctggttgtaaactgcttttggatttggagcacgtggtctggttggctctctgcaaggctgctttaaagcaacactgcagtgctagcagtggaggccctgctgatcagtgattcatcccagggattctgaggggccatccatatcaggcaggtggcccaccctgcccactgatccctctcaccctgctcagcaggtcctcccctgccaccgagcgcaaacatctgtgtccttcaatgacctgcccaactctgtttggtttcctgcggagagagggctttttaactttctgcttcctgcctcgccctgcttccctggttggcccaccggagtgacctctgatcctctagtctcagttgagccaaattctgactgtggactgttgtctgggttctagctttctttcaaaccgcgtgacagtaggggtttgggttggctctagacacggtgagcgcctagtcattgtcatgagactggatcatttcagcctgggggtctgccagcagttgtgtgttttgctgggatagactcagacagctcccttgagacattcccaggcaatgggaagcctaggaggcctgcaggactcagtttacatgcaatctcctactgactccacacctggggttcattttggaggctctaggtcaagaaaccctctggctgcttccctctttttccctgtgggagcttcatagggtagatgtggaggccacagtgtatatggggaccaggaagctcagaaatagagggaggctgatgatgggggagcagaattgagtgtggcatggaggctgccaggggagctgttacaggtctgcttgcatcagagtggactaggttgacgagaaggattagtaaagaggagctgggacttgaagctaagatttaagaaaaaggatctccaggacacttcatctggaggcccagagaaggcaaaatcttccagtcaaagcaacttagctgaggaacaatttttaaaaagaaaaaaagtctgaccagggcaaggttctaatagagcgagtgatgtgttcatttcttaaggtgttgcacattggcacagccttcaggttagcatcatggctgttgatgcagcaaaagctatgaaaatgctcagaccctttagccctgtaatttcaccccccaggagtgtgtcctaaggaaactgtccagctgaaagaaagacatgcttaaaaatattctctgtatgggccgggtgtggtggctcatgcctgtaatcccagcactttgggaggccaaggtgggcggatcatgaggtcaggagttcgagaccagtctggctaacatggtgaaaccccgtctatactaaaaatacaaaaattagctcggttcggtggcgggtgcctgtaatcccagctactcgggaggctgaggcaggagaacctccttgaaactggaaggcggaggttgcagtgagccaagattgcaccactgcactccagcttgggtgaaaagagtgaaactccatttcagaataaataaataaataaataaataaattctctgtgtgtaacagcaaaactgggggaaaaaagtgcttccatatctaactaaccctggggaaggaatttaacaaactatccatcctgatacatcatggtggtgtagtatttttgcagcctttaaaaatgataattaggaagattatacaggaataaaatattcaacagactgttgaaagtcggagaacactaaagagtaatacattataattgatcgtactgtaaataaggaagatagtgtagtaagtagtgtaaataaggaagataatatgtaaaaatacaaatggctatgttaaggctagaggattcattattttaaaaaattagtatttaaattttatggcaagtcagagaatttctatctgaagcatcattcctcttcaaatatttttctactatcacttgtcccttttcttttttttttttttgagacagagtcttgctgtgtcgcccaggctggagtgcagtggcgcgatcttggctcactgcaactccacctcctgggtttaggtgattcttctgcctcagcctcccgagtagctgggagtacaggcgcatgccaccacgcctagctaatttttttttttttttgtatttttagtagagatggggtttcaccatattggccaggctggtctggaactcctgacctcatgatctgcctgcctcggcctcccaaagtgctgggattacaggcgtgagccaccgtgcctggtcacttgtcccttttcttaaggagtcatggcaactgggtgagattgaatgacccactttgagcatctttagtgtgtgttgtgcactgccaggctctgcggagtacgcacagtgtaagatgtggtcctctgagcttaagggcagaggatatgtgtctttgctggggagataagatgtccctgtgctgggcacgctgattagtgctgaggctgatgcatggctcaggcatggagtgggggacatggaggctgagggtagggagtgggtggagtggtttgggcctttagctggggctggaagaaggaccaggagagctttcaggacagggaaacaaccagcccggcattggggaaacctaggaagaccaggagagttgagtttgcctaagagggattttcagatcatcacagctgtgagtgagctcagagttaaataagatgtctgttattcaccctgttttctagagattggaaactgaagtccaggaaataagctcttccaggaatctccagagtcccctggggacaggggtgggtgcgcaggctgactccctgtgggttggctgcgttccagtggcagatgcccctagggatgggaaatcatccccccgaccctctcaggaaaccctttccatcccttctgggttggtggcgtcactggtggtggaggatcagcattccttctcctttcaaatctgcccgtgccctgcttgggtgtcaggccctcctgggggctgctccatccacactttccatttgggggactttgacattttgtttaagtggagatgtgattgagagtgtgtgagggtgagaaccggaggctctggctctttaaggctcggccttcaagtgaggtttggcagagaagatactgaacgtttaattttagggccaaggtagggggtgggggaaagtccctaccgcatctggtttgtgttaagcctgtgccttcagaaaagggctgtgtttatggttaaaatccagcagggatggggggtgggcgggatgccgctttcccctactaggcattgcggcacagggacagggcacatatctaccttccttctcattctttgaccccatcccaagcccgacagttacaacttggagaaaactgcatgtgacatccattttatctctgcagttaaagccagatgtttgctttcaggcagcctccagcagctggactttgccaggctgaagctgtattctttgtgccccagaactccctgccgttggccgcctgtcacttcgacctgtctgcagcccgcagggtcccgggtgggtcattgctgctgcggagtccaagctggggcctgtcagaagctgcccagggctggcctccagcaggcctccctctggcgatcccaggattgagaagttgagtcaatccctaggatgtctagactaccagcgctggaaggtcccacagaaaccagagccagccccctctgtcagataaagaaactgaggcccggaaagctggagactgaaccagacctccctcagctctcagcttggctcactgctcttttgccagcttcatgtggcttcccttttggctactgtttgttttgctcttccatgctctactcccttaaagggccggccctggggacagggagtagggtgaaagatcttcagacccaatgggaagttcacaaggctgcgcttgttcactgctgtttgccagcattagtatagtacctggcacagggtaagagtttagaaaatcttgaatgaatgaacgaacgaatgaatgagtgaatgaatgatggggttacttggcctgagggtggggacactggtgctgcacttagagccattacttctgggaggggtaccaggcacgagtctccacacccaaagctctccctgttccaagaccacgtccagtcttctccaggccttcctcagtcccagcccatcacccggcttttacaggagcctggagtttcagagctgaaaggggccttggatatcaaatgttgcatcaccttcacgttagagttggggaaacggagtcaagggcacacagctagtcagcgggaacgtcaggaccagagcccaagtctgtggggttgcagagcttccatgcatccctccttgggcatttatgttgggagttgaggttagaaagagaaggccctgtcttgtccattgtgcctccccttttctgtatcttcctctgtgggatgagctgtttcctctttctctccctcctcactctggcttcctctcctgtagtggaggacggtggggtggtttctccataacagtctgagtaaaaaggctgggcccctgggattgggccaagtcattcccttgtgtcttcctagaaagggaaaaagagagtcggctggctcacttccttccggggaaaccagcgcctgagtcaccctggagtcagggcccagggaggagcctgcccgtcaccccgttgcctctggccatgggtggcgcttccctgccactgtttctcaaagggcggggggccagggaaggcctgtgctatccagctgccctgccgttcgtctgccttcgtcgcttcttgggagagtttcttggccttctgcaggcaggctggtgctggtggcaaggagggcaggcaggtgataacattgcccccctctaactggaggtcttaaacaccctcctgaatcacaatttgaaatgtttttgatttacaagtcttcaatatctgttttgttttatgataaaagtttgacatgcttagggccggacgtggtggctcatgcctgtaatcccagcactttgggaggccaaggcagccagatcacaaggtcagtagatccagaccatcctggctaacacagtgaaaccatgtctctactaaaaatacaaaaaattagccaggcgtggtggcgggtgcttgtagtcccagctacttgggaggctgaggcaggagaatggtgtgaaccagggaggcggagcttgcagtgagccgagatcataccactgcattccagactgggcgacagagtgagactccgtctcaaaaaaaaaaaaaagtttgacatgcttgtggtaaaataaaaaacaactccccacaggtaacactgttatttttctataccacagattttatatgtttgatttatatatatatatatacacacacgcatatatattatggtaaaagatacataatatgatatttaccattttagccattttgaagtgtacgtacagttcagcagcattaagtacatgtatgttgttgcgtaaccatcaccagcatccatctcctgaactcttttttttttttttttttttttttttgagacaacaactcactctgtcacccagactgggagtacagtggcacaatctcagcttactgcaacctcctcctctcgggttcaagtgattcttctgcctcagcctccccagtagctgggattacaggcacctgccactatgcctggctagtttttgtattttcagtagaaacggggtttcattatgttggctaggctggtctcgaactcctgaccttgtgatccgcccacctcagcctcccaaagtgctgggattacaggtgtgagccgcagcgcccagccccatcttctgaactcttttcatcttgtaaaactgaaactctgtacccatgaacaattcctgacccccagtcctgataattccattctactttctgcctctatgaatttgactactctaggggccccatgtaagtggaatcatatagcatttattcttttgtgtctgggttattttcacttagcagaatgtcttgaaggttggtccatgttgcagcatgtgtcagaatttcctccctttttaaggctgaatcatagtccattgtatgtatgaccatgtttggtttctccgttcatctgttgatggacatttgggttgttccccccttttggccgttgtgaacagtgctgctgtgaatgtgggtgtacaaatacctgtttgagtccttgcatttaatttttttgtgtatatgctcagaaagtagtactgctatattttatgctgttactggttgtgcttctcaggcaccttgggtcccctgggcagtgttgacaggtcagcagagggctttggataccaccccttccccctgccagcgccaggcctgccacagtagctgtctgcagaggctagggctggcctggccatttgggtccccgagggcacactgtggagctgcagagctaatgaaaagttttggaatcttgtggtgcagaagggcctttttgggccaggtccccacccttccttcctcctgacctcctcgtgttttggacttggggaagggggatgcagcttctgggagccctggggaggcacggggaccccgagcttactttgggacctagaggcccattcttcttatgacctcccccacccctgcctccagttcttcctgtcctgggctgtttttctctccgaggctctcccagagggttagtgtgaaaaagatttttggcccgttaattacagagactaatgcaaaacttcctagcttcctttggaggaaaattctatttcttgctaacagagcaggagctcctgtcctgatgcctgctttcaccaagttgggccccagagcagctcctcgctagagccctgtgcacagctgactggtctctgtgggctcactggttcgagcttcattatgagctgctttgaccccctggcagagatctgcacgtggctgtcttttgggtgccccgtgcgcctcaggaggcagtgtgtctgttctgtcagctagatcacagctctctgagagcagagctgctggttgtttttctttgtggcctggtagtggctggtctggtagcctgtacttcctggatgcccagttacagagaaagagaggccatgaaaataatttgggatttggcattggagaactcctggcttttggtttggggcctgctctttgctagccggcttacttaaccctctcgagcctgtttttccgtctctaaaatagggatcagaaaaccttacttcttttttttttaagatggagtcttgctgttttgcccaggctggagtgcagcggtgcaatctcggctcactgcaacctctgcctcccgggttcaagccattctcctgcctcagcctcccaagtagctgggattacaggcgctcgccaccatgcccggctaatttttgtatttttagtagagacgggggttccaccatgttggtcaggctggtcttggactcctgacctcaggtgatccacccaccttggccttccaaagtgctgggattataggcgtgagcccaccgcacccagccagaaaaccctacttcttaataagcttgttgtgaagagtaaatggggtcattgttataaagtgcgtaggtaagtgtcagtgaatgtcagcttttgtcaccgttgtgcctctgctaagtggaagggcctgggggggactccctgcagaaggccaacttcctaggacctctgtgtgctttctgtccatccaagccctactcccctgggagaggctgcgtgtgaggttgtctggttgggtggcagcagcttcccctgcagaaggaaactgcttcctccccagggagatgggagttgctaaactctggcttgggccggctgtgtgctctaagcagggattatgtgcgtgtgtgatgagggcggtgccttgggcttcattccagatacaccgtgttctctgacctcgcactcccttccttggagcccctcactccagcaccaggcattgtggctcagaactcccactgctccggattgctatttgacagtttcataggtgggtcctacttccctttttagatgataggctccaggacctccatattcctcatatttggggacagaaaataagagcttctctttccatgcagtaggatgcccctttctcctgtgggatgattgggaccggcctgtccaggcttgggggagggaataggaacgggaaccctgcttggagctgcattctgtgttcggcccctccctgcagaagacttcaccttgcagagactgcagagtgttagggagaacccagctttggagccagcagcactggtgtggaggcaagctctgctgtctgacttgctgtgtccttgagctggtccttattctgagcctcagtttcttcctctgtaaaaagacaatctgtcttgcagagttgttgccgagactaaatgagatgatggatgtaaaccacccaagctggcatcccatacctggtaggctccctaagtgtgttgttattttgtgtgtggatgggccaaggggtgcttttagcgaaccattcttctccacacagaggtgtggtgagacagacttcctatatacatttctgtagcccagagttgcccaaacttgcctgattataggattcacatggagtacttgttacttgttaaaataccaatctgtgagtcccatcccagaactcctgaaccagaatggtggttgttggggtgaggggtctctacttttaaccttttttataatcgggccagtctgggaaatgccgtttccctcagattgctctgccagttgctgtgtcattccatcttcacgggggcccattggaatgagacaagtatggccccttggaaagtgggagactttgcaggtgagactgaagcttgaaggggctggcctgaggccctgagctccttgtggtggaagcagatttagaactgagatctcccagtgatgtgtgtccattgtgcctgcaaacattccactaaagcatggaaaaggtgaaggtggggatggagagagatggagtgacaggaaggaggtgagggctgagggcctccatgatggccttgggaacctgcagagactaagtgggggatggatggtgggacagagccctgagccccactaggatgcttccccaggtgtgccttctgaaaaccagggccccagtgagcatgtggggccttgggcttcttagaaccactgggaatccacaggtgtcagagcgtaggcgcggtcttaggcagcatggacccagcgggaggggctgggactcctcctcagggctgctggtggagtcctggaagtcctgtgggtaggacttctgccacttctcccctcttcctctgccttttttattgggctgggaagttttctagaagcacaggcagggctggctcccttgttcagatagggaagttgaggaataggtatttccagggtcagctgatgatgccaggaactggggtcccactgccttgtctgcttcctccttctcaaagttggcctggtccattagagaaaaccccttttaggtccttactatgtcatcctttccagtttacccttaagaggcccttaaggaggatttcaacctctgctgggccccacccccagagggtgacttgattggtggtggtgaggtgggctggtgggctggtgggctgtgagcggaggggccctgttacggacagttgtgagagtgtggccggggcacggtgacctgctgccaggccctggggagagtcacgctgactgagcctgtggttgaaagtgtgtgactgccaccgcgggtggaattctggctcctgcatctactgttcgctgtgaccttgagtggctgtgagctcttggcctcggttttctcatctgtaaaatgagatgccttctggggtggttaagattgattgggttgacactggtagaacacttggggcagtgggttgggagtgacatcctgatctctgaagctcttccactcagacctttcaattagatctgcagcctcaggactttggacctttggggactgctgtgaacagcgagctgccccaggtgtctgggcaggcagggagtatgggtgcaaagctgtggcctctctgcctgttcctccttctgttggctcaggtctgaaaatctgggtgtggcctctgcccctcctccccgtctctcctgagtatctcttgtatccacctgcttctccctctcctacactgccaccctggactggctccctttgtctctggctgggaccttttcgtgatcttgtgcttggtctcttttcagccactcttttccatctctgatctgcccttcccatggcatttagaggtctctttctaagatgcaggtggaattatgtaaccagcatctgattggcactcccagcccaactcagcccgccacagccccatttgtttctttcagctaaaataaaatgtcttcggtgacttccactgctctcaggagaaacaacagctgcaggaacccgaacacccatgtggctagttgatctccagtctctggcaccctcttcttccctcctgcactgtgactttttttttttcagttttttgaacagaccttactctcttttctctggggcctttgctgtttgtttgttttcttcttcttcttcttttctttctttctttctttctttttttttttttttgaaccggagtcttactctgttgcccaggctggagtgtagtggtgcaataggctcactgcaacctccgcctcctgggttcaagcgattctcctaccttagccttttgagtagctgggattatgggcacgtgccaccacacccagctaattttgtatttttagtagagacagggtttcaccatgttgcccagccccacacacgcgtagggtgacctacagctacctgctccacacacgcatagggtgacctacagctacctgacccacacacgcatagggtgacctacagctacccgccccacacacgtgtagggtgacctacagctctgcctatacctgttatgctggtgtaattattagtagaccccctggtgccttggtttggatgacaggttatgtgggcccccttcacatttacgaacttttcatctaatactccccagccttatagattcactgactcccttggggcagtgatcagacacactgcccccctacagccccccaggatcagttcagggtcctgttttagccttatgccttccaggacctttcctataggcactggatcttagtgtacaaaaatacacgcattgataaaatctttgcttattgtttgtcttctccattagactgcaggctccatgacttaggacagtgcctgtatttgcccacgatgtaaccctagtccctgatacagaatgagtgctcagtaagaatttatggaaggaaggaatgaatgaatctggctgcagctgtctggcaggggaggcctggagcctgggcgagtctgtagaatctgcagtggcctgcgtgagggaggctgccaacatcgggccagtccaagccctagcaagccagttgcccacactctggcacacatcatcggcttggtggcccctttaattattcatcggtctttctcaatggcctttgtgttcagaaacccaagacagaattcaaaccctctttccatctccctaaaactgagacctggaagaaaaacctgctggcccattctgcatccccagggggccagcaggtccacagcctcctctcgtggctggctttaagcgttgaagtgtcctgggctgccctgtggctctcctccccagtccactgggctcagggactgcctgggcacagctgagtgggtgcccgtgtggcttgagactgagcagggactggtgcaggctggtgggcagagctggatgagtccccatcattccccagcctgaacggagtctgaaggctggcctggaagagtttagcctcccagcagagtggagcaggctcaggctttgaccgacctagttcacacctcagttctgcctcttgccagctgtgtgactgtggggaactggcccttggtgtcctgttcctttgttcctttaacctagaattgttgagtggacttgctgagatggcgcatgcctcgtgggtgatgataacagtgagtgagcactcactgagggttataatggtagccaacatctttgagcaaccctaggatatgattccctctccttccctcacctccccttggggctccctgaagtccacgttgccatcagtgtccccatcttgaaactgaggatggaacgctgatctttcctttcaaggttggggggagggggctggggagccgaaagcaccccagggctgcccttgctgcagtgtctgaagtgaagcctaggagccccggtgctggtgggcaacagcaggcgtggatctctctgatctttgaagaggactgtgaatacactgaccacaggcggaagccccttgtcccgtcctgccctgcactacccagaggtccctgggcttctcagcagaggtggacagatctgcttgcagctgcccttcttcccacgcttctggaaatggaagttcccacagacacattcctgttcctcagcttgctgctccctgcttgctgataccttgccgccctgtccctcaaaccgggctggccataccaaggtgttggcgagctgctcagcctgctgagctgttgacaccccagaccaccgccggcctagtggacaggccaggaaggcagtgatggcactgggtcacattgtcctgggcctgggtgagggtttctgtgctgctttttaatgtgctgatctgtgtgtttgtgttttgggagaagaaactttgtgttgcggaacctcaggtgaagagaattgaggtcgttaggctcctccgtcatggcccagtgtcatctcggggccatgcaaggcctctgtgtgtccgtcacattttatcctacaatctcctgtgatggatatgcagattgtccccagctgctctcctgctgacacaaatgaggcaacgatgaacattctcccatacatcccagtgcagctgtgtgaggattgcattgagcagggaattgctgggttgcagggaatttcctgatacgctgctgagttaccccctaaaatggctgtacagtctactctccaccagccgggcacgagggcttccggatccctcaaccccaccaacattcggcgtaatcaactttctaattgtttgcctgtctattaggtgtaaagagatgcattttagttttgagctgcagctgaagaggaactctcctccaagtgccaagactgctcccctcctccagtcagctctcttggaaccagaaacttcctcctgggtggtgttgagaatcatggtgatgctctgcagaaaacctctcctctgtaaggagtggcagtttatagatacagcccgttaatgcctcagtccctgcaggaagttcttttttttttgagctggggtctcactgtctcccaggttggaatgcagtggtatgattatggctcactgcagcctcgacctccctgggctggggtgatcctcccacctcagcctcctgggtagctggaactataggggtgcaccatcatgcctggctaacatttttaaattttttgtagagacagagttttttgcctgttgcgtaggttcctgcaggaagttctgctccctgggagtgtctgctccagtcccaccccgggggtgcaaatcactgctgtgacttgtggtggcttgtgatgcttccacagttgctgaacttgttgcctcatcccctggtatctctggcatcctgcgggcttgggtttcctggagctttgagaattcctttgcaaagtcatgtggctgctgccgggtggttgtccctcagggaggaggtgggtggcgctgtggcattggcttggagtttgggctggatcagtgctgaggtcctattgatcaagttttgactgagtcagagaggttggggtgcagtgcctgctggatcctgctagcccagatgaaggaacacactgggtgccaaggtgtcccccatgatcccttgatgctacctgggaccgtttagtagacaagggcaattccatgggtcctggagtcgttctttttgtctcatgcctttccatgagcaccctttctcttgtctttcttgtactttagtaatgaactctagacactattaactacttagggtgtgctgggctttttgcatagattatctcattgaaactccttaccaaaccagttgagaaaggtattatccctgttttacagatgaggaaactgaggctcagaaaggtcaagaacttgcttaggttccaaggttagtaagtggcagacccatattgaacccagctcttctgtgcccaaatccgttcttagccactaagccttggtcctcagagtgtggtctctggaccggcagcatcagcatcacctggatacttgttagaaatgcagtttctctgccggcctagaactttggaatcagaaactggcggtggggcccagcaatctgtattttaacaagccctccaggtgattctggtaaatgttcaagtttacatattcaagtttgagaaccaccgcactgaattatcctgctgttcttttttctattttttctgcctggcttctccccttttgtcattgggccagtcactgtgagcccagactttgaaccctggctgctcttcaggggcttcatgccccttttaaagaggtgcagtaattcgtcctctggggcctccacaggaacccctcccaagtccccaaaagcagttgacagaactgatgctccagctgacagcctggtgaccggaaccaccatgggggtcagagttcccagtcactatgcccaaggaggtgctttgaggggtccgggtgacccaggggtggactgtgggacagaccaggacagaagctcctgctgggagattattttaggggcacagaaaggagacttggaaaacttccttgtccaagcaggatctctttctttcttgcaaatttgtaatgataagtggtttgacctttggagaggagcttccacacaggggtttggaatctaggcaggtccttgtttctggtcaacaaggcacattcaggagaaatgaccctggggagaggatagaagctaattttttttttttttttttaagtagagacagggtcttgctatgttgcccaggctggccttgatctcctggcctcaggcaatcctcctgcctcagcctcccaaagtgctgggattgctggtgtgagataccagagccagccttatttaatttttgagcccctaccgtaagtctagttttgtgctatttaattcttagcccaaccccaggaggggtggatttcatcatcccattccacagataagaccatggaggtttcaagctggaagactgagggtcatacctcaactacatggaggggtcaagttaggggccagagtctgccagaccccgggttcccatattgtatgagtagcaggctgggccaaatccctgtcagctgggggagttctctatggaattgagtgacccagagctctcagcatctgtgccaaaaaaaccaaatgacctcacttttggtggcttttccttctttggggaaggaatgtgctggccactgctgggagctacagcctgctgaggcctgtgtgctctcagacctgcaagggccagaatcagactccagacatgggggaggggttacagcaggaccaaactgtaaccccggaggaccggggaggaggctgttctcacactggcctcccggagcgggtgccactctgcttcgaagaccagctccgcccatttagtaatcctcatctcagcaggcttaccagccactgttcagtagctgaactagctcaattacatcagtcccccgagagggctctggtccagggcctgtctttgagcctggtttctttccaatgggccaaatgggttaaaaacaaaaccacgtcttgatataaaaggcttagcggggtcctggaacattttagtttaaaagagaaataacagctttattgagatgtcattcacatacccatacaattaacccatttatacaacttcatggtttttaggatagtcacataaatgggcagctatttttgccatcagttttgaacatttttatcaccttagaaagatattctgtaccccttagctatcacctcccccaactcctccgttcccagccctaagaaaccactaatcaagccgctttcggtcttcctaggtgcttttgtgttttaacatctagtgagtgcttggtctgcgtctggtagcagactgagccctttgcactagctcacatagccctccctcgtgactactttatgggctgcaggctcattttatctttattttattattactattttcaccatcatcattctggcccacagaagtctttactgatgtgagaaccaaggctccgggaggcccagtcgcaagtactggacagagctagctggtggctggcagttggggtgggctcttgggtccctgggaggggtgaggctgtggatggtgacagattggctgaggcagttgactctcattggcgaggagctaagaggacagacctgtttcttcactaggatcgtgtgtccacctgttttaaagtggctctgatttctcctgggagcccataggttccacctgtaccaggcaagaaggagctgggcagtctgccttctggggggccttggatggcagggaggccagatcagagtctcatggtggcccaggagccctctcaagcacggtgcctttgttaggcctcccagaaaaagctgcaggccccctgcttcttggccctggtgaccctctgggtgtctggtgctatgtcttttgaaatgggctgtagatgggtgtaaaccaggaaatgcaggctccactcccccctccccatctcctcctcttggccagaggcccgtctcagagttctctcatcagtggggaaaaaaaacaacaggacttctttcttgctctgtgaatgattaactttgattaaatagacagtggatgggaagtgagagcatgctgaccgctgacattgactgggctcctgatgtgtccagggtatcttgctggctgttttgcttccattgtcataatcttcacaaagtggtgatgttctttatccccattgtaaggtgaggcaattgacacctagacagtttaactaaagccacacagccagtgagtggtgaggacctgctgggttaacattgtttaagtgtctgttgtggacacagcaccaggctaagtctttcaggacatagggtctaatttggtcgtctttcattctgtgccattgtaggccttgttatccccattttacagatagggatcctgaggctaggattaaatctcctgtccaagcagacagatgtaatgtgaggtgtgggctggcactggagcctaggtctgtcttgttccaaagtccaaggtgcacccccagtcccccctactctgaatctccaggaccccagcactcacatgtcctggggacaggctgttagagcagtgccaggtctcagcagaggcctggtggttgtcagctttttcagcagccactcccaggtgggtgggaagtgggcagatctgggtggagatgttcccgaagactctgcttttcatcagcgcatgaaccagctgacggctggctttgaagggctggcagtcagcccctgataagttagccagatactcctatttaccatgccagaacactgggcatctgagatcacttctgggcaggtctttgcttagacaaaccacccagggcccacgccctggccagactggccatacttgtatgggggtcagagggattccagcacgccccctggctgcacctcagtaacgtcttcaacatcagtggatgctgcaggggactcaacgctgagcacaggtgctggcctggccttctccaaggaccctgctggttcacacaccccgcccacacagcagggggctggcttgggctggcagggtgcttgcctggggaggctggtgagtttgtttttgactcgatgagcctagaccagagtcctgggtgctctactcagggagaagaacgaccatcagacgagaagctggcttgtataggaagctgtgtaccattttcaggaagtgtagaagctcatttgggtgatttcctggggtcacttggccagagcacagccctttatcttacccagttagcagtttgctgtcttaattattggggagatgtgtgtgattgctggtgtatcctcatgtcctgctccctaattatgactttctttaagattttacactgataaggcactttaaagttcttcagagccttttccctatattatatcttattttattctcaaactcattcttttaaatagatgggataattttttcattttttatctttattttggaaacatcctttttcctcctccataatacctgagccttgtcccacccttgccaaataatcccagagaaatgggaagtcctctctatcctatcctagaggtctgacataacaattaaatgtatatattcccagacagacttttcttttttcttttttttttgaaaaccactaactttattgatctaaaaaactttacaaggacagtgactgttctgccaaaaaaggagccaaatggtatcaaatggactgcaagtgagggtgggggtgagagacggggccaggaatccatgcaggaaagctgataactgtcaccagggaattggcaagggaaaaaggaaggaggaggcatacaagagcgagaatccaaaaaagttgaaatggttaggggagaaaactctcaaaagaccctggagtacatcagaggtgagtacaatagcaatcttttcctctgtagaggacaggggaggagtcccttcatggctgcaaactctggatgagggctggggattgagggcttcccagagagcatcacaagaagttgtcctaccactcttaaaggcatcagaagcagttctgggattgcttggcgttggcaccacaagtgtccttcagccattcctggaagaggtcttcagttttcttcagcaccagaaactggccaaggacaacataggctttgtcaaagcccctttcctccggcttcttgcccaggacttcacccggccaggctccccactggctcttcccccatgggctctgccacgaactctcggtgcttttggaaggttgtcatcttgattaggcctaatcggcagcttcaattcccgtaacagttcctcccgccaccccctagacagactgttcttttatttgcatacttaaaaaaaaaaaaaaggtaatgacagcacattttggtacaaaactcaaacaaaagcatattctgtgaaaagcaagtgttctctaccccctgccttcccatttctctccctggaggcagccgatgatcctggtccttctgtgtcctgctaggaatgttctagcataaagcttttagatgctgtccgggacactaacgtcaggattctgcttgctgagaagggttaggagctggctgtcttgagacagaaacactgagtatgttttgagttcatggagatgaaattgtccctgggaaattttttggctttctttgagagcccaccaatcagaataaaccctacacaggaacaaaagattgttgccgggtgctgtttggttgtgtcttctcattaggcgtgttctgatgggaaaagtttctgggctccagcctgcaaggtaggagggacttgtttgcgctagcagagctggaagggattgaagtgacttatctgaggtcacacgcctggctgagccagggcaggtcccaggtttcctgatcccatcctctgaacacttaactcccctggcctgaatggtggctggtatttttgattccgggagagtgggaggatgtgcttggaagaggtgtggccagcacgtgagtttggagcctgggctgtcccaccactgcccagctagtcttgtttggctgcaggtgggttatcttgtttattccactgtgcaacaaatggaaaaagcacctttgtcaatggaggcttctctggggaggtcagccagagtggatggcctggattgtgtgttgaggcttaaacatcagaatagagcgctctagccgggtgtggtggctcatgcctgtaatcccagcactttgggaagccaaggtggacagatcgcttgaggtcaggagtttgagaccagccaggccaacatagcaaaaccccgtctctactaaaaatacaaaacttagccgggcgtggtggcacgcgcctgtagtcccagcaactcaggaggctgaggcaggagaattgcttgaacctgagaggtggaggttgcagtgagctgagattgcaccactgcactccagcctgggcagactcctctcaaaaaaaaaaaaaaaaaaaaaaaaaatgaacagagagctctctgacaggagaagggagagggagcagatcatcataaaaaccaaccacattgccaggcacagtagctcatgcctgtaatcccagcattttgggaggcagaggcaggtggatcacctgagctcaggagttcgagaccagcctgaccaatatggagaaaccccatctctactaaaaatacaaaattagttgggtgtggtggcacatgcctgtaatcccagctagtcgggggagggtaaggcaggagaatagcttgaacctgagagatggaggttgcagtgagcggagattgtgccattgcactccagcctgggcaacaagagcaaaactccatcttaaaaaaaaacaaaaacaaagcccacaaccaaccacatttacagacaactgtaaaacagcaaaaaatcctaatcagttcagttactggagtgcaagccctgttagcattttgatgtgttttgtttttagtcatttttttcatgtttgtgtgattgcccacatagttttaaacttgcagtacatacagtcttgaatcctgctttttttggttaattatatataagcagtttttttcatagtaacatagtttcagaacccatcattttggccatgtaatatttcattaagtggatgatgaagcctaatatacttaacctaataccttattaatacaatttctgtctctttctaatttttctctctcaaggaatactggcaagaacatttgtatgcttacagcctttgctttatatttagaattattagtctttattcaggatggtggcccagaattgggctaagggctggtgcccatcttagttcaccttggtgagttgctgtccatcagagttgtaccaatcgcctgcccacagtaatgtgcctttgtcattgaacccaccagcagtggaaatgatcagaaaactactttgcacatgtaataagtgacaaatacaccttttgaaaattcacaagcatggcagcatgtgcgtgacatgtctaaccacaggcccttgtgacaggtattgacgtgggttcctcattgatccagccccaggagaggcgcgcccgctgccccttacgggaagtcttgccagcttttgccgactcccagatggctgatgtccccaagacctgtcaggagtgttaactgtggtaggcacagctgtctgctgcgtgcttgttttagcatgtcatacattattacgtgtgtaactttattagcagacttagaaagctttcatgttttcccattgtgaaactaaagacccattgggtcttaattcacatttagcctgctgacatttttggggggcctgtgggatgtcttatttttatattgtggcagcatttcaaaactgagggagtctacataaaaatctagatttttttttttttttttcttgagacagggtctcactctgtcaccccaggttggactgtagtgacacaatcatggctctctgtagccatcatctcccaggctcaagcaatcttcctgccttagcctactgaggagctgggactacaggtgtgtaccaccatgcttggctaaattttgtttgattttttctgtagagatgaagttgcccaggctggtctcgaactcctggacacaagtgatccttccactttggcctcccaaagtgctgggattacaggcataagccactacacccagcataagttcagatttctgtctcttcttcattggaggtgtggcagccaagggcctatgttcccatatgaggcacagaggagctgcttctgccccgggccacctcctgccgtgatacagaggccgtattctagttgccattgagtagctctcatgcaccctagtatacttgtatttcaggatagccatgttttcttctgggtagaaaaacaaaggatagcccaagagggccactgtttcaagaacaatgcataagaatacagggaggtggccgggcgtggtggctcatgcctgtaatcccagcactttgggaggctgaggcgggcggatcacttgaggtcaggagtttgagaccagcctggccaacacggtgaaaccccgtctctactaaaaatacaaaaaaattacccaggtatggtggtgcttgcctgtaatcccagatactcaggaggctgaggcaggagaattgcttgaacccctgaggcagatgttgcagtgagccgagatcgcaccactgcactccagccagggcgacagagcgagatacatcgcaaataataataataataaaaaaaatacaaggaggtaaggactaacttgtcctacacttgacccctccttgtgccttagtttcctcatctctaaagtggggagaataatacttgtcccacagtgtcattgtgatgattcaatgagttaaaggaggtaaagcactcaggagaggatctggcgtgtagcaaatggtcaatacgtattagctgctgctgttattacgatctgtggcatatgtgtttgtctcctccagatgaggaactgaggggtgaattttgcttgtcatagcttggggttgggcgatgttaccagcaactagggtgtggtccaggggtgctgctgaacatctatgatgcatacagcagcttccctgcccccaccaaaaaatttttcagaccccaaatatcagtagtactgaggttgagaaaccttgcttagaccttggcgtgtgtgacccttggtctgactgaactcttctaacaggtctagaccaggtgcagtggctcacgcctgtaaccagcactttgggaggatgaggtgggaggatcacttgaggcccaaagtttgagaccagcctgggtaacatagagagacccagtctccaagaaaaattaaaaaaaaaaaaaaaaaaaaaaaaaagctgggtgtattagtcagggttctctagagggacagaactaatgagatagatgtatatataaaggggagtttgttaaggagcactgactcacacactcacaaggcgagctcccacagtaggccatctgcaagctgaggagcaaggaagccagtccgagtcccaaagctgaagaacttggagtctgatgtttgagagcaggaggcatccagcacgggagagagatggaggctgggagactcagccagtctagtcttttcacgttcttctgcttgcttttattctggctgtgctggcagctgattagatggtgcccacccagattgagggtgggtctgcctttcccagtccactgattcagatgttaatctcctttggcaacaccctcacagacacacccaggaataatactttgcatcctttaattcaatcaagttgacaatcaatattaaacatcacactgggcatggtagtgtgcaccttgagtcccagctacttggcaggctgaaaaaaaaatcctctaaaccaacattttcaagggctgcctcaggctcttatagagtcagagtgataaaggaccttacttagctcaactggaggggctgcttgaatcccttccccagtgcccttgccgagccctgccttcagccgcaggtagcacactgtacagccagcttgtggtctgttctttattatgttgaactctaatcttccctgaaactttctgtccttcattctaagaatagtagctcccatttttggagcctgtgtgtgggtgattctgcttagcattttccacgtgctactgcaacgatcttccccaccctgtgaggtggttctattaccatccccattttacagatgtggagatggaggcttggagaagtcaagtcacatgcacaaggtcactcagtggatccaggtccatcttgccgtagaatccacattcctcaccattcctcaccactggcctattctgcctggtctgtacccagcaagtttactcactcattcatggaaggatctttagatatttgcagtgaatccctcagccatctcatctctcctcctggtcatagagccccagttcccaaagttcccctcaaagggctgtctggtctgcttaccatctgtaatgatctctcttgcctcttgacaacacctgtctgtccctgggctctgcctctgtctgccaggctgccccagaggggctgcccatcttctgccaactctgctgatgttccatcaactcagactctctgtgccaatgctggctgcggtcccctggatttcatctggttggtgttttcacttcacagtgacccattttcagtgataccctatgagattcagcttacctgtttgaccattgagaatctcagccttggttctgctgttcccttccagcacccacccatgcctgcacctgaaatccacgtcattcgggtggagcagaaagtgtgaggggctggaggagtcaggaggttgagttgtgaatataatccagccgtgtggactggggaaagcctctcaccctctcttttttgtgtccttagtcgtaaagtcaaggtttgacttggatggtgcctaacacctcttctagctctaacattcttttatgaggtgtgttaacagcataaacttataataattatacccccaattgtggtggcaatagtaacaatagataattattgcagttgctataattttcagtgttttaagtggactgtctcattgactcctccaataatcctctgggtaggtgctattactacccccattttacagatggtgccttaaggcagagccatgtcaagtcacttgtccagggtttaccacctgctagaagctgataggcctggatttgcagtcttctttagagtgactaaatccttgcattcccatggatacttttctgcagagtgatccgagtgaatcccatggccctcctgctttagggtcttgtgatttacctctccctctccccatgaccaagggtatgaaggatgcttgattgtaaaagctcatcccctaactcatgcttctggggtaatcttctgtaccccagctccttgcagagtgtgattattcagacatccttttagaatctaaaattcaggcagtgatgatgacggtaggaactaccactttctgcacacttactatatttcagacacattgatactatattgtcattattcacataaattaacaacattactatgctaaaattatttactgaataagggtacttcctgtcagtcatgcctgggagatgctattgtcccccattttacagacttgaaaactgaggctcaaagaggcctgttgtggctaaagaaacattgcagtgtgtctgtctgagcttgggggcagggaaggcacgttctcaaaagccatattcctttccaacacattttaaaggaagtatatcacatgataattgtgaaagatgtgacgaaaagaggttagcggagtctgtgagagcaaggctatgagacctgtacagaaggtggacaatgtgattctgtctccatggccagctccatggctcctagcctgggctggggcccctctgttggcgcctggccaggtccctctttgcaaccctgaactacagggctggacagttgcactctccacctcctcaaaccaccttcaaactggattagacatgggcagtggcttcgaggtcattgagaggctgagcaggggtccaggctgttttgcggcccctccctctgtcccgggtcctcagagactctgcagggccggggcaggtggagtgcagacagggctgctgagaggggaacaggccgttgccgctgctctgcgggaacatcccagtgtggtccttggtcccaaggacttttcctgggacctctcggcatccctgaagccatttctggaacggagtgtatccactgaagacctgccatcccggatctcctttgtcaggctgtgagcctgagtatggcccaaggaggtgacttgaagatggctcttggggtgaggggaggccagatagggcagggcttcatcgggctgagcagtaacatggccctgtaccctttgtttgaatgcggctgggccacaaacctgccggggtagcactccccaccacgccgggcgtccaggctggaggtcttggggccgtgggtctctagcatgggcctctcctgtggctttgaccttcctctccttgctggacccctggagcactgctaaggagcaggtgccaccccctcatgctggagcttgagcctcaagaccaaggctgccccaggctggaggggaggatatagttgtatggtgtgcgttcagctgtcagacctcctctgcggaggtgcacaaggccactgtcaaaatccctggttttctgcacccacgccactgttccagccctctcccacgaacgcaccacagttccagccctctcccacgaacccgccacagttccagccctctcccacgaacccgccacagttccagccctctcccacgaatgtgccacagttccacccctctcccaggaactcaccacagttccacccctctcccaggaactcaccacagttccagccctctcccacgaacacaccagcaccggtgcaaaaaagagctcgcatgttgtcatcttggaaacagtacagcgcgtggtggggtgggacctacgacaggagagtttggtggctgggggcagggagaggatgtggggtgggagtgcagaggagcaagagcaagtcctctgagacctggtcccgggatcattttgggggagctagtcctgtcctcttcctcctccccactgttcactgagcacttactaaatggcaagttttttacagatgtttttgagttaatctttttaacttttatggagcgctgttactatccctgttttactgcaaagggaactgaagtttaggaaggttaatctgaaggtcacacagccagtaaatagtggatctgagaactgaatccagctctgatgcgtcccgaagtgcatgttgttgatcaccgggtcacagccaccatttcctcctctagcctaaactttgcggtggctgctgcttgttggggaaactttccagtttgagaggtgcccagagcccccttcaaggcagtaatctatggggcctctgaggattgggggttttagtaaagccatgttccagggctttgtccaggagacctgagcaaacataggtgtgttttgtttcccagggctgagcctggcttttccaggaaagggggctggctgctttcaacagcacttttcctctttcaaaagcagtgtctttttacgacagcagcctcttcctcctttatctcatcccaaccccctccacgactgggtagtaaacagtgagaatttatagcccccagctgggcgggtgggctcagggcagtgcctgctaggaccctggatgtttcaggccacattggacctgaaagcatcccttcgagttgctggggctgacacagttcccctcaaggaaatagaaaaccttaggctgaaggttcagtgctgggggactgggagtgggtgctggggatggccaagatggtgataaatgagaaaagaccacccaccccagtgtcaacgcacactcaagtgtgaacgcacagcttgaagacactgggcagaccagtgtcagctgggagagaatgtgcaaaaccaaagtaaattatatttgttttaaagagttaaaaatcctttaatatttttctaccaataaaaagaagttaaaataaggataaaggctaaaggccctctcatctcctgcagtgccagcagcggaggaaggatgcttggtacatacgcttccctgtcctgctgcgtcctctttcctccgagctgtcttctgtgtccagggggtccctaagagcactgtttgtcccatcaccccctgccctgagagcattcagcctcacccacaaggtgcagttggatctcccaggaccctctcagctttgcatccagttccccacttgttccttcacctggctgcccaattcttacgtccactagaatgtctgctgcacagaggcagggacttttgctgtttagttcactgctgtgtccctgactctgtgccctgggtctctgggatataaaggtgaacattgagtttctacctccaagagctcccaggctgggggtgtggagctgacaagtggctaggcataatgggtgaatgcagggtgctatgggtgtgtgtccagcccagacagagcaggtggctatcaggaaggcttcctggaggaggtgatatctctacccagtcttgaaagatgagtgagttagttaagcaagatagagaggacattggaaatcagtgtatgtcccctatctaccctgatctgtgtgccagtcttcccagagctctgggatagcacaatacgccgtttctcttcatcatgggagtaggctggcctgcagagtggagatatgtttgcagggagagagaggtattccatattggtaagttactagtgagacatgattgaaaaattaagcccaaagtcacagggtatcataatgctgtccctttctccccgcctgtgtggagggatagcttctgtccccctgttccctttcttgttcataggctcttcaacttttgctcctaaatctaagcagctatttcttttcccctgatactcgctggtgtgatgttcttccctcttcctacccacttattgccacttcacctttagagttccccagggcaggaggaagggattggggagcatgaagctgtgacctttcccatgaggaagagtatttctagtgtggctcctactgtcacatgaatgatacactgcccatcctttgaattttgcagggcaggtgggaagagagctgaatggctctggtgttgggtgagccccatgtaattggtagtgccatttggtgcagagaagtctggagttgccaatgaatggtttagatctaaagcaagggagctcttctctctggttgccacagagtggagacagctggagagagacacctgttttagatggacatgtaaaactgcgatgcatgcttttgtttctcatgtttgttgagacaccctcttcctgtttgagccactagctggtgctgttggcacaggatggcttagttgctgcctcacctgatcataatctgcttaatagagaagtaactatgaagctgatggtctttgatttgacctccttacattccctttctggaactcttcatgcttttgcagcttagggtgcccctatccccacccaaagcacacacagatacacattggggtgcttactcttctcccttgtcctgacaccctgcatctgaattctgttctcagcgaaacttactactcctttctcttagctggctgccaagtgagaaaggatttaatatactaatttaccctaaggtatcaacagggcttaatatgttccttcggggttactctgtcttaaaactgtgaagattgaaactaagtcttataacttaagaggtaacttgtaagaatggaattgtggcattttcaaatgtgggtgggcatgagtctttgagagagggctgggaggcggatgttaagggaatttgctgcttcatgtatcctgcttgctcccacccatgtagcaggctctgtgtagggtccctcagctgctgccctgtgggtagctcagtgcttggttgatgcagtgaatgagaccatggtggggcaactgtgttgagaggctctgctgagtaggtgtccacctcccaccccctggcaccattaaatggcttgtccaatgagggtgacaacaccagccccctgaccacttgcccttcttgtctctgcccagacattcacggcatggtgtaactcccacctccggaaggcggggacacagatcgagaacatcgaagaggacttccgggatggcctgaagctcatgctgctgctggaggtcatctcaggtgaggcggaacctggcccaggacgagatactgtctattggtgctgcctgacaccttggcatctgctctgcctatgagcgcagctggttttggtctcttgaaacaagttggggatgacatgtatgaattcatcctaggagcgtgggtctgagttctggttctgctgccagccatccaggtgccttggacatttgtttcagcatccttgtttgttttaaaaaaaaaaaaaaaaaaaaaaagggtttgaaggaactgaggttccttctcctccccagtgccaggattctgtggccaagaatgttaaccatgggtgactgtctccaaatcttggctccattactacttatctacctgtatccaggtgacccaggccattccccagcccctggtttgtccagatgtctggagggacagctctactggaacacacatctcatcctgcttatgaatgcctttctgccaccatcccttaaggggtgggagtcctgtgagtctagccttggttgatacactgggccatgttagctactctcttcaccttgatgccggtgagccttagacctaatcccagcccagccctctccctcgagccacctctgaaatgctgaacctcgctgggcgtctccaccccaatgtcccacacagtcctctcagcatgtccaaaactctgtgcttgtcactcctgccctagcaaacctcttttccctcccagagtcctgttcttctgcacccaagctgggatcatagacagctcttctttgcaagttgttactgatgttctgtttattctgattccttcttctcagtccttcttttaacccctactgttgtggtgtcagtgtggcctgtgtcaactctcacctagatgatcccacaaaggcctttaccccagctcttcctggcagtccacccctgtcactgtagccagagggcttgtccgacagtcagtccaaatatggtcacactgttccctctcacagccctcagcccgcggtgcctctccagggctttgagcctgcaggccacattccttagcatagcttatggaatcctgcatgagctggcacctgctttgttttcaactaactattcccaaaaaggtatcagaccttcgatcctctgccagttgtggggtgggggcagggggaacgtgcagctctccccagatgacatgcactttctgtttcctgtgcctttgcacaagctctaactgccctttttttttaaaagtagttttttctactttcagataaaacctgtgtgtgtggtaaaataatatataacagaaaatgtatcattttagccattttaaagggtgcagttcagcggtattaagggcatgcactgactgttgtgcagccatcgccaccgtccaccttcagggctcttcatcgtctcaaactgacaccctacagctgttcaacactagctcgccgctccccccggccctcccctggcaaccaccattctactttttgtctctgatttgactactctaggtataccttgtacgagtggaatcatacagtatttctccttttgtgacactggtttatttcacttactgtgtcttcacggttcatccatgttggagcatgtgccgccatccctttcctttttatggctgaatcgtattccattgtatgtatgacctacagctataaaatggctccccacattttgttcattcacctgtcggtggtcacttgggttgtttctaccttttgggtattgtgaataatgctaggacatggttgtacaaaatatttttaaaatccctctttcagttctttttttgtatattccccaaagtggaactgctaggtcacatgggaattctctgtttaattttttgaggagccaccgtgctgttttcctctgccgttatttatttatttattttcttttttctttgagatagggttccaccatgttggccaggctggtattgaactcctgacctcaggtgatcctcccacctcagcctcccaaagcgctgggattgcaggtgtgagccaccgtgccttgcctctaactgccttttagaatgtccctgcttcctacctcctccactacccttccccagttttaaacaaatctggccttacaatttatcattcttcaaaatgcagcttgagggtgtccttcaagaaggcttcacccttcctctctcccctaatctgagtggactgtgccctgcccgcaccacccccctacctgcccagctccccagcacctataataccccattaattcctctgctgtgtcttttatcacaaagtgtagtcattttcggttcgcttgttttcttctctgctccacactgagctccttggggcaggtcatcttctctctgtgtctcaggtgcttagaacagcaccagacatgtaggcggtgctccgggaacattagaatgactgagtgcccagagccgggcttgtcctcatgatacccagtgtgttcctgctgcataggtctgacgtgtgcccaggggacctgtgcatttctgtgaagcatgtgtctctttgccagggttgggaaagatctgttctgtgaaatgatctgttctcccctggacaggaaatgctgggatacctttttctcctgatcatcgttggagatgggtagggtgccccaggatgaggagaaggaggggtatgctgcctacagaggttctcaaagtgtggtccttggactacccacaccagaatcggcaggattgcctgtcaaaatgcagatttccaaaccttaacccagtcctcctaatcacaaacttagtgagagggggaaaggggctggacagccacagattagccagttctccaggtgattttgtgctgactgacgtttgagaaccactggcccaggcctgggaagctttttccattctcccgtgtttaacccttgcctcctccactgtcctttgcagaagcccccttccagccagtgtgcacagctgctgaatggctggggcactccgcttagctggacaggccccaagggctggggctgtaacaggagcagccttccagggaggggacgtggtgctgcctgcatccatcctgtggggagggagcctctgtgccatctccccccggacaggaaatactggggtaccttgctgggttgcagccagagccttgggagggccccaagtggaaagtcttgatttaatttaaaaaacagctgtgcttccctgggagctgacagccagatcccatctgtggcaggaagtctgccgtcttccagaagctagcaggctgctgggaggccacctggagaggtgctgctctgacagggtgggcctggcccagaatccccgtggctggtccctggagtcctcgcagccagattgtcgacctgctggggagacagtgggtgtggtcgggatatcagggcaggcacaaggggcctgaattccaggctctgcgatggtggttctcagccttttggggtccttggccccttagagaccctgaaagctatataccccttccctaggtatggctctatgctgcacttagaaaattctcagatcatttcaggaggcccctggatgctctttgttctggaataaaagtgctgttaatggggtatttggagagccagctcctctacctttattttctcaaaggttctgaccttgaaacctgagcagcagaagctactgtgtggaatctggaggtgggggtggagggttgacctggagctgagccctgggtgcccacaggaggcagcataataggacaagaactgtggttctcagatggggatgggctgctataggcaactccatttaaacaccagggaagtccataatacttgagtgacctataccctcctcccagggcaaagggaaggctagaaggagttcagggcctttgcatgtactgttccttctgccttgatcatcattccttgctttgtttgcctggctgcaaagactcagacctttcctgaccactcctcagttcctccttcctcttcctcctcctcttttgaagagcatggatctttctttgtatttgttcattgtatatatttatttgtgtttctctatttaaggtctgtctctcctactggactgtaattacataaaggcaagaaactgttttgttcacccccctattcctagcacccagccaaatccctggcatgcggtaggggctcgataaataaatgttgagtggatgcaagcagatttcgacctgagaagcagaagaaagaagaggcagggtagattctccctctcattccctgccagggtgacattctccagcccctgagcagcgtgtgagcacacacacacgtgcacacatgcacatgcttctgcctagctaagctgtgctttggatgagggtgtagtggtagtagctctggcccctggctcatagcgtctcaccttcctcttcctccctcttgatccaaacaggtgaacgcttggccaagccagagcgaggcaagatgagagtgcacaagatctccaacgtcaacaaggccctggatttcatagccagcaaaggcgtcaaactggtgtccatcggagccgaaggtaaggcctacctctggtggccccaaggagcctgattttctttgtccccctggttctcttggccttttttgtgctgcctcctgggcccatgcatcacttgggggcattgggcagtgggtccccagcacctccatctggtcgcctgtggaggctttgtattgcaacagcgcttttcttctagtctcagccctgcccaaaaccaaggacttagacccctgttcccatgcctgcacctgcttagccacgtccttgctctgtggagtcctgtgtgtgtggcatgccacctcccccatccagaggcctgactgcacggtgttgcctggagcagaggatttgtgtatgggctggaaagggtgtgcagacacaggctggtggaggctggaggctgccccgagactccccggggccctgggaagactgaagtcccgaagcctctaggaacatttttaatagcatttccctgcagtgtagcttcctaactctttaacttttacttagaaacacttaccaaaaaagctattagcatttccttaatgattaaaagaaggtagtgtaatttcttgtgtgcatggtggtggctctgaaaaattgagagtgggttgtttagagtgggcagaaaatgttctatccaggccccttcagtcctgtgaccatggatttagcaagtatttatggggcacctgctgcgtgatgtcagagacctaaagatgaacgaatctcactcattcaagacacatcgtggctgtgagaatggattgctcactctgtggcatatacttaatcctcacaacaaccctatgaggtagctctaagaattaattatcctgattttgccataagaaaacagatgcttaaagagattacgtgacttcctcaaggttccgccatcagtaagtggcaaagccagaactcaaacgcaggtcttcgtgacaccagaggaatgccctgagagtggccttcccttggagggggcaggggtcttgctcctgggaagtccataggagcagatctcttctctggttgaagcttacagtcccctctcttctagaaatggagggatatttatcaaatggagaactttaacacaggctcagcaaactgcagtgcatggggtcgagtccggctgatttggatttttggaaatattggaacacagcacaccggtgttaatgtatcatcagtggctttgtgctgcaatgacagagttgagtagttgctacagagcttatatggatcatagagccagaaacatttcttatcaggccctctacagaaaaagtttgctcacctctgccttatctggaattcaggccagtgcccaaggtggtcacgcaaggtgccttatggattccagcatctcccccaccagctgtgagcttctcaaaggcagaaaccttggtttctacatcctgtggccccagttcctagcagcatgatgcacacagtaggtgctcaatacatgttaaaaggatttacatatagcagtataatctgctttgtgatgaggaagatgttctctgccttataataagaaaagaacagtttgctttattagggagcaattcaagacttggcagaaaaagttataactaagcaggcgtgggaagccaaagaaagtcacccaggtggttagtgcaggctcggatgcccctggggcagggaagtgtagagaatttgtgaagtggttcaggggtcagtggcaggggtgggtagggaccgtggcaagctagagagtcatgtcctaagcgggatgggcaccttgtggatgtaagaagttgctgctgtgtggatccagtgctgctagatcttccagtttttcaaaagaagccagaaatccagattttttgaaaagaaaaatttggcaactaaatttaaaaaaataacttgtttgctctttaaagcctctaccaaaggggaggagggcagggaaggggaaggtggaagagaatagcactcaccgagtacccgctctgtgttgctagacagggtgctttacgtgggccatctcctgctacactcatgatgggctcgtaggatgggtatcaccagccacgttttacagttaaggaaactgaggctcagaaaagttgctagagtggaagagtgtcatcagttgagcccaggctctgagccagactgcttctatgtggcagatccagggttaaacccaggggtaggctccagagctgaggccttcctcttcctgttactgtcggcagtgctgcctccccagtcagagcccaggacagaactttcttttctttttttttttttagtagagatgggatttcactgtgctagccaggatggtctctatctcctgaccttgtgatccgcccgcctcggcctcccaaagtgttgagattacaggtgtgcgccaccgcgcctggcctaagatctgaaacttctttttttttttttgagacggagtctcactctgtcgcccaggctggagtgtagaggggcgatcttgactcgctgcaagctccgcctcccagtttgacgccattctcctgcctcagcctcccgagtagctgggactacaggcgcccaccaccacgcctggctaatttttttttaaatatttttagtagagacggggtttcaccgtgttaaccaggatggtctcgatctcctgacctcgtgatccacccgcctcagcttcccaaagtgctgggattacaggcgtgagccaccgcgcccggccagaactttcacatcgaattgtcttcagtactgagatggcagatcaagcctgcccctgccatgctggcctcaggggtgaggagtgagaggaacactggcgtgaactctcatctcactgctgctgctgtgctgggaaggtcattcacctggcagcctcagttttcccgtttcctttgacgcaggcctagcttctctaaagattttgaaaaggctcctttattttttattttttgagacagggtctcactctgttacccagactagagtgcaatggcacgatcttggctcactgcaacctccacctcccaggctcaagtgattcttaatctgcttcagccttccaagtagctgggattacaggtttgtgccaccacgcctggctaatttttgtatttttagtacagatggggtttcactatgttggccaggctggtcttgaactactgacttcaaatgatccgccagcctcagcctcccaaagtgctgggattacaggcgcaagccaccacgccccgacgaaaagttcctttaaagtgagacgttctttaccttctccctgccctgaggagccagtgttttcagctgtggcttccaggagtgaaatcatccactcccatcaggctgagcaccaagattatgccacaatggccgctctgctgagccaagaaactagatgaggcagcaaatggcgttttgtgggcttttaaaagtgaaatggagtttattgatgtcgattataaaataaaaggcgatgggcagatggcatagaatgagctctcctggaaggggagcgggggaacgttgcaggttgtccatcctgggctgctgaaggctgtgactgtggagaccaggcccagcagggacacccctcaccccccaccaaagtctttgaaggattatcatgcagtgcaaggactaagacctctggctgactccgaagggcagaaccaggcccagaataggtaccctgtaggtaggtggactctgggagccttgggaaatggagccggggctctgggagggttatgagttccctgtccctgaaggtgtgcacatgaaggctggagacaaggagcttccacacataaaggggaggttagagcagatccttaaggtctcccctacgatatttggttctagaatgcatagacttcatggaattggcctgggtgagtggttggaatgtagttaaccaggggagagaactcaaaaaggattttgtattttaaggtctttgggcaggtggagcctgagggtttgggtgctgtgagcatggaggtgggctcagtgaggtagcatgtatctttaggatggagggggcggtgggtgccataccacagcattggtctgggaggtggtggcccctggggttctagtttctgtcacatggaatttctgcagcattcattctgccgtctgaatactgaacagatgacggtgtccctggagagagaaggagggagaaacatgttcccagtaaacaggggatgtgagcagcttcatagctcgctgtagaccaagaaggtctacattacagacgctgttaatctgtcaccaaggtttttccacaaagcccagttgtggccttggaaccctccctttggggccagccttctaagcagtccctgacataaagctgcctgagagatgaggcacccctgctgcaaacgttgagaagccggaggcccggtatacaggacctgccatgccagggaaggggaaggagagtggatgggatgggagtcaggtgggaactggggctgggcgtgcatgggctgctaattaagcacgccctactctctatgctcgtgcttggcgcctctgttttctggagtgaaactatgcctttggtgtgaatgagaattcagtaagcaaaattctctggggagtttctggggaagaagaagaggaataagtaggcaagaccctaaaaagaagccacctgcctctcccagtccctccgggaggactccaagagggcaaatctgcaggcagtgagctcagggccagcgggaggccctggagtttggccgtcacagagtggggcagcatgtgggggaccaagggagggctagcattgcagccccactcctaggaaggccaaaccatgggattaccactcagagcttttttctaggcttaaaaaatttttcccttatattttaaacactgtttatgaaattttttacctgcttttcccacttcccatgctaaaaaatttttctaagttattaagcactcataagcattaatgtctgcgttcattgtcttttttgttttgtttttttgagatgagtctcgctctcttgcttagtctggagtgcagtggcacgatctcagcttactgcaacctccgcctcccgaattcaagcgattctcctgcctcagccccacgagtagctgggattgcaggcatgtgccaccacatctgcctaatttctgttttagtggagacggggtttcgccatgttgtccaggctggtcttgaactcctgacctcaagtgatctgtcccaccttggcctcccaaagtgctgggattacaggtgtgagccactgcgtctggcctcatcatctgtttgtcgtacttcgtcccaggcctgggccctgccctggaagagactgaggtccattgtgttctcagggggccaatggcaggcctgtgttagctctgcccattcccctacttgtggttagtgtttgttcactcattcgttcactcagcagatgctgatgggggctttgcctgtgccaggcttcatactgaactctaagcagtgatgcaaaacaggaagtattcttaccctcaaggggcttacattctagaggggaaagagagaaaatacacatgtacacctgtcagatggagaaaaccaaagcagggaggaacttgggtggtcaagggaggtgtccatgagaaggggacgtgtgagtgaaactggcaggaggcagggacaggccacgtgggtatctagggaaggggagctgcagggaggcccgagcaggggggacggggaggaggaggaggagaaggaggggaagaaggagcagggggaggagggggaacaagaggcccaggcggccagaccacgagggcctctctggccactggctttgactctcagggaggtgggaagctgtggaggttttttagcagagggtgatatggggtctggggatttacttggtcattctgtgtactgtgtacctttgcgaggtttctaagtacggggtgtgataaatagccttgcagcaagtgcattcattcaggaaccttactctgcatttcctttcattggctagggatagattcctggagataaaattatactgccaaaaagctgagcaactgtaaaatgcgtgctccttgtggccaaattatttcccagattaattgattaatttcccagaaattattattattgttttttaaaccaatttacacttctagtgtggtggccttgctgacatcaaggcgtgtggttttcaactttgggtttttttgtttgttttgttttgttttgtttttaagagacagggtctcaacttgtcgcttaggttggagtgcagcggtgatatcacacagctcactgcaaccttgagctcctgggctcagtccccagtcctcctgcctctgcctcccaagaagctaggactacaagtttgcaccactgcacctggctaattttttcatttttttgtagagacaaggtctcctatgttgccccggctggtcttgaactcctgggctcaagcgatcctcccaccttggcctcccaaagtgctaggattaaaggcatgagctacttcacccagcctaactttgttttttaactttgctaatttaatagctgggaaggtgatcttatttctttgattacaagtgagattgaacattcttgtgaattggttatttgtatttcatgttttatgatttttttgtcttttgcctatttattgagagtttagtatttttcaattgtcttttcaattgagatgaactctttaaaccattggaaataacaaatgaaagtgcattttttaaaatatcaaagatttatgagccgattcctttacttttttattttatttattcatttttttagagagggtcttgctttgttgcccaggatggattcacagctcactgcagcctctgccttggctcaagcaatcctcccacttaagcctgagtagctgggactacaggcactaccatgcctgtttaatttttgtatttttgtagagatggggttttgtcatgttgcccaggctggtcttgaacacctgggttcaagcaatccacctgtcttggcctcccaaagtgttgggagtacaggctcgagccactgtgccaggtctatgagttgattcttgatgagtagtactacctccccacaatgtggactgcaaaatgctggctggctgtgttgcttggtagcaaaaggggttgcatgctgctcagctctctgtttctctccaacccaagcatttggatgtgggactgtgccccgcctggtgtctggggctctgggaggggcatttttacttccctgtttacaagaagggttacatcctattccaagtccaaagtggacacttgttcctttgctcagcatcccatgcagactcagcaggttacccgctcccctgggaggtggctgtggccaagcactgctccatggactacacccggctggtcatggaacagcatacagttttgccctcacttttgggaaaggggctaagatgttagagtataccatccttaatggaaatccactcttgtttcaggggtttgtgggatgcaaatcctagtagggtcagaactgcctagaaattgatccttctcatggttctattgggtctcccctaaaattaatgttgcaggtaggaaaaaaaaagatattctttgggtaccttactcttaactgagcgtgtcttaccatgggccggattactatctcctggtctggaagcaggtgatgagtgggtgtggaatctacatttgagtatcacttgttcaaccacaagaccatagattgctccatgtattgggctccttaaaatagggcttatttatgttgtattccctgccattaggcctggtacagaaaaaaagagaaaatctacttcatagaacttgtagattctaaaactctaaaaggtgctgcttagactaaatatattgggttatctcttagctgtgatcttgaagctattgtttgattttttaaaaaaacatctgttttaatacccaaactgatggcattgtgagattgagtcagtggatagttcaagatggcaatttacaaaactttaagtttgtgactttctcttgattccactgtttttccacgtgtgggtggctattttgagagctgtgattgcccagagagccccagctcacagaattgccagaacatttgtgattgcttagaaatcctcccctcttcatcaggctgggaacacagatcaggatttcaaatgcccccttctctgtggccttccctgatgtacccactgtctccaactaggattgattacaccctttttttgtgccccaaatagacttctcttccagcacctgtcacagtttattgcattaactttaagaaacatccaggccaggcatggtagctcatgcctgtaattccagcactttgggaggctaaggtgggaggatcgtttgaacccaggagtttgagaccagcctgggcaatatcgtaagaccctgtctctacaaaaaatgaaaaaattagccgggtgtggtggcctatctgtagtcccagctacccaggaaggtgagatgggaggatcgcttgagcccaggatttggaggctgcagtgagccatgattgcaccactgcacgctagcttgggtgacagagcgaaaaccctgtctcaaaaacaagcaaaaatcctgtttccctctagaagtagagctctggagtcttttgattcctagcgtggggcatggagtgctgtgggtgctgagggagtgttaattctgtccccgctgaggccctttctgatgtgtgctgctgctgtttctgtagaaatcgtggatgggaatgtgaagatgaccctgggcatgatctggaccatcatcctgcgctttgccatccaggacatctccgtggaaggtgggtttctgctttgttccatcccgccatcaccatctcgtctccctccctgggcttagcctggagaactcccatacccagggcaacggacgttgatcaggggccatgtcctgggcttcttgctcatttattgggcatcagccttctcctccagtcaatgtagaaaaaagaactgtttgccattctgattctcataggcatgttggcctcagggaaactccccactttgggaaagcccaaggctgccatggggaagtatattggaaaacccacctggctcttgggttgttaatctgaaagggtggggaaatagcggctgggaggaaggaccaggaggggcgctaaccccgtcctccactttgctcccctagcaccctctagtggccatttcacagatctgcaagggccgccatggtctggagaggtgatctctacgcttgattccacactcgggcagtttttgagctttatgtctgctatgcctgtatttatcttgcataataatatttgtgtattgttgtgcctgtgataaaacacacatactgaaacaaacttttacaagatgagatggagatactattttttaaatatttgttttaatggcatagacatcataaacatttttaatcaaaggaatttcttaatgaaaacaacgtggattcaattcaattgctttgtgatggagatctaggtgtgacactctgtgatgcagcaatgtagagttccaagttcggtttatgggtacttggtatttagggttgaagtggttggaaagagggtcatagtagtcacctggggtgtggttcttgttaatgatagtggatgtaaatccatttctcaaatagccttcttgatgattttgattcttttgggtggacttcttgtcagctctgcagtcatcattgtgttactcttgtgatttagctgacgaagagcttaagctaagtagaagcattagcttttccaatttttaaattgtctgcttttgcttaggtggttatggtctttgtaggaacccttgaatgtcattttaaagtccattttgtgtgttgaaaataaatgagatcattcatgaacacagtccactgagtaccttaacctccaattcacaggcacaaacacagggtgtattagtccgttttcacgctgctggtaaggacatacccgagactgggtaatttataaataaaaagaggtttaatggactcacagttccacatggctggggaggcctcacagtcattgcagaagagcaagggagagcaaagggacctcttacatggcagcaggcagagaatgagagccaagtgaaaggggtttccccttagaaaaccatcagacctcgtgagacttattcactaccacgagaacagtatgggggaaaccacgcccacgactcaatcatctcccaccggctctctcccacaacacgtgggaattatgggagctacaattcaagatgagatttgggcggggacacagcacaagcctaacgggggtagtgtggtttgcagtctttcttctgtgctgggagctccgtgagccccctcagttgcctgcctaacctcatagacacgtggctgcttcacacacagagggcagcagtattgatccgtgcagtaaatataaggaaaccttattttttagattaaaaacaaaatctgtctaggagtcctaatgcttccttctcactcagctgtgtgcacccctcaggctgtgggattcccctgtctggagacccctagatgtgtagatttcccagatcaaatcttcctccccaacctgatagaggttgccgacttattttgtatcattaccatttctttgaataaaagagagtagggggagctaattcttgaagtttgaaaaactgttgtctcaaaatttgcacgtgtaacatgactagctctgaacagcttcccagcttgctttttctgtttctcaaataacttctcaaactctgtcaagggaatagacttgatggccagggctcctccttcagtagctgcagggttggcatcaaggggtcacagtggggcctcctgtgagccggcatcccttcctccaccgagtcagccctctgacctcgctgcccgtccccttccccatagagacttcagccaaggaagggctgctcctgtggtgtcagagaaagacagccccttacaaaaatgtcaacatccagaacttccacataaggtgagtgctgggggctgaggggctctcacagaaccaggctgcctcccccgggagctcccagacccccttggctgggtcagtctcagctttagaacaaagtggagacctctgggggaagaagtagctttccttgggaaggggatgtcgccatcgctctgaatccccccgtctctctccctgcagtgtcttagatggggctgctgcctgatataactttggttgatgcttttgctactgggagcgcccccaaggaaattgtccaggaagtcccagcccagggctctggaacagcagactagggccataggccttggtcgggggtagggctggatatggcaggtttatctgaacttgtcaacccccccacaaagtcttgaccctagtgcctgggatttgtggcaggaagaaatgtcccttcccatcctgtcttctaactcctaccccagaaagctctatgtgttcatctctctggagtctaggaggcccctgctttgccctggttgcccgtttgttcagcctcatttaccagcctgctccttcttctctctccccgggcagctggaaggatggcctcggcttctgtgctttgatccaccgacaccggcccgagctgattgactacgggaagctgcggaaggtatgtgtgcccacctgaccacccgctttgggtccctggcaggtggggtgggaaaagagcaggactaggacccttgttgtgacagtccatggtccagcctgagcagtgttggcctcttagaatagccagacagagccccaactgaaagtgaagagaaaacaccttccctgttagggcaacttcattacccttgtgcgtggtgtgtgtgtacttgcacacatacacagcccatcaggaaaatatcacagctgtgacagcagctttgtcagagggatggaatgatacatggtgtttctcccttctgtttttccgggatttgtaaagaggagacaatattttcatcattgaaaacagtgcatattctaagggacagttcatccccgccttgtcctttgacctgctgtgcggtcctgggcagcttatcccacccatggatttggtttcctttattgctcaagtttggctgggggattttcttttggtttcactcccgccttcagcatgaagctgcagtgatttttcttgagtgggtgtgtggagtggggacagatgcaggagtgggagctgtgtttctagcctcatggtggttctcaatgtctgagctggttggacgacactgccctggaccttggagaaacctgtcctggaccctctgaccacactctccaggttccctcctggaccctctgaccacactctccaggttccctcttggtccatcttggtgccaagaggccacatggcatggccatccaaggaaagacccttcccacgccccaagttggtgacctggagttggggttggaatgtcgcctatctgtgctcagatctcttggcaagggaggcttcaaggagcggctggacttgtgtgtctctacttcaccttgatgctggagaacacagtgttcagtgtagctcttgccttgcctgggcctccaggaagggcgtcttgcttctcagtggccaggagaggtttaatatcactggggcaggagctgctgtgcaactcatggtggtggcaggccctttgtttcgggcgggtggatagcaagctgccaaaaaggatcttgagggaggaaaggagcagatgcctacccgcttccctgcaccgtgccccgccccacccccaccccatacacactgccccgtcacctgaagcttgaggctgaggcctctgcccactggaagggcccatctgctgaaggagaggagccacagcaggggccagcccttcgccagctaacctcctgggggaagaggatccttggcccacctcctcagctgctttgcaaggaaaaaaaaaaaaagagaaccttcctgtcctgctggaaagttgtgtggccaaatcaaacgtggccaagggggaatattctacaggtggcagttttttcttttgaaggcatcaccacttcctattcagctgatgggctttggtgacaggtgtgcacctatctctgtccctgcttgggtatgctggggtgtcagtggccagttcatccacagctgttggacatccccactaaaggggtctgtgccgaccgtggctctagagccccctcccttattctgaaggatttggaagcatcagccatttgggaggtgaaagtccaggggttctttctgatacccagttagcactctcccacgcactatccctctctgtctttttatttatctctgccagtttctccctgttttgctgtctctgcctctccttctgtgtttttttgtttttgtttttgttttgttttttgagacagagtttcactattgttgcccaggctggagtgcaatggcgtgatctccactcactgcaacctccgcctcctgggttcaggcaattctcctgcctcagcctcctcagtagctgggattacaggcgcacgccagcacgcctggctaatttttgtatttttagtggagacgggatttcaccatgttggtcaggctggtcttgaactgctgacctcaggtgatccacccgccttggcctcccaaagtgctgggattacaggcgtgacccaccatgcccagctttttttttttttttttttttttaagagagtcttgctgtgtcgcccaggctggagtgcagtggcgtgatcttggctcactgcaacctccgcctcccaggttcaagcgattctcctgcctcagcctcctgagtagctgggattacaggcacccaggctaatttttgtatttttagtagagacaggatttcaccatgttggccaggctggtctcgaactcctgacctcaggtgattcgctcaccttggcctcccaaagtgctgggattacaggcatgagccaccgcgcccagccccccttctgttttttaattgtaatttttttgtagagatgaagtctcactatattgccgaggctggtctcgaacttctggcctcaatgtgaccctcctgcctcagcctcccaagtagctgggattacaggaacagccaccacacctggcttccactccttttaattcagtatcatcatcagtaaaatccagcccaaatcctagcacacacctgagcccagtgaaccaggaacacccttccagagaacaaggaggttgtgagaccaactggtgccgaagaatagggacagagggctgaggggctccgactgggaagctcttccttcctgcagcagccatgggtgggcatggggccctggggtccctgggactcacgtggggcgggtgtgtgtatacctggacctgagcactggcagctgctgctccaggccctggatgagaatgaccttgactactcggcagtgttcatcctcctggctgctgttggagactttcccagagggaccccaccttctctgtttagagcaatttcctcctgaaaacatcctggatgatgtatttatctttgtgttaccctatacttctccctttagcaaacagggaaactgagtcctgggccgacacaaccagcttgctttaggttagtctggggaaccaagaatagaggagaagggcccagccagaaactcttccactaaggttttttatcctctgcattaaaaacttatacaataactggtacaatatacaaaacaaaatttaccactttaaccatttttaaatacacttactgttcaggggtattccgtacactcacattattgtacaactgttcctaccatccatcttcagaactcttttcttgcaaaactgaaagtctgtacccattaaacggtagttccccgttctttcctgcccccccggcctctggctgctaccattctgctttctgtctgggaacctcataacagtgaagccatatggtgtttgctgtttttttttttttttttgagacgaggtcttgctctgttgcccaggctggagtgcagcagcgcgatcttggctcattgcaacctctgcctcccgggttcaagcaattctcctgtcccagcctcccgagtagctgggacgtgccaccacacccagctaatttttgtatttttagcagacacggggtgtcaccacgttggtcacgctagtcatgaactcctgacctcaaacaatccatctgcctcggcctcccaaagtactgggattacacacgtgagccactgcacccggcctgtgtccttttgtgtctggcttatttcactgagcataacattctaagagttcatccatgttgcagcatgtgtcagaaattccctcttgttgaggctgaataatattccattgtatgtatcaccacgttttgctcatccgttcatccatcaatgggtacttgggttgcttccacctcttggctactgtgaataatgctgctatgaacaatggaggtataaagatctctttgagaacctgctttcaattcttttgagtatctccccgcaagtggaattgtaggaccatgtaataccatgttgaattttttgaggaaccaccatcctattctcacagcatttgacattccacctacgtttatgttgcattcatcgcacaaggattacagcttctcaacatccttgccaagccccgctaagtgttcttgcgaaggtagcagaagccagaatagtccaaagctgtggctatttaaaggagcccccaaatttcatgaaatgtgagcaccagaggggctcctgctccgaatcttgactagtctagagtttagagctccctaccccaactcttgagttatggatggagaagctgaggtcaggttagctacccacgagtcccactggttgagggcagagctgaaaccagaagccaggatggatggtgactaggccagtgccctgcccttggcacacgtttcttaggaactccttcctacccccgactcaggctgcagactacttcgccccattttcctgacaatctgaagcttgaagggggaaagagaatgctttaaacctccaaccagtgagccccagtggtgagaccagccttccacatctggagctgtcccctgaggatcgagctggggctgggagaaagtcgctctgctccccagtttgggtggccacccaattgggagtagccagtgacttgtggtggctctcactttatcatcccttcctccttttctccctctaggatgatccactcacaaatctgaatacggcttttgacgtggcagagaagtacctggacatccccaagatgctggatgccgaaggtgaaaggcgctttccttctgtgtctcttgcccatcgcccacctgccactcagcggctaagaaggggtggaccccagcagtccggggctggacgggaggaggcctggtcttctgggaccgcatttgaggagcatggggatcacagcctcttggggattcttccatcgttctttgagctttggagagagaggtgttagttgattctgcaaaggtcttaggggctgttcttgcatcgactgcctgaggatggttcttgtctttgccttggagtcaggatagcgggtgctggggtgtggggaaatgtgcccttgttgtccggcacagtttgggatgggaagtttcccttgctgagaggtgcactgtcctcaccctctgagccctgggtggtctctggacagctgagcttagcatctcctctatgccccagctctgactggggctggctgggcatggtgtttttctcatctgtaaccctggcttccttctagcatcttctgaggagggtgctagagaactatggcttggactttctcagtggtggaagtgtccagttctgatctgtctgggaagatcccagccagaggcagtggctccatgttgggtagggaaggaaggagggggcccaagttgagtgttgacttttctgttcctcaccaaggccttgctgtcccagatgctgctagccaggatgcctggatggggacaggttcagggttcgacactagaacatccttaccaaagattgggcctggggctggaaacccagctcttcctggctgctgaccttaccattgcccctctccctgtgtagagcgtctcggatggggtgagcaggggctgtggggggaagggaagcatctgggagcataggggtctgtgggcttatgaagccagggctggcagctccaggctggggtcaggctgggtcttgtcccacctccgcgcttgccccttgggaggagcctgactcaccacagccccttccctgtgtgctctccttggccccaactgctcagtgctgaagggctagaaaggggttatggagacaggaaaagaccacggtggggtccagactgttccctgcccctctgccccaccagtggcttttttttttttttgagacggggtctccctgtgtcacccaggctggagtgctgtggtgcgatctccgctcactgcaacctccgcctcctgggttcaagcgattctcttgcctcagcctcccaagtagctgggattacaggcacccaccaccggctaatttttatatttttagtagagacggggtttcaccaagttggcaaggctggtctcgaactcctggcctcaagtgatccacctgccttggcctcccaaagccaccagtagcttttaaaatttcaaaatgtcatgaggaaaattttcaaacgcataaaaacccaggcaaaagcagaaagaatagcacgatgacctttcctatttccatcatccagatagaatggctactgaggtcttgccacactttgtgtttttcttgttttctttgttgaagtatcttaaagcaattctgagatatcacatcattttaccactgcatacttccgaatacatccttaaaaatagagttattttcttagtcaatgataaagttatcacatttagcaaattgataattccatgtgatacccagttcataatgaaatttccctaattacctatgacatttctttgagggttggtttgttttaatcagaatccaaacaaggtccatactggcattcggttgtgtttctgacagcttttcccatctctagtacttctctcctccctttgaccccttttattcctgccaatgaacttgctgcagaaatggggccgctgtcctgtagcaagttccttatactgggtttgtccgcctcctttggggcttcatttcacctgttcctctacttacattcccataagcgcaagttgacgccagaggctggttagattcgggctccacattttggcaagaagacttggtggtgctgcgagcttctttctgcctcacgtcgggggtgtatggtgttcttggaaccagctggctttaactccagatttttcttgacagacatcgttggaactgcccgaccggatgagaaagccatcatgacttacgtgtctagcttctaccacgccttctctggagcccagaaggtacccggggccccctgctccttccatgcccagcacacctcctgctggaccccaaaccatgtcctcctgcccgcctccacctctcctggtgacaggtatctggatggtctggtctctcggacagaggcagtccctagttctgaagtggcgtgttgttcttacctggctcccgtcccaccccacacctctctctctcatcttctactgttaacaagaaaattgggcagcagctcactttctgggacccagatgactggcttaagcaggaagggctgtgtgcatgaggcagccggggtggttctggaaggctactgaaaggtgaacaggagcagcccttccatgcccacgtctgttgaagccactggctcgatagagcagctggagctcccttagaagggcaatgctgggagacacctccagtcttcacttacccacttggcaaaggcatcataaagccccacctttgtcctgctcatgggcatgacttagcagatctgtcctcagccccttgggctctagtgccttctcctgtatcctgcctgggactcccatgcggccatgctgcactctgtgttctcagacataagcagaacctctgggaggaagggagaggcggtgggcagctgtgagccccgtcaagtgtcctggcccagttttgctccgggaggcctgagattaaagttcagtcgtgcaggttctgcaccacacaggggttccacgactaaagggcactgtccatgctgtggacattgaagatttgaacattttcatcaccaggcttaggcagcatacacccctcccccagacctccctggtaggcaggactccagaagaagcacaacatcaccatgaccacagaatcttcacgtctcatgcagatctcctgccctccacatggcatctgagtgaccgttttaaaatgcatgatgaggccgggctggtggctcacgcctgtaatcccagcactttgggaggccaaggcaggcggatcacttgaggccaggagttcgagaccagcctggccaacatggtgaaaccccgtctctactaaaaatacaaaaattagccgggtgtgatagcaccctcctgtaatcccagctattcaggaggctgagaccagagaatcgcttgaacccgagaggtggaggttgcagtgagccaagattgtgccactgcactccagcctgggtgacagagtcagactctgtctcaaaaaaaaaaaaaaaacaaaacaaaaacaaaacaaaacaaaaaaaaaacaaaaaaaaaccataaaacaaaaaaaaaatgcatgatgggagcccctgccctctcccacctctcctatgccgtccctgcctcagactctgctcacctcccacccactccctcccctgctgtttcattttttctctttctgctcattccctccttttctgtctgtccgtctgtcttgtgtcctctttctgtccaccatggctgtttgggtttattctgtgctgctgccgctgcctactttctcctctcaacctcttctccttctctgtgcagatgtgtaggcacgctaaggccggatgggaaggccgtgtgacctaatgtttcatgtcacggccacgccttctcgggtgtgcagaaggtgagctctccctcggcctcctccactctcccctcttgcccatctcttccgtcctccctggacactccagcagcaggccctgggatggaaggagggactagagaagcccctccttctcctgcaggggaacaggactctgaactttggccaggacacttgaagatgccagagaaccccagcctctgaatgacctcctgtgtctctgtccctatgccctgggcatagcggataccacaagcgagagagaagcttgtggtctcagcttcttccctgcaccccgcatcaagagcccttatcccaggcagcacagctcttggcagtgctttctatttccttaaacatccaggacctcttccctctctctctctccctccttcctgcttgagcaaggccaccctcgcaaatttagccagcagccagagcagggagaactcttcctgccttctccagggagtccagaccagagccctgcctgatgcttctcaaccaggctgccatggacagttgtgcaggttgcagactactcacaagtgccacgtgtgtgcagtggacaatggagatttgaatattgattactaaagtgatcctgcagatggcagtgaaaatgtcttctaacaaaatcagtaggacattttcccagtagaagtgcccttggggaagaggtaaaaaatgatccagagacaccatatgggctggcagcagccctgttccctgcctggttgggcacccaagaccctccggaacttccttccagggctcattggtgcgggccagagacaggagaccagccccgtctggaggctgtttctcataggtatcccccgagcctgcccagcccctctcagcccctcctctggccttccttctgcttcctctttgtccttcccacatctcctgctgctgttcctgtgcccctcccctggcccctcgcagccagggtgtgaacagcttctctcccttgccttggttggcctcctggcccaatagccacgggtgtgcacctgcccgtgtccgtggtcaggctgagctctctgctatggtcttttcccctcttcccaaagctccttccttctcttccagtctctccccttctccttcaggggtctgtcccgggcttcatgcccattggtgctggccttccctgtctctgaagccttctctgtgtcctggctggtgacaaagcttggaagggaatgtgagatgcgtgtgggtgtagtgggtatgaagtgggtgtgtggtatgtatgggtatggggggttctgaggagtgtgtggtttgaggtatgtatggtgtgtgggggatgtgatgggtgagatatggggtgtgtgtgaggtgtgtgtgtatggtatggatgtggtgggtgtgaggtgtgtatggggagtgtggtgtgtgtatgtggagtgtggtgtgtaaggtgtgtgtctggggggtgtggggaatgtggtgtggaagggtgtagtgtgtgaggtgtgtgtatgaggtgtatggggtgtggggactggtgtgtgtggtgtgtaggaggtgtgaggggtgaggtgcgctgtgggtgtggtgtgctgtgggtgtgaggtgtgtttgtggtgtgaggtgtggcatgtgggtgtgtgtgtgaaggggagtgctgtgtgtgtggggtgtggtgtgtggtgtggaggggtatagtgtgctgtgggtgtgaggtgtagggtgtgaggtgtgtgtgtggtgtgaggtgtagggtgaggtgtgggtgtggtgtggttgtggtgtggaggggtatggtgtgctgtgggtgtgaggtgtgtgtgtggtgtgtgaggtgtgtgtggtgtgaggtgtggcatgtgtgtgtgtgtggtgtgctgtgggtgtgaggtgtagggtgtgtgtggtgtgaggtgtggcgtgtgtggtgtgtgtgtgtggagtgaaggggagtgctgtgggtgtggcatgtgtgaggggtgtgtggggtgtgtggagtgtgtgggatgtggatggcgtgtgggtgacagcctgctccccctcccaaatctcatgccacctccccatgcccccttccctttcactcatccctgttgcaaccatttcacgctgcttttgtccacacctgagggcaaggtcacagctgggttggtggtagtggtggtcgtcctctcatgtcctggtcaggggtctgacccagagttgcccccaccacttctaaggtgactgctttgagctgagcaggcaggggaggggaaccctacctcgccttgtgtggtggggctgatggaggagaaggactcttgctgactcacacactcctgtcttgtctgtctccgggctggcaccgatgaggaaagtcttccaaaacccgtgcccagtgccctccatcctctccactgtctttctgtcgcccaaccttgtatggtggaatgaaaaggcaacagcgcctaatgtgtgtgtgcacgtgtggtgcacagctcgtgtgcctgtacaggcacgtgctgtataataagtctgtgtactgatttccctcattagatgaggaccaactgctgtttgacaggtgggttttggttctaattctttctctgcttccctctcccctcctcttcccttacagggacttagaatggatggagagcattaagattttgtttatgtagcttgtgttttagagttcatggtctgctgtttctgagaaagaacacttgaaggcttggactcgatctgagagaaattcatgagccatctgggaaaacctaaaaaaaggagccggcagtggctgcggtctgaccagtgccctgctctgccccagatctgagcagggcaggtgcagtcacaagactgccggccaccaaggttttcttgagcagcagaaacttgaacatgaggtctgtggggggaaggcttagcaaggccttgggaaggggcagacagtgttgtggagggaggtgaccacagcttgtgcaagaagcttcggggtatgcaggcggagcctgcagtaggagaggaagctggcaaggtgtgggctgcctgaggaaaggggccagtttccctctgcctggtcacccaccctggcccactcaccgtgaggaagctcggatgcctggtctgagatctctgctgatctggggctctcttagtaggaaccctgggcttggtggctgactccggacagagggaaagactgggcagtggacagctgtgggaagaagaaaaaagcaggtccagctagatttgggaacattttggctacagatgacatagatgagatcctcgtggcattcatgtgaatctgtgggttgtgggtggtggagccacagcacatcatctggccacgtttgggtgttttgatgtcaccttgaggacagttcctctctagactgtgcctgtatcaggcaattggatgctgattattagggtagcagtttggcttgggatagctaagtactccagggataataatagttcatatcttttaaaaaataactccagggataataatagttcatatcttttaaaaaataactcttgaatatacaacaaagtgtatatgttaagttgtataatagcgcagcttaaagtaggtcataaaaaaacatgaaaattcaggttgggcgcagaggctcacacctgtaatcccagcactttgggagttgaggctggtggatcacctgaggtcaggaatttgagaccagcttggccaacaccgtgaaatcccatctctactgaaaatacagaaattagccagacatagtggcgcatgcacctgtaatcccagctactcgggaggctgaggcaggaggatggcttgaaccttggaggcagaggttgcagtgagccgagattgtgccatcgcactccagcctgggtgacagagcaagattctgtctcaaaaaacaaaaaaacaaacaaaacaaccatgaaaatacaaactaagggaaaggaaacacagatttctagtagtcttctcctttggcacttggaagcaacattttgctcatttccagagaatattttctgaagccatcaattatctgttacatctgttacattatctcatgaagccatcaattatctgtgcatctgttacattatctcatgtcagggcacctggttcttcttgctggggccagagcagcccatctcctcttcaggaatagcctgaagccaggtctctcccggggttctcttctgaagttgcttctgaagctgcttcagttcctgaggttctcagggaaggaatctttcctcccctagaacacatctctcctttgaacttctggactaaagggttgtctttgagattctttatgtacttggtggttctgggtgcctctctcctagatccctcagagttcatggggttcttgtagctgtgagaggaaaaagctagaaaaccaggagtttgcggtgatggggaaggcctgtcacccccagcggcctttccttctgctcccgggatcgtgtcccgtgggcctaagcctggccttcccagctgacctcatcttacttctcaggctgaggctggtgggtgatgaagccgccttcatcaagggaccacgtggaagcaggtccaactcaccacccagtgggcttctctgtggtgcatcctgcctgtagggggagtcaggctgcgagagaaagggagaggatgaggttctgaggattctgccgtagtttttttagaaaaatcaaatctggacttcaggaacctgcttcctgaaggtaatgtaggagctgggctgtctctcaagggaacccggtggagtctgcagcctggcctgccatacagaaagcactcttgtgtctcccgtggtacttgtgtgttatttctgaaggctggttcactggttataatggatggtattctcagtcagtctccttctggagaggccatcctgggagcaggtggctgagactctggcttgggaatgcggttggatctttgtggaaagtccccaggaggcccacccggaatctcccccagacttcatccagaagggagcccttttgaccctgactctggagtagtcagcaggctcttggggatgggcgaggctcttgaggtcccataggacacatgtaaaatcccacaaatgcagaccttagtccaccagtttgataaattggcacacatcagattttatgaccatcgagccgatggatcaggagagtaacaaggtgaaggtggctttatccatgaaaatcacagccgcagttgcttcgtgccagttatgagtagctgccaaggggtttcagctgtttgagtggcacatctctggcatagtcttccggggtggcacatcctcacaaaaacatcagcctggaggaggacacgcgggtctctctgcagccccctgccccagccttgaagggaagtagtctggggcttccggcaagctgctccccagtcagtcccatgaggctgctggcctggttcccatggccccacttgctttctggggctccaggtctcctagacaggctccaggaaaagcatttccctcttcgttgcttcttgggattccccgtgggtgcttgttggttctcgagagagatggcgatcagtcaggagttgtgggtgagaagcagtcatggcatctccaggacagggttgagttggggtcagggggtgagggcctaaggatgtgactccctgtctcagtttcttgaggcccaggactcaaagtccccacctcaggggactcttagaccaccctctggccattcccaccttctccttattggttctcccaacccattctgacaccttgctctgcaggtcatgcctcccttgacctccttgactgtgtttctgacaaggcctttaggatgatctcattctgccccttaccccctgccccacacaccccagcatagtcatccatccacaaagcacatgatttggtgggcggattcgagaagttcttcaaggaaaaaacatttccgtcttccatcttagtcattccttccaattctaagcacgttcattctcaggaagctcttccttacaaccagcctcagttcatcttgctgcagttgaaacctgttttgtcttgttcatcaaccagttgtgaggtcctgtctttcaacctgttaatccagggatcatttttcatctgcagggcacccttctccagggtctcaggatgcatgtctgtcttctcacagatatcatcttctcccacccccaggctgtcttcctttctaccctctggcccccaaaaggctttgagttcacttcccccttggtgtagggttggaatgtatgcaagaacacagctggattttaaaaccacctatttgaagtggactcaggaatgctgggtccctgctggtgttaggggtacagtagcccccacagctgcagaaggcgctctcccactaaggtttcttagtctttgcctgggattgccattcagtcccctttccttccctttgctgctgaggccatcttgggtccctgctagcccagcacgcagcgcatgatgtgtgcttagctgtctggaagaggcctgtgctgggtttgctgggcattgagcccatacttggttgatccggaagtctggacttgggtgcagtagaatgtccgtcagttttctctaaagtgcttcaggctttgggccaagagccttgggagattctgcagggatcccaagaggtcccatgatttctcagtcagcactttatcccaggactcccggatttgaattcccacatctccaagaccctggaaaatccagccagaggtcctaagccttgcagttccagtgcctccacttggaattccaggatgggcatgaattttctcacctctccacctgacctgagtattttgattatatcagtcattggattagtttcttcccaacctgcaggttgggccttaaactcaggctgttctccaggggcccagttcagccaccaagacctctgtccaggctcacttgacccatgggacctggccatgggctggcaaggaggatggtaaggagagaggaggaatgtgacctcacagccttcttaactcccttccaaccacagggagctgcagggatgggaggggctttgtcagcacaggtgtgtaccaggtgcccctgctgctggggctggctggtcgtgactctctctgtcttgttgccaggcggagacagcagccaatcgcatctgcaaggtgttggccgtcaaccaggagaacgagcagcttatggaagactacgagaagctggccagtgatgtgggtacccccgggttcacctggcctgactctagcaagagtcagtcccctagaacgtgtacctccaagtctttccttggagcatagtctcaggcttgtatagtctctgatcccaatactgctagtccagggcagcctgagctctgttgtggctctcccagaaagtagtgaggtgggggcagaggccagtccctgagttatcatgagcctaggatatccctttgcctctcagagtcttcttgtttttttcacttgtcaagtgagagttgagccaggggatgtcaaagcctttccagcctagtgtactcttagtctgtgagttttgcttcagtgagaaaaggagcacatctggttctaagagggtgagggtagggttttcggtaaattagtgccggctcaggctagcataacagctaccaaaagtagcggctgtcccctactgttcagggaacaggatggcacagtgctgggtttcctgttctgccattggctacatttaggttaagcctcctcttcttgaaagaattcagcccgttgagctgctcagcccagcctcttggtggatctgctgcccagcatagtaagaacgcaggttctggagcccaagtgcctgggtttaaatttctgccattccagccaggtcaccttggcaagttacaggacctggtagggcctcggttgtctcctctgtaacatgcaggtgatcacagcccttagctttgtagtgtttctgtggtgattcagatgagtccatgtgtgtgatgtgcctggccccctgcaggtgttcagtgtattcctattgtcatgtgcacccctccaccttctccaccaccatcaccttggcccaaggaaaacagtccaggccgtgcctgcttgtgctccaggccagctctctgcccagaagccagcctcttcccttttaagtcagagacccacattctagattcttaggaagtcagatggcaagaacttctggaaatagctgttaaccccctccatggtatagatgaggaaactgaggcccagccagttagaacctggtactaaaacccaggcttccttcctgccttttagttgcactaacttcacaccaggtctatgggtcttcccttagcaaagcagggaggttgagtgacgtgactgtgagtcgatgtaccctagtagccaggcttcacgaagcctgtggttctcagagggaacaccctggaagctgacttcatggcctgggaatgtcagtggttgggaaggagtgtgctattaggagagaccccttccccatgtgggagggctgttgggaggaaagggaggctggccctagcacactccctccccgcctcctcacctcctgcccccaccgccttcccaccctagctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggtgagcactgggggtgagcctgggcccccagactggactgcctccacctctgagctgctcctagttgtggtcaaattcagctttatgggggtgcggatgggcgtgtttgcttctacctacatacactgctccagaagtcacttcccccttccagttaccacccaggctcaatcccaaactcggccatgtggggcagccccctctgcccagaccattctgggtcaggcttgcccttccagacccctgagcatctactccagacctccctctcacaaaaaatcatccctatgaacacaatgcttttgacaccctgaaccaaacagggcataattgaatcgcagtcaagttgatttctacttccatggaatcttaagtagttaaaaaatattattattgaagtaatagttttgtgggtttttttgggtagtatatttcaaagatacaaataagcaaaatacagaacatggaaattactgaaaatcttactacccagtatcaactttaaaaaaaatgattttaatccttttggttttttcgtgtaaatatttgagggaatcctaaagtgtatgtatttgaaattgaacattttttcccggtttctgtactcaagtgtcccctgacagataactaaagcctgttttatataataagctgctttaggaaaacccccaatctcacattatattctgaccagctttccatgtcataaaatactcttcttttaggttatttttgttattcatccttcttgaccctgtccccacaacttagggaaaaatttcataagccagagaaacacacagaagaaaatgtaagaaatttgccatgacgcagctttttgtccttaagtgaaacaagtaacaggagtgtcacgggcacatgacaggtctagaaggggagggtgaaaggcagacagcatcgtggggagacggcagcccagggggtcatggagggagaatacattgcaagtgggtatgcagtttggaaaattgcagtcatttcggggctccaaggctgaatcagtagcttttaggtggccagagccactgctagcctaagggtgctctatgagaattagacaaagtaccctttctgggggacagatgtagcttggcctggggacatgtggggagggtggcttgcagggtgcagccccagtgactgtccagctgggcactgttgcacaaactggaggcatggccctgtctgaaggggcgtgtgggtttgcactcagcatctgtcctcccagaattctggccggctcacccaggccggggtctctgtaggctccaggttattgcccagaggcctgagtccatgaatggatccaggacagtggggaggctgggcagctccagtgcctgcttgcctcattgcacattgttggtctgtttacctcgggggccctttgccttagcacatgtgtgacctctgtgatcggttagagtcctgcgggaaaccagtcctagtcagggagagtctggggccctttccccacagggctctgttctcaaagtcccatagctgggtgaccaatgtagatgcaggtcccatgccttgcccaggaggcctggctcctgggagcccagaaaataccagtgggagatgggaggtatggtggggcagcctggctagggtggatatggggcagagatagggaagaggctcttcctggaaggcatggggcaccttcaggggtctagggggctaggggacctgaagcctaggcccaagccagaccctgaccctgtacctcccatccccacaggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggtgaggccagcccagcctcctgcctccccccagggcttcacttccctactcttcagcccagccagcagccactatgctattctttgcttttcatttgtttcatttggtctcttactagttccatggctttaggcaagttcattagccttctggtcgcctcagcttcctcatctgtaaagtgggaataataatagtaccaacctcacaggcttgtaagaattgaatcagttaatacataacgaagttctgaggagagttcctgcatagtgcagtgctgtgtgagtgttcactttgcagtcaaatcctctaccccgagtgttcactttgttttttagttttatgggggtttttttttgagatggaattgtgttcttgttgccaggatcgaatgcaatggtgaaatctcagctcactgcaacctccacttcgtgggttcaagtgattctcctgccctagcctccctagtagctgggactacaggtgcctgccaccattcccagctgatttttgtatttttagtttcaccatgttggtcgggctggttttgaactcctgatctcaggtgatccatctgcttctgcctcctgaagtgttgggattacaggcgtgagccactgtgcccagccgtataatgtcatcttaaggaattatgtctgcaaagagcctgtttccaaataaggttctatcttgaggttctgggttgacatgagttttatgggggaccccattcaacctaattcagtctcctcatgggttgttgtgaggcttaaatattatagtacattgcatgcttgtggttttcatctcttcagctctttttcctctatttcctggcctccaattacagtgaaccagcctttgccttagcacatgtgtgtccctgttgctccaaccttgaggctcttgggggcgtgtctggtgtctgcttattggcagctaaggtgaactctgaagagagaggatcatacctaggatagtattttccccagaacctggaccagggctggaggtggggaacaggctgcctatctgctggggcccctccggccatttcagctggagcgtgggacagacctattggccggcggagctcaatgccctaagactcccccagtcagccctgttttgtactcctcagatcttaggttggagatgagaaggaagaaccataccccaaggccatttgggagtggcttggcttggtgtagggcagcggtccccagccttgttggtaccggggaccagtttcgtggaagacagtttttccatgcagtggggaggaggcagatgctttcaggatgactgttctacttcagatcatcaggcattagattctcataaggagcacacaacctagatccctcgcatgcgcagttcacaataggatttgagctcctgtgagaatccagtgccgcccctgacacaacaggaggcggagctcaggtggtaatgctctcccacctgctggctcacctcctgctatttagcccagttcctaacaggccacggaccagtaccagtctatggcccagggggtggggacccctggtgtaggggatgggagtgtgcttgactggctaaggggggttggctctagttcccctttgtaagtacaaatgctgggctttgcacacaatggtaagaggttgctgcccccacatccactgtgcgtgtatggagttatttatccagacgtgacgggcagagtggaggaggcacagtggggattgcactgattcatcacatgcttctgtcgggtccagctcacagccaaggtacaaagcaaagattgacctcgttgccttgccagccaccagcaggggcatgagaagtgctggcatgctggcacagcctctggggaaagcagtttggccacatgtattcagttctaccaattttactacactctgacctgggaattccatttcttgagactgtctaaagaatctatcctgggcgtgaggagtggcagcggccaggcagcacagtttcgcaaaggctgtcagcatgccgcggcccgcagacacctggcacgcgccctccctgccgccaggatgcccaaggggaaggtcagctctgctgaaggagccgccaaggaaaagcccaagaggagatcggcgcggttgtcagttaaacctcctgcaaaagtggaagcgaagccgaaaaacgcagcagtgaaggataaatcttcagacaaaaaagtgcaaacaaaagggaaaaagggagcaaagggaaaacaggccgaagtggctaactaagaaactaaagatttacctgcagaaaacggggaaatgaaaagtgaggagagtccagcctctgatgaagcaggagagaaagaagccgagtctgattaataccatataccatgtcttatcagtggtccctgtctcccttcttgtacaatccagaggaatattttttatcaactattttgtaaatgcaagctttttagtagctctagaaacatttttaagaaggagggaatcccacctcatcccattttttaagtgtaaatgcttttttttaagaggtgaaatcatttgctgattgtttattttttggtacaaccagaaaatagtgtgggatattgaattatgggaggctttgactgtctcgggtgtcagcttaacattccatagatgggggggttagtttttatatcctataatacaaagcatattaaatggcaatatggagtcagtcctgcatttaatatcttgaacattttaaattacttctgttgccatgttgttttttagtagaattgtttcctaaagaaaaccactctttgatcatggctctccctgtcagaattgtgcactctgtaacatctttggttgtggtagtcctgttttcctaataactttgtcactgtgctgtgaaagattacaaatttgaatatgtagtgtacgtgctattcagttgtgaactggtgggccgtatgtgacagctgaccaacatgtgaaaatactggtacttgatagcctcttaaggaaaatttgcttcccgattttaagctggaaagtcactggaataactttaaaaaagaattacactacatggctttttagaatttcattacgtatgttaagaattgtgtacaaattgaaacgtctgtactgatcttcaaccaataaaatctcaattattaaaatacaaaaaaaaaaatccatcctgaacatggagacatccacactagggcaagctgagggcccagcaactcacagtagggcagtgaagggttaggggagtggacgtgcagcctttctgcagacgtctacatgagaagactatggagccagggcagaaattccaataatgtgccgccaatttttttttttttttgaaacggagtctcgctctgtcaccaggctggagtgcagtggcatgatcttggctcactgcaacctctgactccctggttcaagcgattctcctgcctcagcctcccaagtagctgggattacaggcatgcgccaccacgcccagctaatttttgtatttttagtagacatggggtttcaccatgttggccaggatggtctcgatctcctgatgacctcgtgatctgcccgcctcggcctcccaaagtgctgggattacaggcgtgagccaccgtgcccggcccatgtgctgctaaatattttaaaagcaggaaacataatttatatatgcccaaagaatatccacataaggaaagactgaataggagtggataagtaggcttacctgtaatttttttcctaagctttatatattaccattctgttttaaagaagaaagagtagggggaaggaaagaaatgccacctggggacacaaccttggctcccagcccagccttatttattgagatgggccgagcataccagcagcagagggttgggtatgtgagtgagggaggctgggccagcccccatcctgtgcctgtcaacttcacaaggcagctggtgagcgtcgtctaacaatggccctgggaggtcatttcttgttcctgctttcctcctgtggaaacaaatttaagaaacgcaagacctgcttgtgccctgtagatagagggcagtgtgtctgagggtcagagaaggcgctagccactgtcgggttctgtgcagagtgcactggacacactgaccgagggaaggggcccctgcagggctgccggcagccagtgacggtaactggggacattctaaaggcagggtactcctgaggtgcttgggttgtttttttcctggttataccagagggtgtggatggctgtgtttcccgctgtgtgtatagcgtcatgccctatgcattcccacagactcctgcatagccttcctgcgtagacactttcatggccttggaagtgctctgaggagagtgcttttccccgttgcgccggttggtggatgttctagttgcacatctgcttttgcaccctgcagatccctgcacaatgggcacctccttgagaagcacccccagaagtggagctcctggggccctgaggggtgggcggttgggaccaaggagatgcttctcactccagctcagccatgtggccctctctcaacccaggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaagtaggtggccccagacacccctaccctgtggtgaggggctgaggctgggctttctcagctgctgggggaggtgggggtgtggccgtggaagatggggagggtgggtacaggtgggtgcccaggtggggagggagtcaacgcaggagacaaatatctctcctggtggggaaggagcccgggaccactgccatcctgttaaaggccaccagttctcgcctgtagctagtacaggagcagagggtgaccaagacttggttctgagctttctcgttgggcctcgagggctccctgccattggccattgaggtgaaggctggtgtcacctccagccatgactgggaaaggggtcttctttggtctcctctctgccagtctcctgaaagaggggaggggtggaaggagtgcctggaaggtctcttgaagggagcgcccctggctcttcccagcaccaccagccaccccactgacagcctcagagagagggagatgggccatgaaattaacctgggtcccctgacttccttgtctcttccctccccagtgagctggactattatgactcacccagtgtcaacgcccgttgccaaaagatctgtgaccagtgggacaatctgggggccctaactcagaagcgaagggaagctctggaggtgagaggtcccagagggagatctaggcccatatccggcagccctgtggtgccccttcctgcttcttgactctctttgctttgggctaaaagactctatggcttccccagacctcccccaaccctggcctaaatgtggaagattcactttggcacaggatttggactttgccctcatggcgatgcctcctctcttgccctcacatgtctcatcctcccagtttagtgtgctttacagcccaaccccagccatttgagaaccctcctattctacacaccagactctgggacccaggccaggtgactgtgatgtgagatggttcatacagctggcaggaagagcttgttctttctgcctgattgagtcagtgcttctagacctggggctcaccaggaggatcttgataggagtgggggatgattctggacatcactgtactaacccttaccctatttggcactcccagcggaccgagaaactgctggagaccattgaccagctgtacttggagtatgccaagcgggctgcacccttcaacaactggatggagggggccatggaggacctgcaggacaccttcattgtgcacaccattgaggagatccaggtgagccccacctccactccccggaggctggctcccctggggcccctggcccatgctctgtgggtcacttttgcaggactgccccctgaggaagagcatcctaaggattttatagacccagaacctttgcatttgacttattttgacaagataatatatgtgcatgatctaaaatttaaaaaaaattaaaaaggtttatgatagggtctccctctgactccttatcctccagcccctagttctctccccaaaggtaagaatttgactacagtctctgcacacaagcaaatgtttgtttccatgctttgtaccctttttgtataaaacaaaaagtaccttttattatataccatattctgaaccttgatttttatttattttatttttttagagacaaggtctcactctgtcacccaggctggagtgcagtggtgggatcatagctcactacagcctccaactcctgggcttaagcgatcctcctgctgcagcctccctagtagctgggactacaggctcacatcaccatgcctggctaattttttaatttttatttttgtggaagtggggttttttctttgttgctcaggctggtctcgaactcctggcttcaagagatcctcccatttcggccttccaaagtgctgggattacaggcatgagtcactgtgctcagccatgaaccttgatttttaatgtaacatttatttggagctcatttcacatcaattagcagcttcctcaatctttcatgcagttgcagaatactggatttaaaaggttttgccaggagctaaggaagctcatgttgtgggaggtcacctgggtagtgagcctctggagcagcccttctccctgacctgtgaggtggtgaacacaccagagaggttgctgctaatttgaccagccctaaggatgaagctgttgcttttgatgactgtggcttcaccttcctgtggccatacctgccatcctggttctcagccacaagaatctttgaattgatgcctcctggtctcccagctggtgtggaactcaacctccatggcccttccactcacttctagcgctccctttgttcctcttgcccacatattcccatctctgtccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgagttgaagggcatgggccgagccattgtaagtttcataaaggcagggatttttgtccattttaattgatttttgtcaatttcatttaaaattgtcatatagtaaacactcattgtttgtccaaatgtcaaatgactgggtttccagaacaggttgacacctttactcctgttctgttactgaccggcccttccccttctgggtcctccatttcctcatctggcacatggacagatggctgacccatcctgaaagtcgccttgttgttcctgccccaggtgcggcagctggtgcctcggagggaccaagctctgacggaggagcatgcccgacagcagcacaatgagaggctacgcaagcagtttggagcccaggccaatgtcatcgggccctggatccagaccaagatggaggtgggtcccatgctgggaagcagtgctggggctcccacccctcccccccgacactatcctagccagccaggctgcctgtctccctgggtgggacccatggaggactgaggcccggagcccaccgtgggtctgctgttctgtagaaggctatgggggcctatgtgaagaagccctgctggcagtatctgatttgggagcaaagacatatgaggacaccactaagaagctgcctgtgggctcacgcctgtaatcccagcactttgggaggccgaggcaggtggatcacctgaggtcaggagttcgagaccagcctggccaacatggtgaaaccccgtctctactaaaaatacaaaaatcagccgggtgtgatgatgcgtgcctataatcccagctacttgggagcctgaggcaggagaatcgcttgaacccgggagacggagattgcagtgagctgagattacgccattgcactgcagcttgggcaacagagcaagactctgtcaaaaaaaaaaaaaaaaaaagaagctgcctatgaaagtcccatactagggtcagttcctgagcgcccgatccagcttaatccccttgatgtctcttgttgatcaggcctccccttcctctcctcctcctcctgagcaatgagcctggccaaagaaaatgattgatcttcccagaaagagaactgaaccccagtagagcatagaatttttttctgaattgtgtggggtagatagtggggtgctttagcagatcaggaaagaggccctgcttggctagagcatggcctctgagttccttaagaacagagaccatgttgagttcacattggtatgtgtcgctcccctgcacccctgccagcacattgtccttagtagacaggcaggaaatatctactgaattgaactgagtggacagaaagtgctttcacaaacaatggttgtttacatggatgaataacagacagaaatgggcattaggcctggcctgcagggatgaatgggattcaggtgggccagggcaggcatcccaggaggcggaacagcaggagcaagagcatgggtactgaggaggtgagtgaggtctgccgaggctacgaggatcctggttcagtgggtccctgagatggacaagacttgggaaagggcatttgaatggcaagcagaggagtgaatatttaggttagaactgaccctgcatcccctttctgaggctgacaggtacccgagagttggtaggtatttcatccaatgataacagtgcttgttatatacctctgtggtgctgtttccatacctaagagcacccatgctaaaagtgtcttactaattaccagtgatggcctccttagggctgggatgggaactgagaatcatttgagggcttaataagtgattttggaggccccagtccccaccctatgggagcagagtgaggtggtctgacaaggtgcttccttcccggtgagcaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggaggtgggtggggctggccttgttcctcttcgggagcccgtggccccttctgctctttctcctgggtggggaagtctccaagggaacaggtcatagttggaggataaattaacttcacccctgaagcctcacatcttcaatttttagtaccttctgctttcccaaggaatgtgttgagaatgcacatttctaggccccatctctagaatttgcttcactaattctggggtggagttcagaataagcacttctggtggttctgggtgctggtgggctccaaacactggctcaggcatctgctttgaaaatggctacttgttttaactgtgcaagagtgtgtgtgtgtgtatgtgtgtgtgcgcgcgtggctgtggggttggaggttcggggaatcacacatttttttgtctcaatctttcctacccccaaatctgccctccttcctgacctgacccccattggcaagtcctggtttctttgctctcccaggcagaggctgccaccctgccccttggtcatctagggtccttgtcctagtaggttgtccttgtcctggttccccttcctctggtgacactcagccacacagaaggccaagtttgatggctttggccattttgatggttggggagtaggatgggcaggggccgccaggagcccaggcctgggacccctttgctgacaggccccttgccgtcctgcagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggtgagagccccatcctgtgctttcttagtgcagcccccaacccctgccccagggccctggagggcacttccccgggacgtgggctgccatgcaagtgaggagggagagaaaggggaaactgccgtcagcctgccctgactcaatgcaccctgcaaaaccagccttggaaaacctgtgttggtgccccataagcttccctgctttccgggagagagtgttcagactgtgggtagaaagaggacctttgacccctgatccttgctctcctaccatgaggagtcaccctcagtgaaggcttgctgctccctggctgtggagacagaggagcagaagagactcctcctgccctcgctggcccctacccctaccccgacctccagtggcctctgggactctgctggggatgtcagaggccttggtcctgggttcccatcccagctctgggtcaggctgggttttagtgggctgccccttcccagtgccctggggcttgcgggcggtcccaaggcgtgggagcatgggcttgggtgctgcccaccaccccacctgcttcatggctctctaggcacctggggggaagcccctggggaagcgggggggctgggtcacttctgagggagcttctcacccttgtggctcatcacaccccactgtggtcctgctccctggagcagggctgcgtgtgctggggggagggcaccccctggagcctcgttggtgtgtctaaccgtgtgcacttttatttcccctcctcccccgcccccccaccctccctccgcatgcctgtccctgtgtctccccacacacgccaccctcccccggggcatgcccccctcacggctccacctccctgacaccgcatggctcgctgcctggcgcaccgcggccccaggatcactccggcacactgggtcccgaggagttcaaagcctgcctcatcagcttgggttatgatattggcaacgacccccaggtactcgcctcctgcatggagcacgctcaggggtggcgtctggggcaagaaataatgcgtttttcctttttctcttctctctgtctggatctcctgtccccctcctgtgggccatggggctcgtcctctcctgctgtctctgtctgccccatcactggtccaccctctgccctctgctgtctttcatggcaacctactgggtgcccgctgtcttccgtcctcgctgctcttcatcccatgggtggatttttgcatctccctgctctgtcttcctcctgtctttggacatttccaccgatgtgtgttcgcatcttctcctatgttcctttacctatcctgacccccaaaaccataaatctcatccccgttctggccatctgttcctgtcttcctggccccgggccggcccttcctcttcctgccttcccgaccctccttgtgtcttggtaccactgccccccacagaagaagacaggcatgatggacacggatgatttccgcgcctgcctgatctccatgggttacaacatggtaacgtaaaccccaccctctgtctgccctggtgagaaggcagccagctggcgggagcagccaagtcccaggagtggcaggctggaggccctcaggctaggggctgccctccctggaggagccccagggcccatgtccttggggaagatggctccctgaaagccggcccggccacgggcgtgtgtgtatccgggaggcctgacctcctcgcctcaatctctgtgccacttcatcttctggtacttctcactcccactgtggacagctgggctgaccctgaggctggcaggaaggactggtggtgtgggacatcccaggtttcgggctggcatgcgtcacctcacatggagcatggaaaccgagacttccacctctgtcctggcggtgactctggttgggcctgccgcccctctggattgtcccaggccgtcccccaccccccaaccttcctagtctgtccccccttgcacagacattctgagcagagcagtcaggtgactcctgagccatggtgccaagtgcagagcccacaggctgtccagcgcagggcatgggcatggggctaggagcagtgaacctgggagtaaatcccagccctgccgtcattagtgtgttacctcaggtgaagtgggggaaccctacaggactgttacaaggattaaatgaaggaatttaagtgtgtgcatgtatctggcatgtagaaaatacagtgtggtggggagagaacagattctagaaccagactgcctgagttcaaatcccagttctgctgcttcctggctgtgtgaccctgggcaaatcacttagcctgtctgggcttcagatttctcatctgtacaatgaagataataaaatacctatctttatggttgtagtaaggattaaatgaattgaaataaagcttttagattaatacttgatatgctacataggtgtcagccattgttaatcattgttgtcattatagttattatcaacatgattatttgctctaagaggaactcaggcatctgcagggtgtggggaaccctgagctgggtctcccctgttgggtgttgtgtccccatcatacccttaggacaacccaggttaggtcagggggatgtgcccttctcttccagccataggctgctctgagcccccagggtcttcagtccatatgagatattcccagcaggccatgggctgacaggcctgggtttggctgttccctccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaaggtgggtgtcctatgggtgggcactgtgctggggtggcaggcactggctggactgtgatctaaaggggtgagagctggaacatgaactcctcaaccgccccttcttccagggtcctttggcctctccttgtttgccacttctactcatttctgtaatgtcttgggctcagctaaggtgtcaggacacaggattagtataagtgacccttccaggatcactgcatgccagtgagggactccatagctgggatgaaatgacgggtggcagatgagaatagagtggtgtggatgtgtgatcggactcttggagtccatctgacaatccctgggacttcacccttggtctcatcccgcgcatcggcacggactataatgggagcaggaagagggactgtgggacccaggaaggaagcatgtctctcgtgttttctaccctgagcagtgatctactctgggtttcccagtctcccaagtaccctgcaacactccacctggcagtggatggatgcagggggttgtctccatggatgccagaggctcagtccaagtctccactgttctgagatggtcattggtagacctggatgttacccagaaccacagccatctccagcccagggacctgaggggatctgtagaagccacagatccctcgaatattagagaaaagactcacagagcagccagaagaaatggtgggggtggggtgggggcctagggtctgtgttctgttcagtaaaagtcacagtaaatccttatgccatccttccttcaaaactgaaaagattcaggccaggcacagtggctcacgcctgtaattccagtactttgggaggctgaggtggatggatcaggtcaggagttcaagaccagtctggccaacatgggaaaaccttgtctctactaaaaatacaaaaaattaaccgggcgtggtggcgtgcacctgtaattccagctacttgggaggctgaggcctgaaaatcgcttgaacctgagaggtggaggttgcagtgagccaagattgtgccactgcactccagcctgggtgacagagtgagactccgtcttaaaaaaaaccttaaagaatcagttagcgaagcaaaagccaatagggagggaatataatttctggaatgtctgtctataagggaataaaggctgaacctacaaagaagtccctaaagttctgatttaaatacaagaacaacgttatttgcatcatagcactttggagctggaaggatcctcaaaccatttagttgtagtggctaattttgtagaggaggaaaactagggcccagctaggggcctggtctcccaacttttggcttgacagtggcagctctaccctccctcaaactggttcccagggcactctggcagaggtagggcatggtgcagggcgactaccttgtgggtcagagcccccaaatgagctctcctggatcttgaagctcctaaaagaagcagcttccaagtagacctatcatgagcaaacctgggagaaggtagatacccaggctggagctgcttgcatggggcaaggcccgcatttctgcaaagctgcttaacatagcctggccatatttgggaagcagtgatgcccaaacatggatggtgttcttaatctgctggagggctcattaaaattagactgtctgtccgaggcgtccagagagctcagttgagtgcgtgtggggtctccccaggaacctatacgctccaccagagtatctgctgatactgctccagcacgcaattattgcagactagtgtgattcagaagatgattataggtgtaattggcacatggaattagattggaaagtggcttacaaagtaggtactgaagtggaaaacctgagagaattttaaaaatacatgttgtgtatgcggtatgtacatgtgtggatatttacgtccgtacatcctgtagttacaggagggaggcaaaatgcaaacggcacatgctgccttcacgccgccaggctttgcggctgtgtcgggccgcgccgctttacggctgctggactttgcggccttcctgaccactctctcctcgcagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacgacaccaaacagccctgtgacatctgcattccccccactcgttttatttttgctgcagggaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgagatggtgaggagagactgaaggctttgccagttctttggcctatgccaggctctctggtacttctgcgggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaaagtcagctgtgctttgttatgctgtttaaaatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaactgtgagataatacgtttgtgttgttttaagccacttcatttgtgataatttgttacagcaaccataggaagctaatatgtgctccatcgttcatgccctggggagctggctgcctccctgacgtcagtgacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttgacccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccgttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattaatcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgcttgagcccagaagttcaagaccagcttgagcaacatgatgaaactccgtctctactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggctcatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgagagtgtgaaactttgtctcaaaaaaaaaaaaaaaaaaaaaagactctgacaaggaattcagaagagaattttagcaaatttggtttcctcttattgtccatgatacaagtctaaaaaagtctgagctctttcaataagtatataataatgtacatatatgagtacataaagaacataataaaattctaaagaaagcattgtgttatggtttaactggttacactttatagctcataaaataatggagcatctataaatctgatcatatctgaagagtataatatggcctatgggccctattgcctgtcaaatccaccaaatctggattctatatttgatggaagaggaaaagaaagatacatcctaaacttaatccaaaagcaatgtaagggatgtctggagggcctgggaaggtcttcagagtggaagaagtctgtgagaagttaacctggtgataccgattcaaagagcctgtcaagtgaagccccctaaaatggggagaataagaatcttagaggttgttcagtagaagtcttggaatgcattttcagtggttaagggaaaaaaatgactactcttaaaagttgagaaaccaaagtcgcccttacttcatccccaaactgaggagccacctaaatctgttgaagttccctgtggggtccaatccagaagccatcatagccttcagggtccatggaagaaagcagttccattacagagagcccaggagttcagccagggaaaatgctcactgaaaagcagtagaagtggaagctgtaagaatattaggtccctctgggcgtgatggctcacgcctgcaatcccagcactttggtgaggccgaggcgggcagatcacctgaggttgggggtttgagaccagcctgaccaacatggagaaacctagtctctactaaaaatacaaaattagctgggcgtggtggtgggcgcctgtaatcccagctacttgggaggttgaggcaggagaattgcttgaacccgggaggcagaggttgtggtgagccgagattgtgccactgcactccagcctgggcaacaagagcaaaactctgtctcaaaaaagaaaaaaaaaaaagattatatcccaaagctactataacttatgatagctccaacaaaaatataaaaatacaataacacatgatagctccaacaaaattatgatgtctctgggacatcataaaggagaattccttagtcagagggagtttacagaacctaataaggaactctcagagtaaagaatgtattggaggctggctcacgcctttaaccccagcactttgggaggctgaggcaggtggatcacgaggtcaggagtttgagaccagcctggccaatatgatgaaactctgtctctactaaaaatacaaaaattagccgggtgtggtggtgcacgcctgtagtcccagctactcgggaggctgaggcagaagaatcgcttgcacctgggaggcggaggttgcagtgagccgagattgtgccactgcactccagcctaggcaacagagcaagactccgtctcaaaaaaaaaaaaaaagaaaagctcaagaattatgaaagaagattactacaggacaaagaaggtctttgaaaccagctccgtatacagaaggaggtaaatcatgagattaaaaagttgctggtggcttctgttggggatgatcttcagtatcactttgaatgtctagtccttgagaaaaatcagcttattttagaaaatgaagccctaggttgaaatacagctcagctttccaaacagaacgtgtgttaatacagtgtgatatatggcaaagtaaattccttgcaagcagggtaatggcagatgagttaaccaagtcaagagcatcaagagcagttttgtttttctttttttttttttttgagatggagtcttgctttgttgcccaggctggagtgcagtggtgcaatctcagctcactgcaacctctgcctcctgggttcaagcgattcttgtgcctcagcctcccaagtagctgggattacaggcacccatcaccacgcctggctaatttttgtatttttagtagagttggggttttgtcatgttggccaggctggtctcgaactcctggcctcaagtgatccttctgcttcagcctcccacagtactgggatgacgtcaaaaacgtgatgcacgtggggccatacaggatctcctaagtgaatgggaacagtttcttcaggaaatgatagctacccagaaattattggaggagctcttagtctccttgcagtggggaagagggcaaccttactcccctaatgtacaaccccacagcacagcagagctggcattaacaaatcacaagttggcaaaagtagcaaattctcatcttctgggaaacgttggcattaactatcaaaaaaagattccatcgacagttgaattctgcagcaccccagctgagaaaatggctgaaatggttctataaactttagatccaactacctatacagagagctcacctgataatccatgttttgagttttcaccaaccaccttacttgctgcaaagaaaaattctggatgatttcatccctaggctagatatgaaaatataactttcaatttctgcagtcactgccagggagaacttactgccctttaacagtcaatatattggaggcatgctacaggtacttgcttattacccgagagtcattatttgggagctggggttcttagaatgctagaagtaatatcacttcctatttacaaagtgtatatacccaaagatgttttatgtactagactccagattaccccttcttaataaatatctcagggtaataaaagaatgaaactgtatttaaaatttaaatacagttgcattttttttctttgagcttatacaatgttttagaaacagtctactttttataaatatcaagttggatattcttgtgtgttaaactgtatttaatatttaaaatagagaatacttcccaagcaatacatgatgcttttcctaaaggactctaaaagtaaaaggttctataactttcttttaagcactaaattattatttatcttactggatattttatatgaacagtgttaatttagttacactaaagcaagggtaggcaaactacaaccatgagtcaaatatggccacacccattcattcactattgtctaggttgtttttgctctatagctgcagagttgagtagatgcagcagggcatgtatggcttgcaaagcctacagtatttactgtttgatccattacagaaaaagttttctgactcctactctaaagtaattgtagtagaaggccagagggctttctttccctttatggtaattttttgagctacaaaagagccttggataagtgaatgaagggattaatctttttaaaataaatgctgtaagttagaaaaagaataaatattttagagccaaattaacaagtacttcagcaaaacatgttagttttatgcaggggattctgtattctgaatggacacaatctgacatagataaacagattcttaactgttgactctttagcaaatgcaacacacaggaatatccatttgatatttataaaaagtagactgtttctaaaacattgtataagctcaaagaaaaaaatgcaacccatcaattaatatatattatgtaatatatactattgtatatttattatgagccatcataaatacccattgattggcctttaagaataattacaaaatatttatatcaaattatgcaaatttgttgcagaagtgcctatcagtagagaagtcttcaaaagacaaacctggtcaaataataatatattttaatgtcaacttaaaaaaggcaatataaaaatcccctcttatcacagattaccttaagatatactttctaattgcactctgtagcatcttccatttctaatcatgctttcttgtctagaaatctccttaagtcctacttttccaaccaacaatgcaagagaaattttgcaaactccaatagctggggaagctggcttctggaaacaagctatttgaaagatggcttgtgagcacttgtaaaaggatacggggggccaggcgcggtggctcacgcctgtaatcccagcgctttgggaggctgaggcgggtggattacaaggtcaagaattcaagaccagcctagccaacatggtgaaaccccatctctactaaaaatacaaaaaattagccaggtgtggtggcaggcacctgtaatcctagctgtaaccctagctactcaggaggctgaggcaggagaatcacttgaacccatgaggcagaggttgcagtgagctgaggccgagccactgcactccagcctgggcaacagagcgagattccatcccccccccccccccacaaaaaaaaaagatacagggatccttgggcccagcccagtcccaggtagaagaggctctgcttgattaactcttcttttggggttggataccaggctctacagaagagcaatatgaaaatgtctctgtccttgctgaaattcagacaagcagcgtctcctctaatcctggtgggaacgatggggaaaggggagtggatggagagtcccactagaggactaagtggctgtggaaaccaacatgccagaatgtgctggcttatgcatctgacaacttgcagggacatttctgcatgctgtgaggaccagtgattattcccagccagtcatttttcttaatgacttggactcatcaaactcatggccattttgaagccaataaagtaagtgggagatttgaggttcaaaaagaccttaataggcagtcatgatgggagtaatcttacaaggctacatttcatagtaataaacataaaaccctgaaactgggtctaaaaaaccgaaacctgtctccaaggtgggaagatatggtgggaccacatggaaaagaggccgagaagactctaaatgtgattcagcagtgtggtgatgcagctgaaaagagttacttcaatctcgggctgaactgataacttgggagctcagaagctggtggttttctgccaatgtggctgtgaagcacggaaagccggtctctgacgagagaagaatgaagcaatgctcacagtggagaagagatcctgccacgtgtcagcccgagcctgtgggtgagtgacatgaattgtatcctggtacctcgtgacacattttccttttctttctttctttttttaagcaaaacttaattttttctttttttttaagagatggggtctcactctgtcacccaggctgaagtgcagtggtgcaatcatagctcactgcagccttgacctcctgggctcaagcgatcttcctggttcaacctcctgaatagctgggattacaggtgcatttatttcccttctctaatttgagttaatgcaggtggatttgggattggatttgtaacccaagtcctactcaacgcaaatgttataaggactgtgagagatgggcaggacacgacccctaacactgagtggtttggtaagatcaagtggttgaggctgatttgggactttgaggatcaaaatgaatggaaatctccgcttgcttttccagaatcttctggtggtgagggagtgagggggcttcctgggctgtactcactgcaagattctttttagttccaaatttgcactccatggtgaaagcagcatttaaagaagaaagagagaaacccattcttcttatataggtaatagaaatggggaatgcagaaggaatgggttagagatttccaagggaacttctgtggtcctcagtgactggctaaatgcagttgaagaaggagaagaatgtccatagaatgttagtgttggaaacacctttgaagtcatggagtccaaccttcccaatcattgtaggagaaaaccaaggcctgggagcatgggttgccttgctgtaagtcacagggcctgaggcagagctaaggtgagaacccaggtctcctgacttgtagcccagtgctctgtacaggacagcaaagtttgggggccatgatggtcgggaggagagagagaagtggaggtgggaataatttggttttatgtacaatcggcatgagataataaatgtaataagtcatcaatgtacccaacccactgtcatttgtgggtgacagtaaccattagattgtgtagtggttaggacccttctgggtgcaggaaacttaaaacccaatctaagctggtaaagatagaaggataagctgggtgtgatggctcatgcccgtaatcccagcactttgggaggccaaggtgggtggattgcctgagctcaggagttcgagaccagcctgtgcaacatggcgaaacctcgtctctactaaaatacaaaaaattagctgggcatgttggcacgtgcctgtagtcccagctactcagggaggctgaggcataagaattgcttgagcccaggaggtggaggttgcagtgagctgagatcccaccactgcactcagcagagtaagactctgtcttgggaaaaaaaaaaaaaaaaaaaaaggataagttactggctcaaataactgaagtgttcagaggtaatgctgactttccaggtggctgaggcagaggctcaaatgccagcagggcctagcttctctggctggaccccattctcaaaagtgtctctctccaaggcagcaaaatgacttccagcagctccagcttccccaccttgtgattgcaagtctggcagagagaaaaaggagtgaccccagctggaggcaggcaacatagtggccccagccaggacagtgggttttgcttattgttatatgtaaaatgtttattcagaaatagaatgcttgttcctcggcaccacaaggaaaaattagcattcagacaagaagttttctcagcaaggcaattttacttctgcagaaacggtgctccttgcagatggaacaatggtgggagcacacctgaacaaaggagggaagcaatttttatcctttacacagcttgtccctgctactgtgtcctgtctccattggctggagccagatctcacaatctaaactaaaacccaacaggctaataatttaaaacttttctaaataggtaaaggcaagggagaacaaaggaaaagaggaagttgcttatgccaaatagggaaggggcataggctaagagctgggacatgcctgtgagcacgtccggcacaaatatcttggttaaagtacaaggacatagactgtattacgtgcctgtgagcatgtctagcacaagtattttggttaaagtataaggaaatagaatgcacttattcctttatatctagcagctacataggatagggcttaacaaagagttaatagcacaaagcaaggaggcttgaaggaagttagtctttaaaataaactattatttctaacatgatttattttttaacaagaaggaaaactttgaagaggaaactttttactttctacacttactgtttgaggcctagcttgggttgtatgctcaccctagggtggcgggtgcggtcccacccaggccacctgaattcagaatggcctggccagtatgtcagggctccttatcacaagcaacagaaaccctttctgcctgcccccaaaactcatatagggcgtgggcttctccagaggcagatgccggtcaagagacaggacagacatctatgagcatggggaggagtggactcccagcccggatccaggagaagcgctgttgggacaataggcagccagcacctgagtcagaggtgaaggtagcctctagcagcagttgtcaccaccccgcccgtgcctgtcccacccttcagtttgttccagcaaacttccacctgtgtgtacctgcatctgtgtgcctggggctttcctcccagaactgcagaagaccactctgcctgtggatggagcaggctactgaagaagcagccaccaagagcagccctcagccctcagggtgggtgtctgaggccctcagctccctcacacttggatgggatgattctgaggcacgtgttttagactgtttcttggcgcttctttctcccatgggattcagtgcagatgcccatgcggtgctgagctcatagcacagcttcactgttaagtcccccttccctgagtctcttcctcatttccatcccctgcacctcccacgtaaaccactggtgctagagccctcatctagtgcgtgctttggggtgtcccaaactaggacacagcccactctctgggacctacctggggacagtgacttcacctggaagtcccgctctagacctttgagacgggctgggaaggagccccacaccaggtcctcaaacagcactggaacacttagacccacaggtaaagaaaccattcctgctgctgcggtaaggagggggcaccaagggcttgggaaggagctgccacctctccttcagctgcccccttgttcttcattggcagcccccacggaccaagcgggagaacaggaagctcctgtgtgcctgcaggagtgggggtccaggcatgcaggcatgtggcacagcaggggtcacctgtggagacctcggtgcctgtaggggaccccaggtttagaaacaaaattctcattttatgattcaagacaatgagaaaacagttctttaaggaaaacatctctctataggttatataggttatattttataggttgtattaatattttatagaacttaggctgggtgcggtggctcatgcctgtaatcccagaactgtgggaggccgaagtgggtgggtcacctgaggtcaggagttcgagaccaggctgaccaatatggtgaaaccccatctctactaaaactacaaaaattagccaggcgtggttgcatgcgcctgtagtcccagctactcaggagactgaggaaggagaactgcttgaacccaggaggcggagggtgtagtgagccgagattgcgccattgcactccagcctgggcaacagagcgacactctgtctaaaaaaaaaaaaaaaaaaaaaaaaattatagaacctattctgtgtattctgtgataggttatatctgtttactaagggctgcctggaataggatgcataaaatgaactactaggataaaagaactaaccccgtgtccagtaagcccccatgaaggcttccttccatcttctgcacctctgcagctggaaaatgcttttttagaatggccttcctaaaaaacgagcgagtggatgctgccctccagtggccaagtgtgcccttaaagcatgtcagaagaggaccaggaagcaaaatcaaacccttcccccctgcttcttcccagtgcttcacagactgctcctaatgggaatactgctggggtattcctggggtgctgaaggggcttggatctgtgccacaaagggacagcagaagcaacaaggtgcatttagcaggagaaaaacaatagctaacatttgctgagcgcttactttgcattggcctaaatctcaaatgattgacatgcctttaatcatcacacataccgttgttatctcaacttaaaaaaacaaggccaagctatgtggctaatgcctgtaatcctagcactttgggaggctgaggtgggcagattgcttgaggccaggagttcaagaccagcctagggaacatagtgagaccctgtctctacaaaaaaccacaaaaattggccaggcatggtggcacgtgtctgtagtcccagctgctacttgggaggctgagaggggagatcccttgaacccaggaggttgaggctgcagtaagctatgatcacaccactgtactcctgcctgggtcacagagagagaccctgtctttttttttttttttttttttttttttcaggatttggtatgttttattagagcaaatttttaacaaaaggtggcttttatttacagaatttaatgtggggacagtggggactgtccaacccatgtggactcaagtaagggtaaccattaagcctgctaatgtattttcttattttcagtttacatacaattttttttgttagcttcacattaataaaaaaaaccaatattgtaaatgacaaataacccctcccatcccttaattaaatatacaaacagcttgaaaaacatacaatttaaattgggttaatcttgaagtgtaatccaatgagactgaaaactaaacaattcaagtcttgtaccaaatagtaaaatactcgaaggccttcaggatcctttgactgatttacatcaataagagagcctatttttgatgtggtaaaagatatgtgggccgggcgtggtggctcacacctgtaatcccagcactttgtcatcccagcaccaccgccaaggcgggtggatcatgaggtcaggagtttgagaccagcctggccaacatggataaacctcgtctctactaaaaatacaaaattagccgggtgtggtggcgtgtgcctgtaatcccagctacttgggaggctgaggcaggagaatcgcttgaacctgggaggcagaggatgcggtgtgctgagatcgcaccattgcactccagcttgggcaacagggcaagactccgtctcaaaaaaaaaaaaaaaaaaaagatatgtgctcatctccaattacaatttcaagctcctgtcggccagccctgtcagggggaggccacaaaccatcatcttcttttgtgatttcattgtcatcaataattctcttcagttcttccattaaactcttgtgcacgtaagcctcttttctgatcatgacatcatttttgtaattgctattgttggcatatctaagctttccatccagctgaaattcggactccaaaaactcatgcccaaacttgcccttgtgccctacgtagtagcgcaggtagaaatcgctagccataaccatttttgtccctgggaagcccgctgaaaacccagacaaccgagagaccctttcttaaaaaacaaacaaaaacaggaggccacggcctgagatctccagtgagtgacagagctaggacttgaaactatgtttccctcatccccaggagcgatattttatccacttcaccagtggttctcaaactttgcgatgcccaagaattgtttagggagattggtaaagaggcagcatgtaggactgtgtccccagagattctgattatttctaagagaagtaaagacaactgggaatttgtccctaggacattctgggtggggtctggtaatggaaacaagttcatggaccacctttgagaagtgctagattaaaacctcatcattaccaagagggagattttgtatggatagaagagagaactttctaatagtcatatctatattctgatccaactattgctgcgtgccagcatttggattggtgctttcatatacacaatttcatctcctcttggtggctctttgagtaggtgcctgcagtttgcagatgaggataccaggctctgataccttcaagagagtattaatctctccctcctttcttctaacttggggccctgcacctgcttcatttggcattccattatgtgcttatggtgagtctccctatggaaattgtgcaccttgatgttgttgaaggcctttgagtgttgtctggcgaaggtcacagattgtatctgttgagctgaaatgccccatctgctgtgaacaggcttgagcgatgaggaactgagggacctatggagcagctgccccatgtgtcactaaggtgacatcaatcctggtatctggagccgctaatccctgggggaaggtcctgtggaggagagaaagtgctataactggacatttgggagccgagtcctggtcaccttggggctgcttctcaggggaacctgccaagtgctgtcaaatcagaacatgtcctccgcagggaaaagatcccatgaaggcaagcccagggttgtcacagggtcccaggaaccagagtagcatgaaagctctgaggaaggctgggagcagggtgaggctagctatctcacagtttgggccctgtcactcccagttcctccccagaatcggtagggcgtctctcacttccacccctgaaggtgctcctctccttacattctgcccctcacacttttcctttattttcttctttttgagacagagtcttgctctgttacccaggctggagtggagtggtgcgatcttggctcactgcaacctctgcctcctgggttcaagcgattctcctgcctcagcctcctgagtagctgggactacaggcatgtgccaccacgcctggctaattgtgttttgtatttttagtagagacgggatttcaccatgttggccaggccggttttgaactcttgaccttgtgacccgccccccggttcagcctcccaaagtgctgggattacaggtgtgagccactgtgcctggccacactttcctctttataccatgttgtattagctgatttttttttttgcatgaatcaagtgtcacttttataatcatatataaaaaagtttcatttggagaaaactacaaatggaatgatctccaggaaagcagggtgtaggggagaaaaactaagatctttccttcacccaccaagaggttcatggctgacacccctgtaacaaaagacagattaacaagaggaaagtttaacaaatttatttaaccaaagttttatgtcacatgggagccttcagaaataaagacccaaagacccagggaaaacggtatttttatgcttaggtttgatgaacaatggacagttttggccaggtgcggtggctcacgcctgtaatcccagcactttgggaggctgaggtgggaggatcacctgaggtcaggagttcgagaccagcctggccaacatggagaaaccccatctctactaaaaatacaaaattagccaggcgtgttggcacatgcctgtaatcccagctactcaggaggctgaggcaggagaatcgcttgaacctgggtggcggaggttgcgatgatcagagatcacgtcattgcactccagcctgggcaacaagagcaaaactctgtctcaaaaaagacaaaaacaaacaaacaaaaaaacaaaacaaagaaaaaacctctgatgccaaggcgccatgctttggagtattgcaggggaaaaataatagcccccatgggtttgtagttagaaaagcgcccctgttatgaaagacagactaagaagagaaaaacaaacagaagtttattaacatgtatattttatgtatacatggaagacactcagagaatgaatagttctcaaagaggtagctttgaattctagcttgtgtagcatcttcaacacagagcaaagaacagtccatttttagagcagtgacaagacaaaggaaaagggcgttgagtctctggcggcagcggcttgtggggaaggcaaataaatggcagacaaagactagttagtaaagcttattaatgtagattcctctggtaccatctccaggctgatagggtctaaatctgtcttcagtggttaacctttgttctccctggttagaaaggtggttggggctgggcaaattggctcacgcctgtaatcccaacactttgggaggccaaggtaggcagatcacctaaggtcaggagttcgaggccagcctgaccaatatggtgaaactccgtctctactaaaaatacaaaaattagctgggcgtggtggcaggagcctgtaatcctagctacttgggggacggacgcaggagaatcgcttgaacccgggaggcggaggtggcagtgagctgagatcgcaccactgcactccagcctgggtgacaagagcaaatctccgtctcagaaaaaaaggggggttgggacaccttttgttgttgtaagtctatgtcctacatttaggcaaatagagggaggtcagggatctttcccacatctgctcaaggatccttcatactttggggcggcatgttccggactcctgcagtattgtgttcttaaccccggcaaggttaagagggatcattttatttcaaagaaaacgtctcaggacccagtctggaaaattctaacttggaaatttaaggtcttattctgttaaaatggctttcagttgtgaaatagtaatataacaatgtcatccttaaaaacttgtaaaaaaaaaaacaaaaccttaagattatttattaaaataaacacaaaacttaaaaatctcatagaattttagttcctgaacacgggcaggtctaagtgctccaatttgagacacacttacgtgcgacacatacggatgtcaagttggtgctaagacgcccccatggcccccaggtattaccaggcaggtgcagataagactgtgtgatggtgtggaggagtgctgagaactgaagtagtaggatataaaggaaattgtaggcttgaagtttcaggccgcagggtccgattgcttgtgctcaaatcctagctctgtcccttgccaactttgtgtccttaagcagctttaattctctaaaccttgatttcctcatagagttaaaaatgacctctgttttaagcctctttggagggttgaatgaggggggaaaaaaggcaaagcatttttgtagcatactggcacctggcacctgtagcaagccttccgaatgaggaaaaggtgttgcaaggtctaccccatacccttattgcaaaagacagattaaccagagagaggcatagcaagggtattcagggtaagttttacatgatgaagacacaaagacccgggggtatgacccagtggtaatgaactggagggatcttgccaaagcctgtttgttcagattctttctggcctctctgtgaggcatgtcctcgccccaaatatggggtaggatccttttgcaatgagggtcctgtggccaccttgaggggaaggtaggtcagaggtctctaggttttatggctggctttgcgggagaggagttctagtttttatgacacaccttggggaggagaaattctagtttctatgacctgcttcggggagaaatgggaaaagaagaaatgagggcaggagaaggtcagagagagactttgcttctgaggccttctaatctcctttagttcaaagtactcagcctgcccaaggtccagacttcagggtattgttttctgagccccgacactatcaatgtttaccacattagaaatgaaaattaagaaaaagttaaagtagtatttattagtttaaaataatgaatgtatatattgttatatttataataaaaattttttaaattatatcttccaaaacaaaaaagtgagaaaatcagtattatttttaaaataatttttaatttttgtgggtacatagttcatgtatatatttatgaggaacatgagatgttttgtttggtaagacgtgcaatgcataataatcatatcatatagaatggggcatccatcccctcaagcatttatcctttgtcttacaaagaatctaattctactcttttaattatttttcaatatacaattaaattattattgactatagtcaccctgtggtgctgtcaaatactaggtcttacccattctttctattttttttttgtactcactgaccatccccaccttctccccaccctcttactacccttcccatcctctgggaaccatcccaaatcagtattttttttttttttggtgcgaccatacctggctaaattttgtatttttaatagagacggggtttcaccatgttggccaggctagtctggaactcctgacctcaggtgatccacccgtctcggcttcccaaagtgctgggattacaggcgtgagccacagcacctggccccaaatcagtctttttaatacatttttttcaagtctttttaatgtctggcttaatagaaaccagctggacactcatatttgcttctgcattcaatctactgcaatatcacatgtcatgcagcctctggaaaattctgtacacacaagagaatgagagggcacaagagaacgagagggcaaaatactaatgtcttagtgttgctataaaaatagttttgatcttgtgggggagaaaaagtaatatcttttcctcacctgtcgcaaggttcatggctgacacccctaaaaccaaagacagattaataagaggaaagcataacaaatgtattcaatatcagttttatgtgacttgggagccttcggaaaatgaagactcacagacctcgggtaacctgtgtttttatggacagccatgaagaagtaggatcggagcacagggagggaggatctaaaatttaaaaactgggggaagtcagcaaggcctgtttgctcagattcttcttggcattcccatgtgacatttcttttctctgtgtatggtgcaggacatctctcacatgagggtcttcggggagaagggagggagaaggtcagagaatgacctttctaggttttgctgttttctcaaatgcccgagtgccgtattttggggtaggatttctttttctttctttcttttttttttttttttcccgagatggagtcttgttctgtggcccaggctggagtgtgatggtgcaatctcagctcattgcaacctccgcctcccgggttcaagcgattctcctgcctcagcctcccaagtagctgggattacaatggcgcaccaccacacccggctaatttttttatttttgtatttttagtagagatggcgtttcaccatattggccaggctggtctcgaactcctgaccgcaggtgatccacctgctttggcctcccaaagtgctgggattacaggtgtgagccaccgcgccggcttggggtaggatttctaagccacaacaatcttatgactctcctgacaggtctcaaggacgcccgggggcagaacagcagtctctgcaggcaggaaatgtatagtctgggggtgccgagcctccagcctgagtgggctcccttaccagacacggtggtaccctacccaggtcacctctatttgagggcggctgcctgcactgagtgcctcaggtgcagcatttttcctggaaacgggagcaagctgggtccaagcacagaacccgctggaagcgccagggagtcaatgcgggccaaacggtgacggggttggtgagtaaatactggcttgctcacggctccgtgtgaccgctgaggtctg

SEQ ID NO: 899 - DNA, 2690 bp, Homo sapiens
cccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagttaaaacttttctaaataggtaaaggcaagggagaacaaaggaaaagaggaagttgctt

SEQ ID NO: 900 - protein, 849 aa, Homo sapiens
HARTIMDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKLKLF

SEQ ID NO: 901 - DNA, 30471 bp, Mus musculus
  misc_feature (1)...(30471): n = A,T,C or G
agaggctggcggatctgagttgaggtcagacagcctggtctgcagagtgagagcaagcaccagggctacacagagaaaccatggcggtgtggggtggggagatggagcctatgggttagttgaagaggtcgctaagatctgacccaagaagtgtgtccccggcggcgtgccggggcggtgggggaggggctctcaggatgagttcttaatgctgctgctccctcacctgggggtgtggctggatctggctccgggcacatacagacccggggttggagaccaagacagctgcagtctggggtgtgtggtgtggtgtgtgtgtgtgtgtatacctacctgcttcataggggccctggtaaagttggatctcagagtgacctcacagaagccctgcagcctatattttcttatgtctcctctcacctgtgcctcgtgcccttggctgcctgcacactctaggtttcggggttgcatgagcctctggcaggcagggctcagccaagaaccggaaatcagcctctggcacacgggagctgggaagagacagctgtacccggtgacggcccctgtctgctgatggctggaaacctctagacctttccccctggtttcctgtttgtcacctagcccacacttccttcagggcagctcctggttgagcaaggcttgagtcagctagggaagctgggcgggtgagtcttcacagcctgcaggcatggctgttaaatagtcagatggcaccaccacggctctcctgccccttggggagaatagctccagtcccgggttcagatcatagcagtgccttggaatgaggcaaagtcttgaagagctcagttgctatataaatctcatctaatcctgtttcctccttggagcctgctcagcaatgggggcagctcaagacctagtccatgttccttgctaggatcctggccaggcagaccgaagcagttcctcctgtacgctgattgccccggtcctttcctgtctttctctcccagcaggacagagtaaggttatccatctctaagagattaattctccaagaggggacagttgttgagggtacagagcccagtttgtgagggaaactccctctagaaggttgaattcctacagagtgttgaggccttaggtccctaggcatggtaggggcagagatctggcttaactgtgtattggctggccacagccaccttccccgaggatagacagttaccaggataaatatacccggctttccattcctggggagttactcactgagtcgaagcaccccactgtgggttaggttacctctgctctaactgctctcgggctctggcggcttgaggggacagggactgggcagaagccatgggagggggaggggcgggtctgcctctagttccttcctccttccaaatggagaagtctcacccaaggggtgggaggtgaaccatccccagctcctccagctgtttacatagctcctcccttggtcaggctgagcccacccagtgtgtacatccctctgtctgagcagctgtaagggcccttaggctactacctgggctacccgggtgaccagcgggggactgaaacccctttttgggcacaaaagggtagacaagctgtttaagcatcccctggatccggacggcaggtacttatgagcttatcagctctctgcttcaccatggagctgtggatagtgggccctggtgtggtaagggcccaggcagggcagcccatagctgggaaaggatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagaacgtatcccagtggatatatgaacactcacatattcaatatatatgagatataagtatacttatatatttatacttattagagtgactaacagctgtagacctgctagtccaccaatggctgtctaccatcaaaaggtctaagaatccagaagttgcttagtccacaaggttggccctctcagctggtcttaggtatacaccagtgtggcggtccctgccaaccctaggcaggcagaggaactgtcctaactgttctatagcttaagggcccaggggaggatctggtgtggtctaggtcatgggagaggccaccaaattacaaagtacacgcatgtgacatctctcctagggatgggcttgattgactgagaaaccgtgttcaagataaaggtctagggaggaagagtctgggataggcataatggtctaggggcctggggtatgtgctggccccacagatcaccaggatattaaccacacccactctcagccttctgggtggaagacaggtacacatcccttcccttaaagagacaaacctgtgtgcttgtcatccctggtttccctgattcttatctgtgagcacaagggccttgtgtcctctacacaccagaatccccaagaagtaggctctaaggaatggacttgccagagggagagggagagggagagagagagagagagagagagagagagagagagaaagagaaaacgaacttccttcttccatgtcctttatgtcctttatgtaggctgtgagcagatggttcagtccgggttcagggtggatcttcccaacccagatcagaatgagggactggagagatggctcagtggctaagagcacttccagagcccactagttcaaaattttaaaaacaaacaaacaaaagtccagattaaaactgggtttcaggctggagagatggctcagtggttaagagcaccgactgctcttccgaaggtccagagttcaaatcccagcaaccacatggtggctcacaaccatccgtaatgagatctgataccctcttttggtgtgtctgaagacagctacagtgtacttagatataataattaataaatctttaaaaaaaacaactgggtttcactgggcatggtggtacacgcctttaatcccagcacttgggaggcagaggcaggtggatttctgagttcaagcccagcctggtctataaaatgagttctaggacagccagggctacacagagaaaccttgtctcgaaaaaccaaaaaaaaaaccaaaaaaccaaaccaaaaccaaagcactgggtttcccacttcaaccacgtagttgagggaaaattcctcacaggtgttcccctgcctgggttttagttaattccagtcaaggacaaccaagaacaaccgggtctccctccaaggccttgttttgggtagaatgatgccctgtctgccatcccagcactgggtatgacatttctttgtccttagagttgtgggtcctctagtacagagctcctgcctgttcagcacctcccacatgctaactgtgccgtgatttgatcccggtgcccagtaggcacttgatgcccgttttcttgtttgatctgaaccctaagcttaaaatgatgacattcctggaaacgtggggcaggcaagacagctgaggcacaggcccctatccaggcagttcatccagagagcagacagcctgtctgcaaatccccaagtgcaggctgtaacatccagccacctgaggaatggctggggccccagctccggccgcagaacctgaaccaccttgggttggacctggagctcaccgctcttggcacctgtccagcgccaggactctgccttttgacagattgtatcacatgcctaagatgtggctggggacagctagaacaaaggggcaccgcttgggaaagagctctgcatgggcatagggtgggaaggcttcgccgattctccccttggctgtcctttcagtgggggttgggatgggtggaagggagttccggggtgcttactatcaagtcttgacagcccaagtccagtccctgggcgccatatggtacagggagggaactgactccccgaacgttgtcttctggcctcgacatgtgggtgcccttcctcctccagtaatgggacagtcctgccattgagtgctgggctccagtgcaggttcctggcttgaaggtggtattgcctcaagctgtagcccgagcaaggtacagctataaaatggggtgcctgtgccctgcatttgcagaagagatagtggaagctgactgaatgtgtccctctgggtctgtggagcttgaacttcatgctacccttagattgcacctccagatgtcccaatttgcatgcccagggtcttggcactcaggctggtttccgtgccagctctgtgccgccggctctagcttctctgagactgaaacttctcactgtgcctggggactccctagtctttccctagctcagcaagaaaattctgcggttgcacgaggttacccctggtagcaggaaggtgatagaccaacggctccctctggtggtgagcagcggaaggcccgcacgcttactcaacagtacacagcactgtgagttttgcccatccatacccagggctgcacagacctgccccccaccccgtgaattttgctttccccctccagtggattcaagcttttggttcggactttagttgaaatggtgtcaagcctggacccaacaatttagtggggtgatgctgatgcactctgaggtgccccagctctgggccctttagtctgtgagaagaaggacaaaggtggtgatggatctgtgtctgtcctctgtactaaaggatggggccattgaggcgtgaggtgaaggagtttccaacaccccttgtatatttagagctagtgaaaggttgtagctgaagcctggggaagcctggcaggtagggaggctgctttgtgaagcctcatcctggctgtgtttactgaagccaggggaggagtttgctgggttttggaggctttcgcctttaacagcctatgggaccgctaggctaggcgtctacagcacaggacccagagcctcagaggctgggtttaggtggcctcctgtattgctgtaccaactagtgaggggccctgggacacggggactccaagtctattcaagccacaaggtaaggactaagttagggtacagagagaggaggaagccttgtcagaggctgtgcttgggtaaagttctgctctctcaggtaggcaaacgtttagaggaaattgggaaatcatttttttgttttgttttgtttttgttttctgaggcaatgtttctgtgtgtagccctgccctcctggatcttgctctgtagaccaggctgatcttgacctcagatctgcccgcctctgcctcccgagtgctggaattataggcgtgtgccaccaggcagggctttgaatgctcctttcttactctggggctctggcccagactgttttcatggctgcatccggttctacgaaggagggtctttctctagatgtcacagagtaattaggtctggtttggcaactgatgcattttggcaactgttcgtgggccagcccttgtaaatctcactgatactgcagggtaagagttatttacaaggcgggcgtggtggtgcatgcctttaatcccagcacttgggaggcagaggcagggggatttctgagttcgaggacagcctggtctacagagtgagttccaggacagccagagctgcacagagaaaccctgtctcgaaaaaccaaaaaaaaaaaaaaaagagctattcacagcgagggctggagggtcggatagctcagcgggtaacagcatgtgctaggcgagcctgacatccccagctcccatgtaaacctggacagtggttgtatctgcagccccagcacagaagctgacatccgcagtgaagcccctgtcacagacaggaagcggggcatgggctcttgaatgtagtcctctgatctccatgctcacgtgcaaagtacacacaaataaataatcaacaaagataagtatgaagattgtttttacgtgtatgggtgttttgcctgcgtgtatgtaagtggattaaatgtatgtggtgcctgcagtctgagaggatgttggattccccctggcatgagagttacaggtggttgtgagccgcctcgtggctgctgggaactgaacccaggtcctctgcaagagcaaccaagaggttttactgtggaggtgtctctccaacgtggacacttgactgattagactaggccttccttaaagacaggaggtcagtagtcctggagatgagctgggcctgagttcaggccctggtgcttccatctggtatccacatggcagacagttcttctgtaagctcagagtgagcccttttttcttgtatttaagattgacttttttttaagatttatttatttatttcatgtatgtgagtacactgttgctgtcttgagacacaccagaagagggcatcagatcccatgacagatggttgtgagccaccatgtggttgctgggaattgaattcaggacctctggaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctaaagtgcatgatgtgcaaccttgagcgcagagctcttcagctctcactgacagcctcctgtgctgatacacatctataccttccatgccgtggggaacaggtggatcccagggacttggtggccagccagtttttctgaaaccccttctctcaaaaacacaaggtgtggaggctagcctggtctacacagagagctctaggacagccagggttacatagagagactgatgtatctctcaaaaaaaaaaaatggaagctgagctgctgagacggtgcagtggagactgtaagcctgatgacctggctttttagggtttaactcagaaccctacaaaagtggaaggtgaggaccaactccaccaagttgtcttaggatccgggcggtgctgtggcacacccttagtcccagcactggggaggcagaggcaggcggatctctgagtttgaggccagcctagtctacagagtgagttccaggacagccagggctatacagagaaaccctgtctcgagaaaacaaaacaaaacaacaacaaaaaaaaacaaaaacaaaaaaactctcagacacatacaatataaagaaacaaatctttaaaaaaaaaaaaacaacaacaacataaaacggtgacctacagaaataaaatggaacacgacaaagaacataccccaccccaacttccagcctccacacaggctcgtgctggggagcacagcatgtgtgtgcacgtacacacgtgtacacaccacacgcatgtgaagacacacaagaaagaaaacgagcggaaaaagctcatgggagccgagtgtggtgactgaggcaggagaaatgagagtttggagccacctggcttgcatagccaggccccgtctcaaccccaggcactaggctgtgccctggtggtagtggtagagttgacgaaacagagctctaggctttatctgtagcaccataaaaatcggaaaaaaaaaaaaaaatcaaaccagaatccagcccaggcagcagtaaagccggacatgggatctcagcctgggtgcagggcacagggagggagacgatgtgtgggctgtgtgggcagcagaatccctgattcactgtctagcagagaaggcttctgtctccctcggagtgttcggagcccgaggaactgtgtcaacttgggcagtggggacctcagccctgctcgctacgttaagctacgttgctgttgtggggaggatggcaggttccgtaggtgaagctcctggccctgggaacagttcaggactggcggctgctcttgccctctccggagcactgcagtagtccaagatggagaaagaggggttccgcctcctgggggttgggcccggaggaaatggccagcaggtgtggccccagagacgcctccgggattggccctggacattagttcctgctatgccttacctagacacatatagactcccccgtagtagtgtagttccggtttgttggaggcaggaagtcagaactcctccaggggacctggaagaggaggggccgcaggagtttctccagcagtaggaagctgggacccagggtctcagcttctcttcccagtgtacagcaggagccaggggtaggtgtaccgactcaatgatgttggtaagcagggcctcggggagaaagcatggcctcaggaggttcttgttttcctctcctctgagcaggaatggggctgggggcagggctgcagcaaaggtcagactgacagccagctgggcctgccagctcgagcaccttagatttgtcaccatcttgttgccgtgtgttcccataggcttggggtttggaacgtggggaagtctgaggagtcatgtgaccctgtccttatctgccctgttacctgggacagggacccagggcttccaagctctcctcagctctaaagagaacagttgtagtcgtttaggtgaccggaagggtcgcctgtgaccatgtgtgtaaatgcctcccacagcgcctagcagacactgtgatgagagcaggccactgagtttgtgatcgttgcttaggagggccagggacgcaggtcactagaggctgagcgtaaaacaggtcagtgagcagtctaggaaggagggtgtggcgtttggggctggactctacccaggccgcggccccgcagagggtttcgacacaggaggaggagtaaggcaggaaggtcaccacttctagcccctaccctctagctgagttcttcctgtcaggaacctgagcccctgtaggctaccccatgctagggtaatggcagcttgcgtgagggcccctgtgttacagttaaacagccctggggccctggagcctctagggctgggttccttgccagttggcagggacagtcagcagagcagccttgcccccagcttgttgagggggtggctagcgctgagctggctgcatgccagcccccagcctctctacatgccttagctgtaacctggagcccggggaggagcttagagcacggaattctgctcctctccctggccttggaggacaggtgcaccccagggccacctcctgacttggctcagtctgcccagcccctccctgtgctgtgacgtgtttcggggctccccccacctgattaccccagtcgccccgtggagtcaagagttccaggcaggcgtttctagcttgcaccggcttcagcacagccctgtcaggaggaatgcagagccaggcaccctcacccctgagggaggagcccagagaaagcacttttagtctgggctggggacagggcagcagatgtgggaacctgaggaaggcagggcactgtccctgggaaattcccggtaaggccggtgctcactggtgaatggacaccctctctttgcagatgccctgctggcagacttggaatctaccacctcccacatctccaaacggccagtgttcttgtcagaggagcccccctactcctacccaactggaaaccacacataccaggagattgcggtgccacctccggtcccaccaccaccgtccagcgaggccctcaatggcacggtcctggaccctttagatcagtggcagcctagtggttccagatacgctcaccagcaggtaaggggtgtggacccgagaagccctcggggacttagggatgataggagctgatctaccaaggatgcgtcaggccactggagaactgaggtggggggtggggtggaggggatagacatacacagccatacacagtccttcctatgcaccatgtgagggaccagtgaccaagtattaatcacctgaccggcccgtggaaattccctgtgagacaggctgcgagcaggagctgcccgggggctggtgctgctcctggctgctgttcctgtctctcctcgggggacaggcctgattgttcttcccctccgcagcctccgtccccactgcccgtgtacagctccagtgctaaaaattccagtgcctccaacacccaggacggcgtgggctccctttgttcccgagcaggcgaggaagagcacgtctacaggtacagagccagcgcctctgccagcccccggcttccctctgggaacctctgggccgttggcttaactacagaaggcccccgaggcccctaccaggccctgtgcctgtcaggggccttggggctccccctgccacctcacagcggtgggtgggctgggctcccacagcatctgtgtagttgaggaactacagcaaagtttccttcctcctcgctcaccacattccttccctgccctccctccctccctccgcctccttgcttgaccaggaggcttatgacattctgcctcaggggcctcgggtggcagggggaccctctgctgctgcatccagcataaggaggagaggtctcatttctctcctctgcttctcgaagcttccccaacaagcagaagtcagcagagccctcacctaccgtcatgagctcctccctgggcagcaacctctctgaacttgaccggctgttactggagctgaacgcagtgcagcacagcccgcctggcttccctgcaggtacagctgggcatccaggccacccatgagccttcgggtccctgggggaccgagggatgagcaaccatcttggtttccttttttttttccccaagatgaagccgaatcgagcccccccttgcctggagccctgagccccctttatggcatcccagaaaataacactcccttggggggcaaagcggggcccctggtgaaagagaagccaaagcgaaatggaggccgggggctggaggatgtgcggcccagcgtggagagcctcttggatgaactggagagttccgtgcccagccctgtgtgagtattcactgggaagctcttgaaggtcctgcccagacaggctccaggccggagtgcctgtgacgtaaccctagagtcacctggttcccttaagtgcccgttacttgccgtaccagccatcaatcggcactgtgctgtgtgtgcggagcccgtctgtggttcagacggttgctaaggccccagagggctggaatcctggctgggccagttagtacactcagctctccagtctgtcttttcctctgtaagttggaataagccgaagtgaggcacggtgataacgtggtcacgagcccagcatctggggattcggggcttgggggaatcgcgtgttcaaggctagtctaggctatacactaagttccaggttggtctgaactgcacaagaccttgttttaaaacaggaagcaaactgtaaagtaggttagcagacagggatcacgggatgagacgacataggtaaatccagtgagaccatgtagtcccatgtgtgcggggggcctggttcatagctctgctgctcacaggatgctcctagtaatgttaggtcttgtctgttcactctgaggtagggtctccctccacagcccggactgttgtggaactcactacgtagtaagcctcttcttgccccagcctcctgcatgctgggattacaagtaggagccaccgccacccacacctgcctgtcttaatggtagctagcgctgactgatgtgtaataacctgacgtctatgtgcagcgctgtagaagggacctagtgggactccctctgtttgacaggggagcctgccttgccctgccctggcagaggtgtcttcctgtaagggtaccatgtgagccacctgcctttttcctctggtcacctccccttggcacggtctcagccagttgtactcagccagggatgggggtccctaaggtactgggtactggagacctgatcccctgtggagctagagtctggccccccgggctccccgctgacacagcacctgtccttgcagcccggccatcactgtgaaccagggagagatgagcagtccgcagcgagtcacctccagccagcagcagacccggatctcggcctcctctgccaccagggagctggacgagctcatggcgtcactgtcagatttcaaggtgccctgtgaccctccgtcctctctgctttccccccaccccccatccattcttcgacctcagttgagtagctggcctgtggctccacagcaccctgggggagagaggctaggcagtccgtgggcgagactgtgcttcttagcagccagtgaaggcagagaaaccagagcctcttttagctgggacattcctccctctcctggtgttcccagccacccaggtcaaggggatcaggaggcacggacacagggacaaagagccctgtgttgatggctgctcttgctggaggagggtgtgtcctgctgggcccgtgggatcaggatcccaagcctgagaggtcacttgccccagagctgcctctcccacgcttgctgtcctcagaacacccactttctttcagccagtgcagatgggatttacaggcctctgcagccagcctccgtccacactccactttgttctcccggggcctgagtccccagagcacagagcccttggcccatcagcaggaagtgtcccaccttcccctcccaggctctccaggcccaccagtccacggcgttttatttagaagatgtattgccttgatagggcttcatactgacagaactctccagtagctgctgacttcagctccatgtgtgtcagccagagacctctggggcgcagcttggggaatatgagaagggagccaggccgtatgtccactcttggcccagaaaggtgcctcctgtctctcttcagctgtatttttgcttggagctcagaggcgggagaatgggtgctggcaccgtccggacttgtaaaccttgttgcctggttctaagcagtgggaaagcaagttgggacccgcactagctgtattgccttaggcgttcatcccaggacactgcggttgcttccttagaccgtgtagcccagtgccactcaaggaaaagccacaccacttcttgctgagcactagagaggggatgttcccataaaggaaagcaggagtgggctgggtgggatggcccggtgagtagtgtgtgaagctggtgcccgtggccagcttcccccgggtttgcacttcgttgtaaatccccaacatgcttactctgggtgactttgtgagcatggctttgtggctggtctctgatgcctgggtctcctaaggtgcgaaggatacccagaaccagtgcagacaaacatttccgggcttggagcctttccagagaccctgcgccttagtgtcgcacaggtgtaagatggtggttctcagagcactaggccacatctgccccctgctcacctctccctgtttctctctcttcccctttgtctttcttctctagactagcacttctgctgtgctgctgagctcccaggggctgctgcccggctcttctccacccccgcccctcaccctccttcatcctcctcttcctcccactaactcctcccctggagaccacaccccagaggccctctacacagaaggaagtagtcaggtccttttaccttctgtggctcccagatggcttggtttgggtagtcctgaggagacgtctgacactcaaaactcaaggtatccttctgtggcggcttctcaacagtcacgtggtgcgaagagccaggctcaagttaggtgtggcctgatgggtgctgtgggtcccccctctaggactcccccatgccacactccataccctgcaaggagcatagggtccccggggccactggccaaccatgtgttttcagaggagactgtggctcccatttggggacagccacaggctctgacagcatccaggcctgagagtccccatggagtgacttacagctttcaggaagggcttgagccacccgccgtggcattagatcggcaagatatccttcctgacacctgggctctcaccaaggagtgtgccctgcaggagagggtacagtcagaaccagagggcctgggaagcacttgtcctgccgcaggggacaaggagccgctccgtgggaagactccccagaagggaagccttgggggacccactgaggcactcgggagcccagggaacccagaaggtaccactgaagccactctggaggccaggaaggagcagccggagccttcttatgccatggccgtggggacacccagcgtctcggagaggatttccacctccggccaggcaggcaccagcttgtgcggtcactaggcatggctctggcaggacttgagtgtgggccactccttgctaactgcatgctgcccttacaaatgcctgcctgggcagagagtgccaaaggatgatggtctaaagatatgcttggcggtgagcctgaggggccagccttgtgtctagtgatgttcgatctcctgcttcttaagatgtcctttagaggagctgacccggcatctcagtgtacagaacggtggttagatgcatgcatttgggaactacagagatccacacagcactctggcagctctcactccctatgtatacttggggaaccacccagaggctcagctttcccttctttaaaatgggagcactaatagcacactgtcccaaggtcatgcagagggttggctgagataagtcctggaaagtggagacaacccagtacatggttttccttccctctgcccccagctgtctgtcctgcctttgcctcctcagtgctgggactctagctgtgtgccaccacgccaggctcttccttgtttttcgtaggattctgactttacgccttcatcccaaaccgtttccgccaacagtacaaatgagtaagctttaatgcgtactataaactacgtacaaacactggctaaaagatgtaaagaaaagagaagcctccatctttctacttaagtagtgaggagagaggcgagggaggggtgagaacatcaggtgactactgtgtgaccccaagtgtgagtcaggagagccccgctggctccggctaaggagagcgtagctggcgtcctccgagtattttgtccacggttagagactgacttgggagtgagcgctaggccgtaggaccctcaacagccctgtttgcttcctgctttcacctgtctcagctggcctcttggttgttctgctttgacctctagtgtggcccaagtggcagcatcccaccttccctggaatgggatgggtgacagctgctttgtcctcctcccccagatccgctctgtgatcaggaggagccgggagacgggccacgtgcaccccatgtcccgggagccttcccctcgccgcaggctggaccctgccagcctgagcaggaacccatcccaggagcagctcattgctgagctgcagggccggctgggcatccagctggcggccgaggaggtggcagggacccccgagcaggactggctgacggaaggcgttgttatcaccgtgcagccacgtgggaggcaggccggggggcagctggtagagaaggtagccagccagccgatgtggcctggggagtgggggtctggcggttccctcagccctagtgaaaaagattttggggcggtggggtggtttctgcactgtattgccttacgacaaggctggccacatcaccccctccaccctcttttggctgctgagttcttaccttcctgtctctttcccctctctccttcctaggttgtctaccctcctgactctcccgttcccctgagaagaaccatctctgttgtggctccttctccccctgcccctttgctccaggatcaccctgacccttcgactggcagctctcctctcccacccagcctgcccactccctcctggccagggcccttggctgctgcttctgcttcatcttctggggtccagactgaaggggggaagtccccagaggagggtgggcgtggcccttctggtctcacctctgtgccccacaccgtgaggtctgtgggctgccagaccaatgaggacccactcttctgcccgatgcaggccggcctccaggcaccttgccctgcccgtgccctgtctcgtcccgagccacctcccaactctgaggatgctgcagaggtgtgcactcatgcaggcacggagggctccgtcctccatcctcagcccagacagtaactggagtccttccttagggtctgcctgaccctggtatctggcagcaccttagtaaaacacacacacacacacacacacacacacacaccacactggcccattcccttgggttcatcagctgtggaggtcatttcctcactggaaactacgaaccatctctgcccttgttggcctgggcattgtcagggcctcatgtctacccgtgtggttcaccccttccccctccccttcttctcctaggcctcctctctcaggttctctctctctttctctctccctcccccatctcttcacctccacccccacccccctcttgttttctgccattgccagtagggagaactcctctaactttgtgtgataatccagtggcgaggcctctctatctcggtttttaaacaatgccttctcctcttctcctctctttgccacctaagatgcagggcctggaacagagagtggatggagagcggccgtgggcagccggctggccccccagcagcaggcagagcagccccgaagggcaggacgagggaggggtcagtgcttgggctgggggctgagttcttgcttggcatgtcgcccctgggcttggtcatgcagctgggtgctggaagccctccttgaccttccttcggactgcctgcgatgtcaccccacccccaccccaccccaggggaccgtgtgccttttgcctccatcagcctgtctgttcgggatagaaagcctcatatgtgttaatgctgtgagttgctcacaccaggggccctggaaatctgaccagctctctgtgtccacagttcatggcccaggggaaaactgggagcagctcaccccctgggggactctccaagcccgggagccagctggacagcatgttggggagtctgcagtccgacctgaacaagctaggggtcgccaccgttgccaaaggggtctgtggagcctgcaagaagcccatcgccgggcaggtaagcaggggaggtgggcactgaacaccggggcctgggctccggacctcaccagagtgactctgtgtgcctgtcttgtaaggtcgtgaccgccatggggaagacatggcaccccgagcactttgtgtgcacccactgccaggaggagattggatcccgaaacttttttgagcgggacggacagccctactgtgagaaggactaccacagcctcttctccccacgctgctactactgcaacggacccatcctggatgtgaggctcctgggccctgtctgctcctttcatctcctggggttggcagtcctctctctgagccgtgtcagccaggcttacccaggcagaaagtggtagggtaggcctgagagtctgacctggcggctcacagcagcccagaagtgttaggtggctccccctcccatcctggagtcctggtgtgggaggcccaggcattaggagcctgggtgccgggtgtctcccttctcacaatctgggatgttacttataaaataggagtcacaatcaatccggtgaacccgtgagtttgagctcaaagtttgaggagagagatgtgtatgtgtgtctgtcggttggagatgtgtgtgtctgtcagtcgtatccctcagcagctctgagtacttagtgtttgcaattaggaaagagccctcttccattggctatgagcagggctgaggttggaaggagagccttgtccatgcgcctttttttttgctttcacagaaagtggtgacagcgctggaccgcacatggcacccggaacacttcttctgtgcccagtgtggagccttctttggtccagaaggtagggtgacactggaagggcctgcctgccatgctctgggaggtctcagaaggaggtagggtgacctcgccgatggtgggctcagggtggctctgggtctacctctgaatgccaccggcttccgatcctcaggcttccacgagaaggacggcaaagcgtactgtcgtaaagattacttcgacatgtttgctcccaagtgcggcggctgcgcccgtgccatcctggagaactacatttcagccctcaacaccctctggcaccccgaatgctttgtgtgcagggtaaggggcacctccattcagccagagggcctgggagcaggcgggggggggggggcaggggtgagtctctcctgtggtgcctgtgttcaaggctctctgcaagcgagcaagcgagcagggctggggtatgtgtatgtatgctccttcatgtcccaaaagtcctcagctggggtcgagacaaggagccaggtagaggtgttcctcgaaagctccagtgtgcaggccttaggactggtcacactggacagagcatgtgacgatcagatgacgtgtaataaatcctgagactcccggtggggagcggactgtgcttctcagctggtctgtggggtaacagggccctagcgagggcttctggaccagtaaacctgggaacacttgctataggctcaggcctttcacacctgcgtgcgcacactaatcagcaaatggggatccacagtgtgaaatgtaagctcagctctcctctccccgtcctttttaaaagtgtgcccgtttctggctacaactgtatgccgccccccccccccccccccgtgtaaatccagaactcacacctctgactaggctgtccgcggagcagtgagcacggctggatcacatcacgtacagaccttcttccttcaggagaaagttgagggtgtagcctagctcacaggaaccgatgagcaagcagcggtccttacaagggtgacaagggtcctttgggcgtcagccaggacagttcccaagcccctctcgctcctcttctgcccgcaggagtgcttcacacccttcgtcaacggcagcttctttgagcacgacgggcagccgtactgtgaggtccactaccacgagcggcgcggctcgctgtgctccggctgccagaagcccatcacgggccgctgcatcaccgccatggccaagaagttccaccccgagcatttcgtgtgcgccttttgcctgaagcagctcaacaagggcaccttcaaggagcagaacgacaaaccctactgccagagctgcttcgtgaagctcttctgctaggccggtgcctgccctccccgccttccccagccagccagtgccgccacgcactgctcgcttggggccaatccaccaatggaaactggaacctcaccccctcagcaggcacaggcgcaggacaggactccgggtcggtcctgcctgtctctcgtccctaccacctgctaaaggggcctcctcccccttccgtggctctcctgggctctgtgcacttcatcttccccagaggtggaagctgctgcccagttgtcccgtggatgtccctaagagccagcacctcacactggagcctttgacagtcacctttccacagtgtggtcattgggagggcagagagggtcagctaggggctctttttatccttctccactgtattggggacaccgggccccactagacaatgccagcataaagtcacccatgggccatcaaaggcactttgggtgccaccacccagtctcccagagtctgggtgactgccccgtttgtaccggccccggggtctctgagaaagcctcctccagcaataaccttttatatagacacgtgcttcatctctggggacggcgtgaggtgggagtgtcacccgcccaggcctcaacactgtaccaaatttgatagatttctacactgaggttcaacttcgtatggctcaagttgcttttatgtatctccacaagatgattttgaagagatttaaagaactcccccttttgtactctggtctgtccttgccgctgggtcagcccgtggcattggttttggtatggactttgctttgtacgagggggaaatactttgtatctttatgttatttcttagcacaatgagctgggagcggcccttgacgacttctgaaacctcgcagctcccgggactgtttttaaactgctgtattttcaaacccttccctcactgcccaggccaacgggctcttcattaagaactactctaagaatgtccagccctttggacctggagttttgaacctcacgtgtcctgttcccaaggcaggcaaaggggaaagacatatttgggggtctgcttcctgcctaagtaagccatctggaaccagcctctgctccctgtgaaattttttttggcgacaaggagaaacccctgaattttctcagcctcctcattgcttctctggggctcgctcttcttccttctcaggaaagccggtgtctgattttgaccaggaagatggtaaagggtctctggtctccactccactgggcgcatctctccctccctcaaacttcctgtcagctgaccggggctaaggctgttccctttcacaggtggggtttgtgttggggggctggggaagggggtctgagaatgccccaagctggaacaggggagcctggtaggagttggggcagagggacaagatccctattagagtaacgaaaagtcccagagctcccagtccaaaggatgagatgggagcagccagcttggaaatggctggggaaaaaaggcgtctggaaaagggattccagacaattccataggcaggggacctacaccttacatcagcttcccagtagaggaccagcgtgatggggtcccagacaaggatccccagtcaaggtcagctctggcagtggctgcagacaccggcacttccacccacaggccttactgctctgtttacagtgacctgctccagcccccctcccccttcaagacgaggtcggggtatctggagggccattctctgggtcaatggatctgtgatcatttgattcccctcccccttataaacttttaacctggcttttctcatttcaactcctgtgatatatgccaataaagtttgccatgattttcacccgagctgatgttatttcttgggactttgagctagttgccacagcagagaaactagaacctctctagactcagcagactcatacagaggaagcagatacttgctgttctcttcctggaggcccagagagccagagaatgggattctcggagcttgcttgtggccataggtccttctgactccagcgtgaactttacctacctagcctagggagtactgactgcgccccgcaggggcaggtcctactctagggctatcctgtggattcacggagtgtgtctccctgtgggcctgttgaatgacttccactcactgatcatggagaaagaacagagtggaaatcccaagttccagagaactcaccttcgtctaactcatcctttccctatggaatgcccgagacttcctgctgctgctcactctttactgcccccttgtggtcatgtccatacatgcatgctttttcttgtcagatcccagggcccctacgttggatggatggttccattttgcccaaagctgcagtttcagtcccctgtcctttagagcaggtctccaggcagcacgggaaatggtattctgggtgacgactccaatacggcgagcttgacacccaatcagagataatgacttggtttcttttcccaaccctcatgtccccgtccttagagaagtatggttggctttctcggtaatgttttacgaataacttcccgtgccactggttatagatttgcaccgtttctaatggcttcatggcatggtgattgtagtggctattcctggttgtcaatttgactatatttggaatgaactacaatccagaattggaaggctcaccagtgacccttatctggaggcttggagatagaagtttctgatctggatcttggtatggagatcttttttttttttttttttggtttttcgagacagggtttctctttatagctctggctgtcctggaactcactttatagaccaggctggcctcgaactcagaaatccgcctgcctctgcctcccgagtgctggggctaaaggcgtgcgccaccatgcccggcctggtatggagatcttgaggcctagtggctatggattccagaagattaaatctccgagtttaaggtcatctgggattaaagatgtggtggaacacatctttaatctgggctacacctttcatctgggattaagaggtgtggtggaacacacctttaatctgggctacacctttcatctgggattaagaggtgtggtggaacacacctttaatctgggctacaccttctgctggagacaatataaggacattggaagaagggagtcttgctcttgctctcttgcctgcttgccgtgtgtgactgagctagatccttggactcccattcacagctactactgaaccattgttgggaattcggctgcagactgtaagtcattaataaattcctttactatatagagactatccataagttctgtgactctagagaaccctaactaatatatattggtgtacgacagttagggtatttatagtgtcagagtcaggatgtctttggaaatgtaacatagccattatgtatgcacttggaaaagtgtgtttagagaaagagagacatggggtttggatttgactgtggagcacagtggggcccacacagtggcctttgaacctgtttctgcagccttctgaaatcatcaggtgatttaaacactctgggcgctttcttgtggataaagtattgcacctcaggacttggggggtggggatggggtgacggtggtagcttcaggaacatgcaccagcacttagtgctgagcatggggaatccttgtcattaaagagcgacctcagcagccactgatgcctgcagttctcaaactgggctgatcttcaaaggcaccaggaagctttaaaacaacagactgcttgtttagcatgaacaaggccctaggttcaatatcttcccccatatatacacacttatttatatatggatatttatttattcatgggtctgggaagatggctcagcaattaaaaacaaggcaggagtgagactgtctcagtaaaacaattatccaaataatgttgaacgactgtgtgtgtatatatataatgtgtatatatatatatatatatatattatatatatatatatatatatatatatatgtgaagaagctagttttatgtatcgattttctcccgtatccttggaagggaaagcaaacggtcaataaagtggaagtgctttttaagacaacacagcaagcggcagaacaaagttatggatccgggtctcatctggccgcatgccctgcgttttgcctgctcaacaaatacttatctgcccactgtctggcaggcacagaataaaatctctgccctgtggagcttaccttcctgcagggagaggctgacaagcagaatgtggtgaattatacagcgagttagatggtgtaagtgctgcaggagaaggtgggagagtaagggagagtaggtttggttttgcccccgcccttaaaatttgaaatcaagaatcagggcaggtctccttgagtagatagcatttgcagcaagatgtgggggaggtgagtttctctgaccgaagctggccagcaccattcaaaaagctgtgaagccggtggtggtggcgcacacctttaatcccagcacttgggaggcagaggcaggcggatttctgagttcaaggccagcctggtctacaaagtgagttccaggacatccagggctatacagagaaaccctgtctcgaaaaaccaaaaccaaaaccaaaaaaaaaaaaaaggcatactcttgaaggggataaaagggcaaagggatcaggtgagaggcaaacacatcagtaggaaagcaagaaaacagattgcgacagtggaaacagtcgtgtgggaccttgagaatagtctacgttttaggcgtttactcagagaaaacggcaatctttgattaactttgtgcgggtgaagatgtaggttttgaaaggaagaacaaaacgggcagtggtggcgcacgcctttaatcccctttaatcccagcacttgggaggcagaggcaggcagatttctgagtttgaggccagcctggtctacaaagtgagttccaggacagccagggtatacagaaaaacctaaaaaaataaaaaataaataaattaaaagaaagaaaaaagaatggaagaacaagaggagactagagcatcagctagggtttcgcagaaagttgttttgctgtactgactcggtgacgctgcagggcggctccgacccagcagagggcagcaggtctgaaagcgcgcctcctgcggccgggtgctgtctttactttcccgacttgctggagtggcagcggtctcagccaatagacgcgcatgtttattgagtgaggcaggacagtcgatggaaccagccaataggcatggacgacgtcgtcttcgggtttcgaggcccgcctggttctcctataaaaggcacacgcgggcatgcggcccgtctctcgccaggcgtcctcgttggaggttggggggttgttttgttgtgggagggcggcaagagcgcggggacgttgcgggtgggagcgatgggctcgggaaggatcgcggccgggctctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggcttccgcctccgggtcttcccggggcggtcgttggccacgcgctttaacagagtttgggcatcctggggaagttctgttgtcttgggatctccccccccccccccgttccagaactagctcgctcacccagtttttcatctcgtcgagcccttcgcgtttgtgcaaagggctgagactggagtgattcatcttgttgcccatctgagacctgccagtcaggctgctgttgagtgacttaattacaaaaggcctttgaggtggctttgaaccagagctaccagactttgtaggcaccagtctgttttagttaacttttttcttttttttttccgagacagagacaaagatttttgggtctggtagtaccttttatatttcacaacctaagatcccccgacctctctataacttgttttctgtgctttttaagtctgtctcttccctgatcagagtcacgttggtcacccaggcacgccttatttaaaaagtaaaacttaagatttacttgaggcaagtcttccccctatagctctggctggcctcggattagcaattaagccttacctgtctttacaggtgtggcaccacacccagctaaaagttaatttttggctgtgacagtaattttgcgctactcgtaaccagcaagtaagctggatcagataaagacagacgttgggctcgtgtggctggctcctatagagaagtgtcacaccctagggtgaagcaatggggaggtagaggtagcagggtttcgggttttgctgggtattttttgtttgttttcctctcaatgtagttttttctggcttccttcatagcaacttttggatgattatccaaaatgcttcattgtgggagcagacaatgtgggctccaagcagatgcagcagatccgcatgtcgctccgagggaaggccgtggtgctgatgggcaagaacaccatgatgcgcaaggccatcaggggccacctggagaacaacccagctctggagaaactgctgcctcacatccgggggaacgtgggcttcgtgttcaccaaggaggacctcactgagattcgggacatgctgctggccaataaggtaaggggctgggacgatgaatgagaggatttggccgtttcggggctttccgatggagaggcacttcaccgtcgactacctctgttctgtttaggtgccagctgctgctcgggctggtgccatcgccccgtgtgaggtcactgtgccagctcagaacactggtctggggcccgagaagacctccttcttccaggctttgggcatcaccacgaaaatctccagaggcaccattgaaattctggtgagtagatggcctgcagtggtcggtcctttgggctgggcctcctgtgtgtccagatgataactgtcctgctgttctcttcctcagagtgatgtgcagctgataaagactggagacaaggtgggagccagcgaggccacactgctgaacatgctgaacatctcccccttctccttcgggctgatcatccagcaggtgtttgacaacggcagcatttataaccctgaagtgctcgacatcacagagcaggccctgcactctcgctttctggaggtatgtctgcccagctccttcctcccatgctgagtgtgacaacagattcgtgctggcatcttcagttgttccatcttctcatctgcagaaaatagagttgggcaggaggtcatgtgctgggactctaaaggttgttagcctgtgatagcaaaacactgcctgtgggggctgtgtctaatcccagcggaggcaggcaccctcttgtgagtttgaggacagctaggtctcaaacaaaatagaacattgctggtcggtgagattttgagtattgagtcaaggagagatgaatacaatttaatgctaacaatttaaattgttattactctatctttttaaagactgtcccacaccaggctcttgccattaaattgaccttttttttttgttttttgatttgttttgttttgttttgaggcagggtttctttgtatagccctggctgtcctgggctttgtagactaggctggccttgaactcagaaatcctgcttttgcctcccaagtgctaggtttaaaggcgtgcaccaccaccgcccagcttaaggaaaattgtttccttgagtgaataacttactgaaattagacatgcatctatagatttagcattttaatcttaacattttttgagttatttatatagtttatatttctaactccaaccatgcctacccccactcataattcaagattgggaaaaggtttcattactggtaaatcacatctggaaatggattaatattctaatagtgctcagtaactaggctaacagcgtagattttcagaagtcactgtaaggaatattgaacagccaggtctggaggaagggtgagcacaaactgatggctcttgactctgccccggcttgaggctcttgactctgccccggcttgagactgaactgaggcaagctaaaatgtcattcttatctgcacacagggtgtccgcaacgtggccagtgtgtgtctgcagatcgggtacccaactgttgcctcggtgccacactccatcatcaatgggtacaagcgcgtcctggcattgtctgtggagactgagtacaccttcccacttgctgaaaaggtaaggctgtcctttcaggaccacagaggcctgacgggttggcaagtggcagtctgctgagttagtgtattcatgctatgtcacacagtaggtaccttgtgagacaagacagggtttcatgtagccaaatctggtctttttttttttttaaagttttattatttatatgagtacactgttgctgtcttcagacactccagaaaggagtatgaaatcccattactggaggttgggagcttagattttcagaattcccagtcactgcttttaaccactgagccatctctccagccccaaagctgatcttaagctgtagttgggtgaccttgaatcctggttggggcttgttactagtaccagtgcttccccactaagccagcaccttaccaactaagccgttaaaccaagctccgtgtcctgtttggtattgggtgaaaactggctagagtctgccctgagctagtcagatcctttgttaataaaagtggggggaaatgcatattagtggaggcatgcatgctctcattttaaaagactagacccctagagctgggcccaagtgtccagccagcaggctatgctcagaaagaacccctggtgggtaatctcactggaaagctgccgcaggacagtcagttcttagcaggaagagtgtaggtggtagaactgtgatcatgctgactgccttttctccctcaaggtcaaggccttcctggctgatccatctgcatttgcggctgctgcccctgcagctgctgccaccactgctgcccctgcggctgctgcagcccctgccaaagctgaagcaaaggaagagtcggaggaatcagatgaggatatgggattcggtctcttcgactaatcccgccaaagcaaccaagtcagcctgcttaatttgagaaagatggaaataaaggcttacttctcttaaaactcggtctggatttatttagtttgttcacttaagcaggatgaaaaagcaaaaccgctactgtttactttgtgttggcatctttgtttctaaaattaaagctcctagtgtttttgtgggctttgtttgttttttgagacagtctcttgacttggtgccatagctagtctgggacaaagattttccaggtgtgaattaaaggtgtatgtcatcaagccccaagcctggcctttatattcctatggtagtccatgttggatatatatcatatgtatacataatatatatgtatactaagctcaatggttaagagacctatgagccataccaaatctatatggtttggtatctgggtctgctttctgtatatcactggatgtccaagccattgttcataggtagccttactgctccaaggcagagtgatgcaggtccagagccctgttgcttaaggctgaggcaggggtagaaggctgggtttgagctaggcgtggtttaaggactgaagtctgagagggcctgagatggtgatactgagctatggcaaggagtatccaggtgagtggtgattgaactcgggcctgattgtgccttttgagatgaggattggtgtagaagttgatctgcctcagccttctgcctgcagtaattgagtcactgctgtgtgtttagtaatgaagttatacttgtgtttgtgtagtttagatgtgtagttgagtttccacgtgctggctaaagttttttcttggtagattaagtcttgaatacaggggcagttaataactagccactaaggtgtgcatgtagggttgctttgatgtactaatcgggggtgcaaactagaataacttgctatgtaaaaagctgctgcaagagctaaaatactgcctgtgcatcacaggtaactagacaaaaagttaccctagaattgcaacctctaacccgatagtagtttgatgttggttcatataggcattcagtaagtgttaagtctgaaaagctgaggattttaaaaatgggctctaacaagtaggtgaatactgtatcaaatgcaatgccctattgctatcatgaacctttgtgatgtcactacacatctatgtgtgtgtatatatatatatttttttcttctccctcccccaccccccagggtttctctgtgtagccctggctgtcctggaactcactttagaccaggctggccttaaatccgcctacctctctgccttccgagtgctgggattaaaggcgtgcgacaccacgcccggccccccatctgtatagttgccactgctgagggccaagaagcctggagaccgcattctccaagcacactcttgagt

SEQ ID NO: 902 - DNA, 2377 bp, Mus musculus
atgccctgctggcagacttggaatctaccacctcccacatctccaaacggccagtgttcttgtcagaggagcccccctactcctacccaactggaaaccacacataccaggagattgcggtgccacctccggtcccaccaccaccgtccagcgaggccctcaatggcacggtcctggaccctttagatcagtggcagcctagtggttccagatacgctcaccagcagcctccgtccccactgcccgtgtacagctccagtgctaaaaattccagtgcctccaacacccaggacggcgtgggctccctttgttcccgagcaggcgaggaagagcacgtctacagcttccccaacaagcagaagtcagcagagccctcacctaccgtcatgagctcctccctgggcagcaacctctctgaacttgaccggctgttactggagctgaacgcagtgcagcacagcccgcctggcttccctgcagaaaataacactcccttggggggcaaagcggggcccctggtgaaagagaagccaaagcgaaatggaggccgggggctggaggatgtgcggcccagcgtggagagcctcttggatgaactggagagttccgtgcccagccctgtcccggccatcactgtgaaccagggagagatgagcagtccgcagcgagtcacctccagccagcagcagacccggatctcggcctcctctgccaccagggagctggacgagctcatggcgtcactgtcagatttcaagatgcagggcctggaacagagagtggatggagagcggccgtgggcagccggctggccccccagcagcaggcagagcagccccgaagggcaggacgagggagggttcatggcccaggggaaaactgggagcagctcaccccctgggggactctccaagcccgggagccagctggacagcatgttggggagtctgcagtccgacctgaacaagctaggggtcgccaccgttgccaaaggggtctgtggagcctgcaagaagcccatcgccgggcaggtcgtgaccgccatggggaagacatggcaccccgagcactttgtgtgcacccactgccaggaggagattggatcccgaaacttttttgagcgggacggacagccctactgtgagaaggactaccacagcctcttctccccacgctgctactactgcaacggacccatcctggataaagtggtgacagcgctggaccgcacatggcacccggaacacttcttctgtgcccagtgtggagccttctttggtccagaaggcttccacgagaaggacggcaaagcgtactgtcgtaaagattacttcgacatgtttgctcccaagtgcggcggctgcgcccgtgccatcctggagaactacatttcagccctcaacaccctctggcaccccgaatgctttgtgtgcagggagtgcttcacacccttcgtcaacggcagcttctttgagcacgacgggcagccgtactgtgaggtccactaccacgagcggcgcggctcgctgtgctccggctgccagaagcccatcacgggccgctgcatcaccgccatggccaagaagttccaccccgagcatttcgtgtgcgccttttgcctgaagcagctcaacaagggcaccttcaaggagcagaacgacaaaccctactgccagagctgcttcgtgaagctcttctgctaggccggtgcctgccctccccgccttccccagccagccagtgccgccacgcactgctcgcttggggccaatccaccaatggaaactggaacctcaccccctcagcaggcacaggcgcaggacaggactccgggtcggtcctgcctgtctctcgtccctaccacctgctaaaggggcctcctcccccttccgtggctctcctgggctctgtgcacttcatcttccccagaggtggaagctgctgcccagttgtcccgtggatgtccctaagagccagcacctcacactggagcctttgacagtcacctttccacagtgtggtcattgggagggcagagagggtcagctaggggctctttttatccttctccactgtattggggacaccgggccccactagacaatgccagcataaagtcacccatgggccatcaaaggcactttgggtgccaccacccagtctcccagagtctgggtgactgccccgtttgtaccggccccggggtctctgagaaagcctcctccagcaataaccttttatatagacacgtgcttcatctctggggacggcgtgaggtgggagtgtcacccgcccaggcctcaacactgtaccaaatttgatagatttctacactgaggttcaacttcgtatggctcaagttgcttttatgtatctc

SEQ ID NO: 903 - protein, 566 aa, Mus musculus
ALLADLESTTSHISKRPVFLSEEPPYSYPTGNHTYQEIAVPPPVPPPPSSEALNGTVLDPLDQWQPSGSRYAHQQPPSPLPVYSSSAKNSSASNTQDGVGSLCSRAGEEEHVYSFPNKQKSAEPSPTVMSSSLGSNLSELDRLLLELNAVQHSPPGFPAENNTPLGGKAGPLVKEKPKRNGGRGLEDVRPSVESLLDELESSVPSPVPAITVNQGEMSSPQRVTSSQQQTRISASSATRELDELMASLSDFKMQGLEQRVDGERPWAAGWPPSSRQSSPEGQDEGGFMAQGKTGSSSPPGGLSKPGSQLDSMLGSLQSDLNKLGVATVAKGVCGACKKPIAGQVVTAMGKTWHPEHFVCTHCQEEIGSRNFFERDGQPYCEKDYHSLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQSCFVKLFC

SEQ ID NO: 904 - DNA, 75252 bp, Homo sapiens
gtggacccactttaaaacaaacaaacaaacaaaaaaaccttatctttatcctaaacaataatattggagctgggccaggcgcggtggctcatgcctgtaatcccagcacattgggaagccgagggaggtggattatgaagtcaagagatcgagaccatcctggccaacatggtgaaaccccatctctactaaaaatacaaaagctagccaggcatggtggtgggtgcctgtagtcgcagctactcgggaggctgaggcaggagaatcacttgaacccgggaggcggaggttgcagtaagccaagattgtgccaccgcactccagcctggtgacaaagcgagattccgtctcaaaaattaaaataaataaaataaataaataaataatattggagccatcacaggttttatgtgctaattagataattttctaacacataaatatgtaactattaaaataaggaatctggccgggcgcggtggctcacgcctgtaatcctagcactttgggaggccgaggcgggcagatcacgaggtcaggagatcgagaccatactggctaacacggtgaaaccccgtctctactgaaaatacaaaaaattagccaggcgtggtggcaggcgcctgtagtcccagctactcgggaggctgagacaggagaatggcgtgaacccggggggtggagcttgcggtgagccgagatcgcgccactgcactctagcctgggcgacagagcgagactctgtcttgaaaagaagaaaaaaaaaaaactgagctgggcatggtggctcatgtgtgtaatcccagcactttgggaggtcgaggtgggaggattccttgagcccaggagtttgagaccagttgggcaacaaagtgagacctctctgtgtctgcaaaaaatacaaataaaataataaatctttgtactagctacaacctctcattccaccagtggcagttagtcacactacatttgggagaattatgcctgggaccaccctacagtgttgcatgtcaactcagtactcatgaaatatacatgatatatttatctagatacagcagttatagaccacactttgtcaacacatagtaaacggactaacgcgacacttaacctcacacttccactccttaagaactgatctgcaggaaatcattaaggaagtgttccgagatttaactataaggatgttgtcctagcattgctgattatagtgaaaatttgtaactaactaaattttatcaggagattggctaagtaaatcctggtacaattatatgatgcaatgctgttttacccaaggaattgatgtttcagaagaatgttaaatgccatgaaaagatgatcacactggactggccacagtggctcatgcttgtaattctacctctttgggaggccaagactggaggactgattgagcctaggagttcaagaacaggctggacaacatagggaggcccccagctctacaaaaaattaaaaaaaataactagatgtggtggtgcacacctgtagtcccagctactcaggaggctgaggtgggagggtcacttgagcctgggaggtcgaggctgcagtaagccgtgtttgcaccactgtactccagctctgggtgacagagggagaccctatcccaaaaaaaaaaaaaaaaaaccccaaacaaaaaacaaagtagtgataaatgggtaaatgagaaaaccaagtttcaaaacagtgtgcaaaaatattcaaatatatatttaatgttttatatctaaaaacatatatgtgtatgttttttgtgtgtaaaagaacgctctggaaaatctacaactggtcattcttttagttttggattatggataattttaattttcatcttagtttattcattttaaaataagttttttattttaaaagatatctgtaggtctgaatctgaaaggaaatccaataaaaaataaaataaaaataaagaagaggtcttactatgttgcccaggctggtctggaactcctgagctcaagtgatcctcctgcctcagcctcccaagtgctaggattacaggtgtgagccactgtgcttgtccatttattcgagtttttgagacgttttcccacaatgaccaactattggttttgtaaagaaaatgtccacacgtatattataagctctggaactgactcttctagatctgcttttattctctctctctctctctttttttttttttttttgagacagagtctcactctgttgcccaggctggagtgcagtggcacgatcttggctcactgcaagcctcccaggttcaaacgatcctcctgcctcagctcccctagtagctgggatgacaggcatgtgccaccatgcccaggtaattttttttttctttttttttgagacagagtttcgctctttttgcccaggctggagtgcaatggcgcaatctcggctcatagcaacctccgcctcccgggttcaagccattctcctgcctcagcctcccgagtagctgggattacaggcatgcgccaccacgcccggctaattttgtatttttagtagagatggggtttctccatgttggtcaggctggtctcgaactgcggacctcaggtgatccacctgcctcagcctcccaaagtgctaggagccgcgtgagccaccgcgcctggccggtaatttttgtatttttagtagagacggggtttcgccatgttggccaggctggtgttgaactcctgacctcaggtgatccacccaccttggcctcccaaagtgctggaattacatgtgtgagccaccatgcccggctgctttttttctcttaacctctttcttcccaactttagttaatgcagtgctaaggctaattcattaagtgtgtgcttaataaatgttattcacccaacacatctttattgagcacctgttgtatgccagcactgggatagaacaatgagcaaatggtctccacctttctgaagcctacagtctagtaggagacaaacacaaataacaagttaataggaatgattattattactatttttgagacagagtctcgctctgtcaccaggctggagtgcagtggcgcaatctcggctcactgcaagctccacttcccgggttcacgccattctcctgcctcagcctcccgagtagctgggactgcaggcatgcgccaccacgcccagctaatttttgtatttttagtagaaacggggtttcaccatgttgtccaggatggtctctaactcttgacctcgtgatctgcccacctcagcctcccaaaatgctgggattacaggcatgagccactgtgcctggccggaaattattattattattattattattttattttttatttttttgagaggagtctcactctgtcacccaggctggagtgcagtggcatgatctcggctcactgcaagctctgcctcctgggttcatgccattctcctgcctcagcctcctgagtagctgggactacagacgcccgccaccacacctggctaattttttttttttatatatttttagtagagatggggtttcaccatgttagccaggatggtctcgatctcctgacctcgtgatccacccgcctcagcctcccaaagtgctgggattacaggcatgagccaccgtgcccggccagaaattatttaattataatcatgatgagtgcttctagaatgctaaaaaaaagattttatttatttttatttttattttttgagacggagtcttgttctgttgcccaggctggagtgcaatggtgcgatctcagctcactgcaacctccacctcctgggtttgagtgattctcctccctcagcctcccgagtagctgggattacaggtgtgtgccaccacacctggctaatttttgtatttttagtagagacgggggagtttcaccatattggccaggctggtcttgatctcctgacctcaggtgattcatctgccttggcctcccaaagtgctgattgcaggtgtgagccaccacgcctgtcccaaaaaaagattttaataacagggctgacatagttcagcaggtcagggaacagttttctgaggaaatgatttttaggttaaaacccccaaaataggccaggcgtagtggctcattccggtaatcccagcactttgggaggccgaggtgggcggatcacgaggtcaggcattggagaccaccctggccaacatggtgaaaccccgtctctactaaaaatacaaaaattagccaggtgtagtggcgcgcgccagtaatcccagctactcgggaggctgaggcaggagaattgcttgaaccctggaggcagaggttgcagtgggccgagattgtgccattgcactacagcctgggtgacagagcgagactccatctcaaaaaaaaaaacaaaaaccaaaataatgatgacagctgacatttaaaactgtactgttcaatgcagtagccgctagccacatgtgactactgagtacttaaaatgtggctagctgggccggatgcagtggctcatgactgtaatcccaacactttgggaggtagaggtgggcagatggcttgagcccaggagttcaagaccagcctgggcaacatggcaaaatctcatctctactaaaaataaaaaatattagccaggtgcggtgacatgtgcctgtagtcccagttacccaggagacagagatgggaggatcacttaagcctgggagattgaggctgcagtgagcctcagtctcaccactctactccggcatggacaacagagtgagaccctgtctcaaaaaaaaaaaaaagaaaagaaaagaaatgtggctatttggattgagatgtgctgtaagtgtaaaatacacattggatcttgaagacttcatacaaaaaagagtaagatatctcactgatattttgttatattgattacaagttgaaatgataacatttaggatttttttttttttttttgagacagaatcttgctctgtcgccaggctagagtgcagtggtgggatctcagctcactgcaacctctgactccctggttcaagtgagtctcctgcctcagcctcccgagtagctgggattacaggcacgtgccaccagctaatttttgtatttttagtagagatggggtttcaccatggccaggatggtcttgatctcctgaccttgtgatcctcccgccttggcctcccaaagtgctgggattacaggtgtgagccaccatgcccagccaacactgaggatatattgaattaaataaaatatattattaacattaattttatctattttatttatttattttgagatggagtctcactctgtcccccaggctggagtgcagtggtgtgatcttggctcactgcaaactccacctcccaggttcaagcgattctcctgcctcagcctctggagtagctgagattataggtgcccaccaccatgcccggctaatttttgtgtttttagtagaccaggctgttagccaggctggtcttgaactcctgacctcaggttgtttgctcacctcggcctcctaaagtgctgggattacaggcatgagccgccgtgcccggccatatatttttttattttttattttttgagatggagttctgctcttgtaagccaggctggatcttggcccactgcaacttccgcctcccgggttcaagcgattctcctgactcagcctcccaagtagctgggattacaggcatgtgccaccacacctagctaattttgtatatttagtagagatggggtttcaccatgttggtcaggctggtctcaaactcttgacctgaggtaatccacccatcttggcctcccaaagtgctgggattacaggcatgagccaccgtgcctggcctgtttcttttatttttttaaagatattttttagagaggaggtcttgctagtttcccagtttggactcaaactcctaaactcaagcaatcctcctgcctcagtatcccatgtaggtgggactacaggcatatgccattgcacttggctaaaaaagttttgattgggccgggcgcggcggctcacacatgcaatcccagcactttgggaggtgaggcaggtgggatcacctgaggtcaggagttcaagaccagcctggcccacatggtgaaaccccatctctacttaaagaaatgcaaaaattggccaggcgcggtggctcacgcctgtaatcccagcactttgagaggccgagatgggcggatcacgaggtcaggagatcgagaccatcctagctaacacggtgaaaccccgtctctactaaaaatagaaaaaattagctgggcgtggtggcgggcgcctgtagtcccagctacttgggaggctgaggcaggagaatggcatgaacctgggaggcagagcgtgcagtgagccgagatcgcgccaccgcactccagcctgggcgacagagcaagactccgtctcaaaaaaaaaaaaaaaaacaaaaacaaaaattagtcgggtgtgatagcgggtgcctgtaatcctagctactcaggaggctgaggcaggagaatcacttgaacccgggaggcagaggttgcagtgagctgagatcatgccgctgcactccaccctgggcgacagagtgagactctgtctcaaaaaaaagaaagaaaaaaaagaaaagttttgattgcatatccggcttgcattctgtttcttttctctctctttctttccttccttccttccttccatccttccttccttcctttcttccttccttccttctttctttctttgtttttttttttgacagagtctcactctgtcgcgcaggcaggagtgcagtggcacagtctcgactcactgcaacctccgtctcctgggttcaggtgattctcctgcctcagcctcctgagcagctggaattaccggtgcacaccactatgcccagctaatttatatatttttagtagagatggtgtttcgccatgtcggccaggctggtctcgaactcctgacctcaagtgatccgcccgccttggccttccaaagtgctgggattacaggtgtgagcctggtcgagttctgtttctattgctgagtgaagagtgttattttgtggtgacaaggaccattctaagtactaggtgtgtcgtttcttatttagtcctatgaggactctgagaggtagctactattaacctttctataggggaagaaactgaggcacagagtaaattgcccaagatgaaccactagcaagaagtcagcagggttgtccatctgctctgtcaatgtcgtttaatctttaggaagaatgaaaaaacctgattgattttatcaaatgcaagggactgaatgttcatatccttgaaaattcatatgttgaaatctaatctcaattcgatagtgttaggaggtgaggcctgacaggtgattaggtcatgagggcagggccctcatgaaagagattagttagtgcctttattaaagggaccctctttgagccgtgtgagggtacaaaaagtcaacagtctgcaacccagaagagggccctcaccagaacctgactgtgctggcaccctgatcttgaactttcagcctccaaaactgtgaaaaaataatttctgttgtttataagtcactcggtctacagtattttgttgtagcagcctgaactagacaccaagtttaattgctgtggggtgagagtccaagggaagaaggaagccagggaggaaatgggggtttaggaatgatttacatgaggaaatccctggcagggacctgagtgttcgagtgcaccagcactcaactctgaagcttcagttctctttagaactctgcatagcaatgggaaacttgcccattcaatgggtgcctcgcatttccagaccacacagctttgaaaaagaaaggttttagacctttggagaagtggacaagcgtatgccctggggttggtctaagttgttagcagtttcacttagccgtttcataaccaggccttggcataagcctccccaggttcaaatctcagtttccttacttattagctgtatgacctggagtaattcaacctctgactctcaactcttccagctgtaaaaggggctaacaatgctcatctcctaggcttgtggtcagtattaaatgtcttgtctacagacctttgcacatgctgttccacacagctgggagtggggcgaggctactcatccttcatgctaaccactttgctcttttgcgtgcacctttagattcaagaaggtagacatcatgttagtcttattcatcatcccagcctacgcaacaaagcaagactgtgtcttaaaaacacaaaaacaggctgggcgtggtggctcacacctgtaatcccagcactttgggaggctgaggggggcggatcacctgaagtcaggagttcaagaccagcctggccaacatggtgaaaccctgtctctactaaaaatacaaaaattagccaggcatggtagtacacgcctgtaatcccaccaggaggcaggagatcacctgagatcaggagttcaagaccagcctggccaacatggtgaaaccccatctctactaaaaatacaaaaattagccaggcatggtggtatgcgcctgtaatcccagcaggaggcaggagaatcacttgaacctgggaggcggaggttgcagtgagctgagattgcaccactgcactccaacctgggcgacagattgggactccatctcaaacaaaaacaaaaacacaaaaactaaaacaaaatagaggtatgtgcaagatgctggaaaaccacgcaatagagtgtttgaggaacagtctttggtcttgaatttattataggagaatgtggcagccacagaagctgcttggatctgcctttataaaatgactgaacatggtgggagcattggaacccggatacttctgcccaaggagacttctcattttttttgtcctggaattccctgatgggttgacctgtttgtcagatctgagtctccttgcccaaccctgcttatttccccttctctgtcacgggcattacccctagctttatctcagcatctcatctgctttctggaggacctgatctgacccagaaggcctggattcttgagggacaaggggaactcgaagctgtacttgcagagcagttttatataaaatccacaaactgccatcacccatcccaacgggtagggaagtacctctaggaggattaatttagagaatagctatatagtgtctgtctattcagacactcaataaatggtagttgttattattacccaatttccgagtgtgtgggagcactgggtgtgactttcctgtagttttccctttaatgtctaatctggggacccctctgccccatgcagttttggaaaagtgtctagggagggtggctgtgtggaagtaatattaagagagatggaaccacacaggtattgggtttgggccagaaagggtgaactgcgagctgcactgccattgatccagaggacgaccccaggaaaggtcagccacgggctccgggccttgcctggtactgatttatggtcctcctgggtggtgacctacaggtgacagacggacaggtgggcaaaactgactgtccagtggacaggcatgtgatgacccagtggctgacgaatgcacagacacatggctgactgtggacggatttgtcatccgcagggtcaggcaagtgactttgagagggacagaaagatggatgggagtggctggaggcctgggagccgcccacctgcccgcttagccgcgagggggcgccaccgccccgcccagcgacgcccactgcccgggctcttggcgggggcgggaccagcgtgcgcagggggcggggccagcaagctcgcgggggtgtccgggggcggggcgcgcgtgcacagggggcggccgggggcggggcgcgcggcgggcgcgggcgcgggcgcgcgcggcggcggcgcgttccgttccgggccgaggctcgcggcggaaaagttgcggggcatagacgagcggccccgggacgggcagctagcgcgaccctgagccggcgcccgtggtccggccatggacgacctcggtgagtgagcgggaggccgagggaggaggaggcgagaggcgcgcagcttggggccaggagggcgccagcgagcggcaggggccgcgggatcccaccctcggcggccccggcctcagctcctgtccctgccggccggggctccgcggggctgggatccctaaccgggccttagtctcgggccaggccggccccggcaccgaccgcacagcagcgaccccccgtctgggacggcttcacctctggacccccgacctcggggacccatcaccatctcccagaagggccccagggaccagcccgcccctcagggacccaccccgtccgctgcagggacgagacttcctgcggcagaccacctcgtcagctacgggaccctcacctcgcagacctctccccacccccacctcacagatcgaccgcccaactcggggagcagctgcccgatctcatgggctgctccctcatttcctcgacctgctccccgtccctccagggccgccccccacttcacagactagcaccccccttcagggataacccctcggagcccacccctttcatttcacaagtcagatgcaaaagctagagatgagcgtgtgatgaccacacccccatttcaaagacaagtttcccagtctgcctgctcttctgaccccccacttcaaatctggtcaccccgtttcaaggacccatcactcattttctctcactgacctccccgctctgtggaccagcccctcaattcacagaccagtccgtctaccatggtatctaagtctagaacggtaatttgggagtcctgattctctccccacccctagattctggtgaaatgccaggggaatgaggtggaaggtgggccccaaggtatgaccatccctgaacgtgtcctggctagcagagtcccctccaccctctctgcgtcaggccctgctggaagccacgcaggtgaaagaggacaggatgcccagaacagagttttactgttttcctgttattggagccccaaggctactcttttcagtccagtcttgatctggtgttaggggaaagaaagtatctcctggaagccgactctaaacccaagggggttggtgccagggttctaggaatgccttgggtggcgtgaacgcaggagtgggaggattcgctgtctctccctccccttcacgcctgtagctggagggccctgagcttgggaggtgaggaggggggcaacgtttcttctctgcaggagccttgtctttcctctctggactgtgggtggcttgtgtgaccactgatgcttcctctgtcccaggctctgaggagtagattcagcagacaggactgatggacctctaccaagcagcgccgggcactaagttaagactggctatttgtaggtgctggacttgactgcttccctccagcttccttttgggatcagggtgcccctgagatcctggagctggggttggtgtagggtcctgcctgttttgcagagtgagatggctgccaagcgtggttctgcctttgggtcaggcttggcacccatttttccagtgtgctcaaggttggcatggcttccaggcaggtatttttttttttcacataaaaatagctcagctggaaggaggctgggggatgttctttgaaccaggatctaagagtctgagtgctttcccagtgggaactgggagcaaagttacagtttctaaagtgctggtgcagttctgttgcttctcggcagtccccgtgctgtttcaaggactgagaaagtctttgtagagctcgccatcgaaatctggaattcctgtcttctgacagtcttccatttagggccaggaaactgagttctgaaaggaaagagagtactgtatacgggagaggggattgtagggatttaaattgctgtttgtggagtacttccctctacctcgatttgtgatatcctcacaacaacccttttatcagattccaccttaaagccaatgctgtcatgaccacctgcctttttacagattgagaaagccgagacgaagagaggctgattctcttgcccaaggctgcacagccatgaaatgacaaaaccataactggaagcccaattcctagctcccagatctgtggctcttgtataccgagaagactttttttcctggggaggaggcaagggcacttgaaggaggggttgccactgggtgatggcgatcacctgtaacttctactgctttctaccatagactcccagttgcttacatccgggctgcccgacttccttggcctgagctcccaaggggcaagccacgcctgactgaccggagcctggggtgggaggaatggggtgtgcaggaggggagaggaatttgcctttgcactggggccccgtcagctgtctggatggcggctcagcacactgccatcagctgttttccttagggtggctcagctgttttccttagggtggacacaaagcccagacctcttgtttttatttttctcctgagcgtgctctcagccgtgtgcctcctggtccctaacacaggggagagtttatggtgtgtccggtagcaaggccagagggtgcatcacctcctctgtgactttgttttttggtctaataaaaaatggggaactcttctccttcccatagttgccaatgacagactcaccatgtgctgcttaataagttacaaatttatagctctctgagcagaaaaatatcaacacagcgtgttctgcccttccctgtgtgttctctccactttgttctttggggtggctgcttggtggcttttcttattactgtttagatgctggtttggcccagagttcgctctgttcaagttctggccggagtttcctggacagagttcccacaacactgagatgcactctgactgtgttttctaacccgattgcttgctcttcctctgttcatgttctcagtgtacttggtgggggctttgaccacaactgtggtctaatcatgatcatgtgcgcttcatgggagacaggcactgtactcagcactttacgagctgtatcacaacctttcagaaagggaggtgttttcgctccactttatacatgtggaaacctgagctcagggaagtttagtggtagtgctgggatttgaacccaggctcatccaattccagatccggttatcttaatcatcataaggtggtaggtgctggtgactaaccagggggatgagccttggggcctgctgagtaattgatagttacctttaacaatctctgccctaggggcccatcccaggaaatggcaaagggtgtgtccagtgcaagactgggtagctttgccttcccatcctctagcagggggaacagccagctgttggcagtgcccagttgctgctggaatctggacatgtcttctttcagcttctcagcagtcttgaccctttggaaaacagtgcctcattgtccttgggggtagtgctaggggggcagaggagttgcctggggcattgggagctatggagcctccctgtttccatggaaagtctggactttgggctttcctgtctgtggtccctctgtgtgttagggcagagtcagggcacccagctgctgggcgtgtggcagaggcggcatttacccatgcagcgatagtgccctcctggtgggctctgcatcagtgccagaccttctcctgggcttgtgctagtaaggggcagagctgggattcaaaccttggtgggtttgattcttcagcgggtacactttctgatatgtgaagctgtctgctgcctgggcagacatagcttgatggagaaatgctcagcctactggaacccaaagccctgtcactataggttcaaggtcttttgagggaatatctcagtattccttttttccagcttccctagtgatggtcatgcattgaagagactgggtgtacccttggctggagaggctgatggaaggccagagttattggtgggccactgagcagccctcctctcctatttagtcatcctgcttggagtatctgactctgaagcttctcttgcgtctttacctcgctccagagatgttgaataaacttccagcctcattgcagcctttccggggatcatcctagtctcagtgccttcattaataataacaaaatctgccgggcatggtggctcacacctgtaatcccagcactttgggaggctgaagtgggtgcatcttttgaggtcaggagttcaagaccagcctggccaatgtggtgaaacccaatctctactaaaaatacaaaaattagctgggcgtggtggcgcgtgcctgtagtctcagctactcaggaggctgaggcaggagaatcgcttgaacccgggaggcagagattgcagtaagccgagatcgcatcactgcactctggcctagggggtacttttcttttttacagtgtttacagaactttttctcataatatttattgagctcttattatgtgcaggcactgtgctgggcactttacatgcattgtttgcttgaatcaagctggccatatgaggcaggttttattagtagtcgtattactactacctgttttataagtgaggaaactgagacacagagaggtgagcccacttgcccaagttctacaactagtgaatggcagtgctaggatttgaatccaggtggtctggctgctgagcgggacttgcagccaactgttttgtacacttttttttggagacagggtctgcagcctctgcctcccaggcccaagtgttcctcttccctcagcctcccgagtagctaggactacaggcatatgccgtaacgccccgctaatttttgaaattttttgtggagacagggtttcaccatgtttcccaggctgttcttgaacacctggcctcaagcaatgtgcctgcatcaacctcccaaaatgctgggattacaggcatgagccattgtgcctggtgcattctttacacttctgttcataatactgcatctgatatgggttgcccattggtttgactgttttctgtttctaggacactaacatttttctgcacccaccctattctctgttgtcttccacatctgtcatttccctgttctctgcagcttcttgtctgtcttttgttctttttttttttttttcctgagtttcactcttattgcccaggctggagggcaatggcatgatctcggctcaccacaacctccacctcccaggttcaagcgattctcctgcctcagtcccccaagtagctgggggcatgagccaccatgcccagctaattttgtatttttagtagagacggagtttctccatgttggtcaggctggtctcgaactcccgacttcaggtgatccacccgcctcggcctcccaaagtgttggcattacaggcgtgagccactgcacccggcctttttgttctttcttggggacacacactcaggatgggatgcagggtcctggggggagtgtctcctgttccaggggaggccccaatcctccctccctggtcacctctccagtcacctgttactcttgagacagagcagtgagcttacagcaccactgccaaggagaacctggggcaggtcccctgtggtcccttgccacctcctctgctcaggaatcagaagccttcctgtgcccccagccccgctgcacccgaacatgctccttgtctttcccgtatccagaggagggagttgttgaaaactttatggtggagaatgaaggatgtcctatgggagggggagaggaagagagaatcaggaagctgagttttctcagaaatgttcacaaagcaagtcatggaaatggcttcagggtgccctcctcacctgggatgggccctgagactccatcgacagcctcacggggtccactctgccttttgcagtctgggtcttgttgggagtctcatatctggccttgagtgtacattcataccctgataagtcttccaactaactaaccgattgcctaaccagtggtgctcagggctggcctctccagggaggccttggatgctgggccagtggtagacagaacatgcggttggccaggcccagtggaaccccagtggccaaatcttcccttaaagacggacttttaatgcttatttcttgtgtgattgtggtattgtggttttatgggagaatattgttattgttaggtgcatgctaaagtatttaggagtgaagtgtcatgatgtcttgcaacttatttttattttttcattttttatttttgaggcagagtcttgccctgtcacccaggctggagtgcagcagcgcgatcttggctcactgcaacctccgcctcctgggcttaagcaattctcctgtctcagcctcctgagtagctgggactatgggtgcatgccaccacacccggctaatttttgtatttttagtagaggtggggtttcaccatattgtttaggctggtcttcaactcctgacctcaggtgatccacctgcctcagcctcccaaagtgctgggattacaggtgtgagctaccccacctggcctcaacttagttttatttgtttttttttgtttgtttgttttgaggcagagttttgctcttgttgcccaggctggagtgcagtggcaccatctcagctcactacaacctctgcctcctgggttcaagcgattctgctgcctcagtctcccgagtagctgggattacaggcatgcaccaccacgcctggctaatttttttatttttagtagaaaccaggtttctccatgttggtcaggctggtcaggctggtctcaaactcccgacctcaggtgatccacccacctcggcctcccaaagtgctgagattacaggtgtgagccactgcacccagctcaacttagttttaaatgatataatgaaaaaaaggatatacacataaagggcagagagcacaagggccatgcgtttacacaaagtggtaaaacaatgacagccattcaatctaagtgagagtacccgggcctctcaacttctctgtgtgcttagacatttttataatgaaaagttggagaaaagtaaggaaaccctgcttttccatgatgggcttggagttgttgggcctaggtgctggcctgcgcctgcctatggttggcctgaatgactgctggtctcctgtgattgagcaggtggtgggaagactgggtgagcagagacagtagctgggggggcctcaggtgacagtgactgctgactatcatctgggaaatggggagcacagtgctgtgacctgtgcagaaaaaagacaggcccagagacagtgtgtgtccataggtgtggaggcagcctcatgagttatttgagcatgatgacattaatcagaccagggttgaagcatgtgagatgccgaactctggttggagtttgagatgggttgtctaggctgatgggatgcagagcaagacttttttttttttttttgagacggagtcttactctgtcacccaggctggagtgcaatggtgtgatcttggctcactgcaacctctgcctcccaggttcaagtgattcttgtgcctcagcctccgcagtagctaggattatgggcgtgcgtcatcacgcctgactaatttttgtaattttagtagagatggggtttcaccatgttggccagcctggtctcgaactcctgacctcaggtgatccgcccgccttggcctcccaaagtgctgggattacaggtgtgagccacggtgcccagccacagcaaggctttacataattcagggaacggtctctgggcagcttgaggcctgtgggcggggaggagatgtcttttgcctcacatcatgaaccccttatctgtggccagtggaacaccattaacctgtgggcagtgatggctgagtgtccccaggcttttgcttatagctcaagtctgaccatccagttttccagccttcaggctccccctcctggaatccccactcccttggtccctcctgtctagtttgtgctgactcaaagctggccctcttggacctccagtctgttttggggaaatagctggattctggcaccagtggccctcttggctctgaggcagaggtgagggccctggtgcctactagaaacatttcgggcagccagcaggctctcatgaggggagggcttcatgccaaggtcttctttcagcctcatgtcatctatgtcagcgtgcagagatgccgaggctggccacttggcgaggactatgaggtcttctagcgagggctcagagcttcactctgcctatttgaaagcagcatgatgtgtgttttatgggggagggggtgatgctgggaggaagctttatgtaattcttggctggagctcaggtaattgttttaatgaaatggaatgcagcttattcagaattcgcttggcagaaacagccatgttctgttctgttttcttgttggggagagcagggcacacatttccagctgttttgaatcgtagaactctgggtgagctggagcaaggggggtggaaccctccagggagctccagggagcttcaggccgattctcttctggatcccggtctgtgtgtattgttttgaatgagccttggagactttggcctcttctaaaacataaaaaccctactgaggccaggcgcggtggctcatgcctgtaatcccagccttgggaggctgaggcaggtggaacacctgaggcctgaagttgggagttcgagaccagcttgaccaacatggagaaaccccatctctactaaaatacaaaattagctgggcgtggtggcgcatgcttgtaatcccagctactcgggaggctgaggcaggagaattccttgaacctgggaggcggaggttgcggtgagccaagatcaggccactgcactccagcctgggtgacagagcgagattccgtctcaaaaacaacaacaacaacaaaaaaaaaccctattgaaagcaggctatgaaatgggtgtaatgcctgccttccacattgttgggagactgagtgaggtgcttagcacatagtagacagatcctcaaggatggcctctatttgctcacgctttactccaccccccacgtccccatctttctacccccttttatacctcatggtcatcatcttctgtcagtgtagatggctgtggccccatgtggccccgatgtccccatctgcaggtccacctggctctcctttttcttctggttccgtttttctcctctccttctcttctcttctttctcttttctcacagggtcttgttctcttgcccaggatgaagtacagtgatctgatcacagctcactgtaacctccaactcaagcgatcctcctgccctcagcctcctgagcagctgggactacaggcacgtgccaccatgcctggccaattttttattttttatacagccggagtctcattatgtttctcaggctggtctcgaactcctggcctcaagcaatccttctgccttggctttccaaagtgctggtattataagtgtgagccaccatgtgtcttgcctgtttccctctttttacttttctgcttttactaacttcagttttttgttttgttttttagagagtcttgctctgccgcccagaatggagtacagtggcatgatcttggctcactgcaacctctgtctcccagggtcaagcgatcctcctgcctccgccccaccccccccaaccccccgcagtccgcagtagctgagattacaggcacacaccaccatacctggctaattttgtatttttggtagagatggggtttcgtttgccatgttggccaggctggtctcgaactcctgagctcaggtaatccgcccacctcggcctcccaaagtgttggaattacagatgtgagccattgtgcctgacctgcacttactaacttttttactttgctcctttttattttatttatttttaaatttattattatcttttttgagacagagtctttctctgtcacccaggctggagtgcagtggcatgatcttggctcactgcaacctccgcctcccgggttcaagtgattcttctgcctcagcctcctgagtagctgggactacaggcgcccgccaccatgcccagctaatttttgtggttttagtagagatggggtttcaccatagtggccaggctggtcttgaactcttgaccttgtgatctgcctgcctcggtctcccagtgctgggattacaggtgtgagccaccgcgcccggcctgttcctttttaaattttaacacagtctgacccattcttccacgtttgctcttttgctgagacacctgtctcaccctttagctgcatatttttttctcccttccttaagctccgcttgcttctccagagaccctcccaccttcttttcccaagtctcctctgatccctgagtggaggtgcacctgggtgttttcccaaaggatttctctgaactccttgtttttcaactatgcacctcggtcagttaatcaactgcatgacctcttttataacctgtgtgctggtgactcccaaatttatatttccacccctgacgtgaattctattgtccagattcttccggtctgcgcaccagcagagactcaactcatttcctttccactctcccttctcatctactcccttctcatttccttttcactctcccaggccccatctactgcctgttctctgttagcgccccctctcttctctgggcctgtattagataatgggcatttgtgtagcacgttaagcttgaggaaatattttcatgtgcttctttattttttaaaaaactaaaccttaggccgggcattgtggctcacacctgtaatcccagcactttgggaggccaaggcaggtggatcttgaggtcaagagatcaagaccagcctggccaacatggtgaaaccccgtctctactaaaattacaaaaattagctgggcgtggtggcacgtgcctgtaattccagctatttgggaggctgaggcaggagaatctcttgaacctgggaggcggaggttgcagtgagccgagatcacaccattgcactccagtctgggtgacagagcgagactccatttcaaaaaaaacaaaacaaaaacaaaagaaccactaaaccttattgtgtatattcgaggtttacaacatgttgtcataggatacgtacagatagtaaggtggttgctaaagtgaagcagattaacctgtcagtcatctcacagctactttcctgtgtgccaagagcagctaaatctacttatgtaacaaaaatccgaaaatcccgagtacgattttcttaacttcagccctcatatcatacattagatttctaaacttgtgcatctcgtgtatctgctacttagtattctttgacccacgtctccccattctccacttccacccatagtaaccactgtttcattctcgatctctgtatttgacctctttatagatatataaatatatatattggactggacgtggtggctcacgcctgtaatcccagcactttgggaggctgaggtgggtggatcatctgaggttaggagttcgagaccagcctggccaacatggcgaaaccctctctaccaaaaatataaaaattagccaagcgtggtggcacgggcctgtagtctcagccacttgggagcctgaggcaggagaatcgcctgaacccaagaggtggaggctggaatgagccaagatcacgccactgcactccagcttgggtgacagagaaagactcgatctcaaaaataagtaaaataataaataaataaatatatgtatatagtacatataagtgagatcatgcaatgtttttcttgttgtgtctggcttatcttacttagcacgtccttccatgctgtggcaaatgggcagaatctccctttttaaggctgaataattcactgtatctatatacaatggatgtataaaccacattttaattatttgtccattgacgatcattttttatatggttctgatagccaccctttgaggtagatagtagttattttctactttcagaggaagctaaactgaagcccagaggagttaggggaagggaacacacccagtgttaccacaggcaatgatgcaagaacctgcaccttgggtgggtcttcccacaactagcccggtctcttttttctttttcttttttttcttttttgagatggagtctcgctctgtcacccaggctagagtgcagtggcgtgatctcagctcactgcaacctccgcctctggggttcaagcaattctcctgtctcagcctcctgagtagctgagactacaggcgtgtgccatcatgcctggctacttttcatatttttagtagagacggggtttcaccataatggtcaggctagtctcaaactcctgacctcaggtgatccacctgccttggccttccaaagagctgggattacaggcgtgagccactatgcctggtcttctttctggtttttcatatgggaaacctcaaggtagaaatcagaaatctacgggtcagatttggtctgcagacccttgttgcttggtctgcatggtattcaaaatattccaaattagttgccaacatttaaaacatcaggagattgcaccaaaaagtccatgttgttccttttttttttttttttttttttgagacagagtctcactgcgtcacccaggctggagtgcagtggcatgatctcggctcaactgcaacctccgcctcctgggttcaagcaattctcctacctcaacctcccgagtagttgggattacaggcgcccgccaccacgcccatctaatttttgtatttttagtagagacggagtttcattacatgtcgtttcttttgaaaaatcagatcaggcttcatgggatgtgtgtactctgtgtcaccacttggttaacctcaatagctccagccttgtatttgaccctctctgttgcctacattgggtctcacttgcctcacacatattcctacttggcccctgctttgggggattctaagaactctctgtgctcgatgtttaatgacaaatgcagttgccagatctagggggtatcttgtattgcagtctctgaattacatttgacttctgaccatgccaaccactcagttctgccttgagtctagatgttggttcaagttgcagaaaatagccttctcctgactcaccttaccctctgcctttaaaatcttagctgaatccacctttttgagaaggcttttttccccgataaaactaaccagcctgttgaccctcctgctaaggtaaaactttacagatctgtgtaaattaggctttcttctgtctcccgctctgccccgtaagctctttgaagacagggattttatctgcctttcaaataccccttgccaccaagcactgtgctgttctctctgcggtcacttaataactacttgatggtggttggtgattaaatgggtatgaactgcgacacccacagtgatgctgagcctgcagcaaaccacttcctcctctggagaacctgagttctctctgggtttggggtggggaggtggcatagaacccagcctctgacatcagccacacttggttctgtatcaatgctgttgcctactacttgtgtgaccctggcagatcactttacactctgagccttggtctcctaatccatgaaataggtgcatttcctgacatactttcccgaaatactttcaaagtgctcagtaactggtgatggttatcgttcattcttgggataatcttgacaactcctggggtggagggtttggcttttggtatcattctcttggcatttatttgtttgtttgtttatttatttttgagaccaagtctcgctctgttgcccaggctggagtacagtggcacaatcttggctcactgcagtctctgcctcccgggttcaagcaattctcctgcctcagcctcccaaatagctgggattacaggcgcccacgaccacgcccagctaatttttgtatttttagtggagacagcgtttcaccatgttggccaggctggtcttgaattcctgacctcaaatgatctgcccacctcacctcccaaagtgctgggattacaggagtgagccaccgcagcggcctgtttgtttatttatttattgagatggagtcttgctttgtcatccaggctggagtgcaggggcgtgatctcagctcactgcagcctccacctcccatgttcaagtgattctcctgcctcagcctcctgagtagctgggattacaggcatgcgccactatgctggctgttttttgtagttttggtagaggtggggtttcaccatgttcgccaggctggtctcaaactcctgacctcaagtgatccacctgccttggcctcccaaagtgctgggattacaggcgtgagccaccatgccgggccttatttattttttaattaattgattttttttgagacagagtctcgttccgttgcccaggctggagtgcagtggcgtgatctcagctcattgcaacctccacctcctgggttcaagtgattctcctgcctcagcctcccgagtagctgggatcacaggcacctgccatcacacccagctaattttttgtatttttagtagagatggggtttcgccatgttggccaggctggtcttgaactcctggcctcaagtgatctgctcacctcggcctcccaaagtgttgggattacagacgtgagccattgcacctggcccactcttcgaatttaagcttccacttcatctttaggttggctgcatttcccgtggccttggtgggcacttagtgcaattggccctgtttggttgcttagctaggcctgggggaagaatctgacttcagttactttctggaagaatgtgatttaggactcttcatggcgccatgggttggagaatgtttggaactctgctgtggaggtgaaatggccacacccttgggctggtggtgttaagttgggttttggttatatgacttttaatttcccctgagcctctttggtggctttcatgaggaagtggtgggggaggaggtggcttggtggcttggtttatactaatcgctcatctaacactaatattagtgagagctgccacagggagctgtgctgagatccactcccagatcagccctgggcttctcctagcactctaggcatccagaaagcctcatggggtggtctggcccctgaggctcctagtagcagtagaaaaaaggagagttggttttctggactgtgaacttggtggttgtacactgagtggacacagctgtgtcatgaagctggcccagtgactgtacccctttaggggtagttgatctgtgggacccaccctgggctctgttggaggtttgaagtggctcagagagtcctggccgagctttgccccctctgtttccaggaacattcctcttccttaggtggaaatgggagtgtccaatggcctgcacttggtttcctctggatttgccatttcccctgtgtactcctggctcggctggccggctaaggcagtttctcatcactgatgtgctctgggacagctgagtgggatgggctcctctggggtgggtgtggaggagtggtcgtgatgcctggaacactgcagtcactcctcagagacacgacttggcagccctcctgagcctgcctggtcacatgctgcctgtcttggaaggtcctctgtcccaagcagtggatgtgcagtttcttcacccctgcttagcttcatcaggcacaatgcgtctttgaggtgaggtagctgttgggatagctgggtggtctcatttcttccctgcctcaccacctcaaatggcctcttctgctgtgtcctgaactttccaagaactcctcccccttctctctctttggaagttggcacttgaagtctttttgtctggtctttggaggcagccaagccggaaagaagctggggaagaagatcgttacctggaggcggttgtcatggcttcctgtggtcacttgtggtcatctgcttctaaacatcctgtttgtgcctctagagcagcaggaacagtgaccaggagacagctgttatctgcctgactttggccaaagcatgggggctggggtgtcaccatcctgggggatgcttgattggctgatcactggcaattgagggcattgctggtagcagctcctttgggcaccactggcttgggctctgtccttcctcttctccctgcttcgactgtctgagattttccctcctaacggcctgttgggtattatcagtctgcactccccctctgtgcttctggactgatccattctttcttagagtcctctggtgcttccagagctggaaggaaccttaggatgtcatttcctcctatgcttgggagtttgtggccgtcatcttcttcagtcagagctgcttacttttctctgtttatatattgagcttccatctaagaccacaattacaaaaggggttttgtggatttttattttattatttatttatttatttattttgagacagagtcttgctctgtcgcccaggctggagtgcagtggtgcaatcttggctcactgcaacctctgcttcccaggttcaagcgattctcgtgcctcagcctcccacgtatctgggatcacaggtgcccaacaccatatctgactaagttttgtatttttagtagagatggagtttcaccatgttggccaggctggtctcaaactcctgacctcaggtgatccacccgcctcagcctcccaaagttttgggattacagacgtgaaccactgcacctggccataactgccagcattaatatagtgttactcactctgtggcagccactgttctaaatacctcccttacgttcccttatcatttcctcacaacagccctctgaagtaggtattctagctgacgacactgaagcacagagaggtgagcaacttgcccgaggttagttgctgattagtggtggagctgggattggattcagtgactgtcgcatacagccctttgctgacattgtagactctgttctgattcctgctcgccaatgagggtgatgccacgcggtgccactggggaggagggaagagaggggacagtctggtgtgtgtgtgtgtgtgtgtgtgtgtgtgtgtgtgtgtgtgtgtgtgtgaaagtcatctgtggattgtatatggtgtgcttgggggtgcagtaattgaggaaacatagtcaaccaggtgtctgctgagggcagtgggggctgttgaacactgacccctatccagggttatcagggactgaaaatgaccccaggagaagtgtggtgtgagctggcgtgcttccctctggggaaggtctaggggctgtggacagaggagggagcatttcctgctctgtggccatcctccagccccctcttctaccgtgagcaaaggctggggtccctcatgttccccagaccagcagtctggcagccctctgtcctcctgctcttcacctctcttgggttatttgcttatatcttccactggcttcctttggaagagttttttctcaattattgagctttctcaactggagagtcaaagtctccagtttccaactaggattgtggatttgtcactttttcttttcaattttgtccatttttgctttatctactttagagctctgttgttgagtgggtgtacatttaggatgattatgtcttcatgatgaattgactcatcattatgaaatgtccctctttacctctggtaatattcctgtctggaagtctgccttgcctgatattaacagaagcacttcaactttctttctttttttcttttaaacaactgctattctgttaataaaatagttgcttgaaacatctgcagtggtgactttaaccttgaatctcagctcagtacagatggacgtaatctgcttagcaatctcgggaggaccatccaggtcagtgagtcacttgcggattctcatctggaaacgatcccttgtcctagaaccttcatcacgaggcgtttttcttatagtgattctcagagtcttgataggcatctgaactgatccttcactttgagattcttttcctttgcacctctgatcaagtcagcacacaccttctccagagatttgatgttgcggcaggctagggtaattctgatttaataaattgccacctctagttccacggatggctttgaaagccatagctgtggtgtggcttcctagctgacttgttctggggtgagggcaaacagtggcaactcaggagcaggcgagggcacaccagagtttagtggcagctgccagctggctccctcaaagggccactctgccttccttgatattagtgtttgcatggtatatctttctccattgctttatactgaatctatctgtgtctttatatgtaaagtatgtttcttgtagatagcatgtattaaatactgcatttctacccaggctgaaaatctctgccttttaattggagtatataaaccttttagattttaaagtaattatcaatgtggttagactgaagtctatcatgttgccattcattttccatttgtgccatctgtttattctttcttcttttctagccttcttttttttaaaatttttttttatagagacagggtcttgctgtcacccaggctgaagtgcagtggtacagtcatggcttactacagtgtcaaactcctaggctcaagtgatcctcctgccttagcctctcgagtagctggaattacaggcatatgctaacatgcccggctacatttttctttttttttttttttttaagacagattctcactctattgcccaggctggagtgcagtggcgcaatcctggctcactgcaacctctgcctcccgggttcaagtgattctcctgcctcagcctcctgagtagctgagactacaggcacgcaccaccatgcctagctaatttttttgtatttttagtagagacagggttttaccatgttagccaggatggtctcgatctcctgatctcacgatctgcctgcctcagcctcccaaagggctgggattacaggcatgagccaccgcgcctggcctggctaaatttttcttttttctttttcttttcttttttctttttttttttttttttttgagacagagtctttctctgtcccccaggctggagtgcatggctcactgcaacctctgcctcccaggttcaagtgattctcatgcctcagcctctggaggaactgggataacaggcatgcgctaccatgcccagctaatttttgtatttttagtagagatggggtttcaccatgttggccaggctggactcgaactcctgacctcaagtgatctgcccacctcagcctcccaaagtgctgggattaaaggcatgagccactgtgcccagcctaattttttatttttatttttgtagagacggaatctcactgtgttgcccaggctggtctctaactcctggcctcaagcaatcctcctgctttggcctcccaatgcgctgggattataggtgtgagccattgtgtctggcctcttgccttgttttagattcattgagtattttttagggttctgttttatttccactctttgcttatttagctatacttcattggtttgattttagtggtcactctgtggtttgcaggtttaaattaatcacaatctgccttcaaatcataccataccatttcacgtataatgtaagaacagtatatttccatttccccctcctgttttttgttatttctacatatattatgaaacccgtactatgtagtccaccttttatgtttgtccacaaatttactataatatttctagcattcttttttttttttttttttttgagatggagtctcgctctgtcgcccaggctggagtgcagtcgtgcgatctcggctcactgaaagctccgcctcctgggttcacgccattctcctgcctcagcctcccaagtagctgggactacaggtgcccgccacaacacccggctaattttttgtattttttagtagagacggggtttcaccgtgttagccaggatggtcttgatctcctgaccttgtgatccacccacctcggcctcccaaagtgctgggattacaggcgtgagccactgtgcccggccgcattctttttttttgaagactaaagaagttaacaaaaatgtcaggaaaacattgttttgtttttttttttcttcccctccttttcccattctcgtctgagaacgtgttgtcttcttcctccctggctagtttccctgcctgtgaactccctcagcctcactaatctgtacgtgctttgtggctcatcccatctgtgcttcagtcatgataatcgatgctgtcagtctctctgggctacacagccccacacttggtgttgctgacacattccggtggtgcacgtttgagaaaatcgcacattccagctcatgtcccctgcctcctctgctccatggggagaggtgtgaccagatctgcagggcctggggctgccacactcctgttccttcttgctctgttgctacgtgatgcccctcctcctccttccccagcaccaagccagagagtcacccagtcccaggccccaactccctcccagctgcctcattcctatgccctgagcccacctcttggagctccccttccccacccacaaaggaagccagataggccacccagtgagtttaaaccttaagtacccacaaggggctatgctccagccacaaagtcttgtggactattcctttgatttttttttattatttattatttattttattttattttatttatttatttgttttgagacagagtctcgctctgtcacccaggctggagtgcagtggcgtgatcttggcttactgcaacctttgcctcccaggttcaaacacttccctgcctcagcctcctaagtagctgggattacaagcgtctgccactgcgcccagctaagttttgtattttttttttttttttccgagacggagtctcactctgtcatccaggctggagtgcagtggtgcgatctctgctcactgcaagctccgcctcccgggttcacgccattctcctgcctcagcctcccgagtagctgggactacaggcgcccgccaccacgcctggctaattttttttgtatttttagtagagacggggtttcaccgtgttagccaggatggtctcgatctcctgacctcgtgatccgcccgcctcggcctcccaaagtgctgggattacaggcgtgagccaccgcgcccgaccaagttttgtatttttagtagagatggggtttcaccatcttggccaggctggtcttgaactcctgaccttgtgatccacccacctcagcctcccaaagtgctgggattacagatgtggccaccatgcccagctatttttttgtttgtttattttagggtaggagttttgctggttggggaggggtggtggcaactagatcacagtagatgggacattctgggatagaagagtaggaacaacttgggccctgtgctcctgtgttgctctccctcaccgggctttgcatacagtgagctcttagggaggaccaggaggtggcatgagctgaagtggcaaggctgatctcagcagcagactgacttggcgcaggtcatttgttgatttgtttggtatcatccatggagcccctattatatgctaggctctgcccaatgctcagatgaagatgaatataggcgtactccctacccacaatgtgctattcctaggctgtgagacatggccccttaggcagacagttcctaccagcttgaggtgttctcataggagaagtgcacagtgctttgggaactcaaaggaatggagcctcaaaccctttgtaggagagtaaggtcagggagggcttcctggaggaaatgggatcctaaactgactctgttttgtgtgtgttttaagagataggatttctctgttgcccaggctggagtgcagtgatgccatcatagctcacttgcagcttcaaacacctgggttcaatccatcttccagcctcagcttcctaagtaactgggattacaggcatgtgctatagcacctggcgaatttttaaaaattttttgtagagacagggtcttgctgtgttgcccagtctggtctcaaatttctgccctcaagcaatcgtcccgccttggcctcccaaaatgcttggattacaggcatgagccaccatgcccggccttttgttgtgtgtttaaatagaacctcaacatttagaaaaggccccaacctttgtcctttacttaaatggtcattctgtaataagattttggaaagagaccttcccagcagaaaagcaacacgttgctttttctctaggtaggcaggatggatcctttttatcctctcgttgaagaagataaactaagctattatgagtctcaagggattagaaaggatttagcctggtaaagaagacaggagagaggtctagggagagggaatagctcatgcagaggcctggagggcggacgtgtgtgcaagcatgtgtgtttagttcattggtagtgatttggtgccctgtgtccagttggatctttcaagctaatcaaacttatcctgagccacaaggccaaggacagtcattaggctttgcatcttcattggaatgaccttttggggatgaccttgctacgatagctgagatggggctggcctttggggcatctgttatcctacagtgagatgagcttttttttttttttttaaagcccgagtctcgctctgtcgctcaggctggagtgcagtggcataatcttggctcactgcaacctctgcctcccaggttcaagcaattctcctgcctcagcctcctgaatagctgggattacaggcgtgtaccaccacaccaatttttgtatttttagtagagacagggtttctccatgttggccaggctggactcggactcctgacctcaagtgatctgcccgcctctgcctcgcaaagtgctgggattacaggcatgagccaccacacttggccatgagatgagctttatctgtgcaaagtctctctgtggtcagctggggctggggccgtgggtcagttctgaagggcatttccatgagggtttgaggcctgagattgtgtcctgggccctctggccccagtggtgagccgcatgctcatgtggcaggaaggatctggttcctctgataacctgcttaggctgacccctctttttcctggaggacggctgtcagagatggggctggctttctatttgaatttcagaggcagactcgtgcagatgggtgcgggcagaggaagggagcccatggtcttcctgaacactctgagaattcccagagcaggctgcatgcaacttcctgaggttctcccaaagccagacagggagaacaacttgtgttcaggagaagggtaccatataatttaacaaactgttacttagataggtgccttggccagagaaaaacgtccttgggccctggctcagggaacactgtggctctgcctgttcttggtgtaactcctgatccttgttaccgtcattacctgacccctgccgcagaccttcttccctgtctcatctgttccatccctcctgcaggaaacaaacatgggaggcatcctgcactcctcactccttctccatatccactcagtttccaggtaacattgattttacctgatttcatgtagagtattgcaactcttgctcttcctccaattgagccctgcctccctctgatctcccctgcctgagtgatgtaaagtgcaagcctggtcctgctgttccgctgctgaccgccttccttctgtggcttgcccttgtaagtccagactccccagtgggccctcggcccttgactcctcttccatcaagctgggacttgcactctgagctcccatcccctctgtctgggcactttcccaggctgttttccacctctgcctggaaagcccctcccctttcctcctggcccactgccgctttcagggccttctgcccctcgtttatgacagtctcccactagtcagtgctccccggagacaggcattgtatatttgcccctcccatgcccagcatagtgcccgtgcacactatgtgtttgtgaacgcgattggagccatcactagtaaaggtgaggctgtcccagtgagagcatcggagggagggtcttggaggaggcacgtgagacaggtgcaggtggctctgccttggatacccaagcgaggccacatctgttttgtgcctcctgaactggggtggcttcactggagtttgctgcctgggtcagtgtccaggcaggtcccattccagaaattctgatcacctgggattgaggtgaagatgaggcagcttcagcttcagcccctagtgatcagacttgtcttcaaaggaccaagctgtgatctgacaggggcagggtggtgcactgtcaggcctgcccatggcagtggtttcattcagattcccaacccctttgggccatgactattgggatctctccccagagtagtgtggtagggacatggtagtgaaacttcaggtggtccacagatccccaggagggtcagctccagatgccagattaagacttctgatataaagtttagctcccttggggggctctcttcctccctttccctttgaaagggaaaaaaagagaatgtggaatacttttgctccagggttagggagctgaactgagccagcaggaagagggtggattgtggggccaggtgcaggccaccctgagtgggtgggcactgttatgcctgacactcagggcctctggagtcagtcctgggtgggttagtgtcgatgttccaatggcgaatgctctggcagagttaggaggcagagacttcagaagggccatccctggactcctttcttggcacttgcgtcattgggagcactgtggggctgcgatgccagcttttggactggactcctgggaggatcagcagtgcccttcttcctgttggcttgtgcactgagcttcccacaccacgaatgcaggggcctccagatgcatctgcttggtgaccctttgaacttgggaatggcttcaaagccagggagagagattgctgttttggttgggtcctgcaaagcctctcagctttttagcccagatcttgtttacagtctgatggtctggtcccagtgtcttaacaggtgactctggagccactgtgggagagtcagactacctaactgacacctgtcagagcaccttctctgcagttgcttatggcttgcagtgctgggcatgcacttgctctggtggggcaatcagggatgtcagctttgtgggtgggacagctcctcatcccccatctgtcacctgtcacctggtgagataggcactaatgatatgcatggctgtgtgcttgtgatgtaccaggactgctttatgattgttatcttatttgttcctctaaatggcttgagtgaggcttgggaaccccacagtccccattatataaggggcagttattatacctattctatagatgagggaactgagctcaaagaggtgtcatgctagcaagtggcagagctggacctgaaaccacgtagttcagcgacaaaacctgtgctacatttttgttgcatactcacttacctgcagaggccaggcaggtcatgtgaatggatgaagtgggccaaaaaaaaaaaaaaaagggagctagatttcatgttgttccaaagaaggtagccaagcagaccagtgttgctagctagctcttctgactgttcctgggaagccagaaatcctggctttcatgtgaaatctctcaatttattcagattagctcagattttttatttaatttaatttattatttatttatttatctgagacagagtctcgctctgtcacccaggctggagtgcagtggtgtgatctcaggtcactgcaacctccgcctcccaggttcaagcaattccgttgcctcactcagcctcctgagtagctgggattacaggcatgcaccaccacgcctggctaattttgtttttgtttttgagacggagtctcactctgttgcccaggttggagtgcagtggcacgatactggctcactgcaacctccgcctcctgggttcaagcgattctcctgcctcagcctcccgagtagctgggactacaggcatgcgccaccatgcctggctaattttttgtattttcagtagagacggggtttcaccatgctggccaggctggtctcgaactcctgacctgtgatccacctgcctcagcctcccaaagtgctgggattataggcgtgagccaccccgcctggcctaaatttttgtatttttagtggagacagggtctcaccacattggccaggctggtttggaactcttgacctcaggtgatccgttggcctcgggctcccaaagtgctgggattacaggcgtgatccaccacacccagcagaaacttccaccctttaaaaaggagaaaccagtggcaccaggaagggcagtagtgggacaggtgcttgctcagctccctggcttttttggtgaccatttcctgtctgaacataaagatgggcaggaggagaaggagcagccccacccgacagtttggttcccgtcagaagttccctagctgaccacgaagctccctgtgttgcagtacagtagttagggggcagaagcacgggatttcttgtccttgggaagtttagcttaggagcgtccaaggacagctgtgccccccatacatagctaggcacagagcaggtactgcctgaaggaggaatgatggggttcaccctagcacctcatggcaagacagcaatctctgcagacactgcagaacctagcatccactggagctagtgatgtaaatagtctacctgaacagtcacccagtttcccctcagagtattgtttctattagaagacattctccacagctcaaaatccaacttccaaacaaccttctggaatgctccacgtgtgtacatggggactttctgtgtggtgtttctgggcattgcggccacgtactgctgttgccctctggctctgctgggctggatttgcggagccccagagtgtctcctgcaataaaatccaaaccaggggcgaggtgtgtaccccctcccccatcaatccctggcatagccagctgggcatggtggagggaggccaggccagccaagcctggttggagccctggaaccctctctgctgcatgaacccccgggcacaggcacctccgttcagtttacccatgaggcttggcatctgcttggcctgcttcctcagctttggagttagtgggcttcttgcaggctaactacgacgtggtctcatttgagttctgttcccaccctatccctctcccctgcaccttgatatacctacacgtgaactccactagccagactgaaagcccagaggtctccctgggtgctttttgtttcaggaaaatatcttctctcctttttttctattgtggtttcccagcgtgactctgcagctccatctgcttcctccctgtccaggaagaggcagatttccccatgcggagagttggcaaggctccgggcctccggagaaattggccttgccctcttcaggacagtggccggggcattcctcctttgtagctcagtgatgccatcccaccagcgccctgggttgggtcaggcctgctgcctatgattgtgcctggggagcctacaaagctcagtggggtggggggactgagacgagacttggagcttctgtgcatgggatgggccctcctgagaccactccttattcaggaggtgccaactctctgtggggacgccagctgtcaaggggcctcagcatttcctagagccctgaaatcagcagatggcttccaaaatttgtgtgcccaagaagacccagggctggatgaggtagacacttctagggaggcaaaagggtcactgagggtcagctcggggagcactctgggggcagctagcctgactcccctcccccacttcttctcagcactcgtgaccatctatgatagtggtttcaaatggtgcgctgccaggacatagccttcagatgacaccaagggtgtgtctggcattctttgcactcctagctctttctttcactcaagtaaatgcactggaacacatgcgggtggggctgatggtcatggagtcatcttgaacccacttcagtttattttctccaaaataaaagcaatggccagcaggagttcgagaccagcctggccaacatggtgaaaccctatctctactaaaaatataaaaattagcagggcgtgttggcacatgcttgtaattccagctacttgggaggctgaggcacaagaattgcttgaccccaagaggcagaggttgcagtgaaccgtgatcatgccactgtaccccagcctgggcaatagaaggagattattctgtgtgtgtgtgtgtgtgtgtgtgtgtgtatacacacacacacacacacacgtacatacataagcaagcaagcaatgaccaggtgcagtggctcatgcccgtaatcctagcactgtgagagactgaggcaggaggatcgcttgagcccaggagttccaggctagccctggcaacatcctaagaccctgtctacaaaaaatagaaaacttagccaagtgtggtggcatgcactgtagccctcatgacttgggaggctgaggtgggaagatcacttgagcccagaagtttgaggttgcagtgagctatgatcacaccactgcactccagcctgggtgacagagtgagaccttgtctcaaataaataaataaataaatacataaataaaattaaaagatcagctggggccaggcacagtggctcacacctgtaatgccagcactttgggaggccaaggtgggtggatcacgaggtcaggagttcaagaccagcctggccaagatggtgaaaccttgtctctactaaaaatacaaaaattagctgggtgtggtggcaggcacctgtaatcctagctactcgggaggctgaggcagggaattgcttgaacccgggaggcagaggttgcagtgagctgagatggcgccactgtacgccagcctgggcgacagagtgagactccgtctcaaaaaaaaaaaaaaaaaaagatcatctgggcatggtggcacacacctatagttccagctattcatgaggctgaggtgggatcccaggaggtggagattgcagtgagctgtgatcatgccactgtattccaccctccagcctgggtaacagagcaagaccctgtctcaaaaaaagaaaaaaatcagttgcagatgtccataccttatgatgattagccaaggactggtgacacacctcatggcagattgcacgtcagggtcgagagccagtggctgaggacagctctatgctcaggcttgtgtttccccagcgtgttgtgccctctgcagccctcttgtgcccagacacagagtagttaaaaacagcagtacagagggcaagacatggaactgcctacttttttgctcagtgggaaaagtgcttgggtgagacatgtggctgtccattgaagggaacagctatgctgactgtgggttggaaaatctaggctggctgtcttgctggctgtcccgtgttggctggtttggtgcctacagtggagtcccttgtctgcctgtgtgtctcttaatgattctgatgtcatctctgcgaggtcagaggttggttcccggggcaggcccatcttgcaccctgaggttcagatgggaccacaagcagcgtagcacagggggaaaacacttgtgcgcgtcgaccttgcacatcaacaagttagaccagaacatggagtgcaccagccttctcagaattcttgagctctctgtaccaccactaggggctcctctgtggctcaagacccctcctgaggcagagggtgaggaggaggcagaaagaaaagagaacaggagacttggagtgggcagcagtagagcggaacccagcaggcccgcctttttggattcctctgggggctctggggatgtgtgttgtgggagtggagagtggtgacgagcagaggacggacagctgctgaaagcgatcattcctctccttgtggggcatcctgggaagaacatgggtgatctctgcagtcaggcagcgcagtcctcgtggggccttatggggcggctctgggtgtctgcattctaatccctggcaacaaatggggctgcaaggctgggctcctggtagatgctcaggaagggttgttccactcctcaccccctcctgagctgctttctagcctcgcagccccgtctttggatccctttttggcactctgctgggctcagagcttccgtggcaggagcagaggctgctctctcctgggttcctctgggagctaccatggagcttgggcagttccttctattgttgcgattctgggttcaaagccacaggcctctcagacagctgtgacttcccggcaggcagtagggatggggtgggggtggaggcgttggggccctgcagcttccctcgcttgcctctgtccttgctaggcagtgagttggaggcgcctgggctcagctgatgttctccaaggaggacttggaatgaacccgagacacaaagggtgaggtcagtggtttgctcagcaagaaggctgagttagtgacaacctgtcacagctcccaggatccctggctgcagtccctggctccgactcctccccctgctggccttaagggagatgaaaatcagtgatgtggatctattgactgagtgtctcctgtgtgtcagagtgggaggcttacgtttattttatcccagccaccaggatggctctcacattctttttcatccattactcactgtgcgctatgaggtgcctgagtaaactaaagcccagaattatctagtcactggtcacccaggctagtgagtggcggatttgaacccatcctcctcactgttagatggcccattccttccactctaccacactgccatgcaggtgggatgcccagagggtgtccaaagaactgtgtgaccatcctagctcccaacgacagcagaccagccaaatctgtgatatgggcaggggtggttttatgtgtggacagtgggggctttgtggtgctgcttaaaattgtttgccaaagtccccaagagcaaaatcttatctgttttttttgttttgtttttttgagacagagtcttactctgtcgcccaggctggagtgcagtggcgcaatctctgttcactgcaacttctgcctcctgggtttaagccattctcctgcctcagcctcccaagaggctgggattacaggcatgcaccaccatgctcaactaaattttgtatttttagtagagtagagatgaggtttcaccatgttggccaggccaacatggtttcgaactcctggcctcaagcaatctccctgtctcggcctcccaaagtgctgggattacaagcataagccaccatgcaggccttgaagcctctctttttatcttacgatttcacttgcattttgcatttgactccataatgtagccttgtttgttttaagacaatgatttacatttcttgcccctgagtacatttgatcctcagagtgttctgggtttatcctgaggtggcttcctgtacccctggcttccatctgtcccctgggggtatggatatccttgtgcgagaggctcaaaccaggtgaatgatgatagaggtagtggtgggacacattcagtattgtgaagaaaggcacgctggcaaaaagggaagcggggagtccagtttggctggagacatgggttgcagtgagggggaccaaggaggcagtgaaggttagtttggggccatattctgagagggtcaagaacagaatgccatccccagggtttctgaccttgttttataggcagagagggcaacagtgggtgagtattataactccaccccttgctctgcacacattcattcaagcccctctaagaggcctgtgagggccgggcacagtggcttatgcttgtaatcccagcactttggaatgccgaggtgggtggatcacttgaagtcaggagttcgagacaagcctgtccaacaatgtgaaacttcgactctactaagaaaatacaaaaattagccaggtgtggtgtgtacctgtagttccagctacttgggagactgaggcaggaggatcatttgaacccgggaggtggaggctgcagtgagctgagatcatgccactgcactccagcctggttgacagagcaagactccatttcaaaaaaaaaggaggcctatgagggtatccatgctgtggggattcaggagcaggaggatgttcttgcccacagaggacctgcagtctagggggagaagcaagagtgaagtgtgaggcatgccccaaaaaggctgggtgccaagaagttcgggccgatggtgtgtgcaggaagcgttagattgggagaacccagggcagggggctgcagtcaagttcaggtaggcactgagcatggattcgaatgctagtccaagtggttggctgtggtgatgaaaggaaagggaggcaagtgatgacagggagaggccccgcgaaggaagaattgatgtgacttagtgaccagctaaatgtgggagctattaaagggacttagaaaagagaactggggaagtcaggcaagcgagagctgacttcgggaaatgaccttgctgcctgaaaaaaggggaaggtgctggctggttagtgagaacctgattagcaaagagtgggtaactaatgctatgaaatccacaaaaatcgcaaaaaaactgcagctcatctcaggaacaggcaaacttttgaactttttgttcgggtctctgtgggacgatgactcactttgagcccctcctaacctctgttggtgattagcaggggtgagaggcccaaggagccgccctgctctgcaacagatcaacttgcctggaagagcccagattgcaggaatgggctggggtcgatttggaacagctgagaacctttccagcccatgagtctcctgggtttgaggctgtcttttttgtatgtgaatctgggttttacccattgaaggagctgtgagttgggcctggaatggggccctggacttgacctgaaaaggtctagcatctctgggcgacctaaagaggtggatgacatctgaccaatgaaatgtgtccacaatgttctgggacctctggaggagggagggcccactgattctggacaggagagatgagttatttacaatatgaaagagactctggggatgggcatggtggctcctgtctgtaatctcagcactttgggaaggcccaggcaggaagatggcttgaggccaggagttcaagaccagcttgggcaacatagtgagaccctgtctctacaaaaaagtttttaaaagcctagtgtggtggcatgtgcttttagtcctagctactcgggaggctgaggcaggaagatcccttgagcccaagaattctaggctgcaatgagctgtgatcaggcctctagcctgagtggcagaacaagacttgtctcaaaaaaagaaaaaaagaagagaaagactctggtgtttggccagcctggcctgaactcctgtgtctgtagcctaaggcagatgcatagaagtgctcagagtcaacctgggcagccttgtctcacctgctgttgcttaagctcctggagcccaatttgatggggaagtggctgcagccaggagcctgatgggtgggccttgtgtgtgcctggtgcagatgggcctggcacagttggtcttctgcctggagctcagggtgactgctggagttgccttgcagccattattttctcaggtctctggttacctgtgccctgtgaccttgggcacaagccaggcagccaataaagccagtctgtctgcacactcatattgtgtcaccctctgcaaggaagagctcctcagcatacaggaagccaccctcctaagctaggcctgtaggaagcctggggaagaaccacttcatccaaatgaccaccccctcctcccctggcggctgactggaagactcctgggccttctcccctggcttcctgtgtgtcaccccccagcccacacttccttcagggctgtaagggtaaaatgcagttcctgttgagtgaggcatgagtcagcggaggagaattggtggctgagtctttgtaacctccaggcatggctattaaatatttaaatgacactatggtattgatcgtttctcatccatcctcttagcagagcagttcctgtctgggattcagataatagcagaatcttggatttagactaactcggaagagctcaaaggtgctatataaatctcacccataattgtattatctcctcagagcatgctactaggaatggggacaaatcgggttctgcccattttcttgatagagaagacatccagagaggttagaggatccgctgaggggcccccactcatccgctgggcctgggatcagggcatcctggctcccctcctccgcactggctgtttgctctgctcactgctgcttccccatcctcctcctcttcacagcccctctgtcattcagccattcattctagctgctggggatatggcatcgaacaagaccgacaaggcccctgctctctggagcttaattcttggagaggagacagttgacaagaacccaaattggcagggaaggcccctcaaggagactgagttcctagtcagtgtccaggccctaggtccctgggctgggggtgggtggggcagagtggatctggcctaattgtggattggcccttactgaggacagacggttatcaggataaatatacccagctcaccattcctggggacttactcaccgagtgaaagcaccccgctgcggattagattacctctgctctaactgctcatgtgctctgggctgggggaggggaggggaacttggagccagggggaggggggagacccgccttcccgttctgttttccttcctaatctggaagagtctcaccaaaggggctgagatgagaccatccctgagctggtcctgctgtttacatagctccttccttaggaagggccaagccctgctcactgcttatatccctgagcgtgggcaactgtaaggaggccgcagcttctctgacactcagagctaccaaggctgcccaggtggtcatcagggggttgggaacctcccttgtccagagttctggacccaacaggatagacaggccatgaggctgggcatccccagaccccctaggacagggacttgtttctctgggagtctgggtttcctatcagatggcagggatggacagctggcccagggctgcggggaaggcccctgtgctatggcagcccgttgctgctggtgctggagctttcagggcggtgcttgctgctccttcctttggcttgtcagctcctaaggaagctgcactggccgctccctgcctggggcaatgaaagctgagtgaaattggcctgcagaagaaggtgggtgaaggggctggaaaataccttgttcttacgtgggcctctcctgggccaggcctcgagaatgcaaggcgtgctaaggtggggcgctgcctgagggccacaggactatacctcttctagttctgcctggggctgctggtggaggagtccagaatggcaaaggtgggcagggaccacggggccctggcgctggggctggtgtggcagggcagcctgtaaactccaagaagggatggaaaagctggctccatgccccacatttacctgcttcctgctgatctgggactagagggcagcaccctttgccctcagggattggataggacggggaggtgatttctttcccctcctagggcttaacacctccctgggaagaagcttgtaatctatttagcaactcccatttcctgtgtgctgtattccaggcactgtgctaagtcagcactttatatctttttctcatgtagtcccaatcctgtgagtaaaatggtggaattcctattgggcagacaaggaaactgaggcacaaaagcagttaagcagcctatccgagcagttcagccattgagcagagcccaggtgactgaggattcaccgtacaagttgtaacactgaaagtcctcagagcctgggaggagagaatggaatcgctctgggtcctcccaccccctcagagagatggacttttatctcctctctcttggcacctgtccagctccaggcctctggtcttgatagtctttatcacacactaagaagtggcaggggcttaggtaggaggaagaagcctggcttgtttctgtgctgcagtcgggggtgggggcggaaggttttaattgattctctttaatctgatattgagtgccatgcgtcagtggatcaaccggggtccccagagccacagtctgggggacatccccccattgtaggtacaaggggacccaggtttccttccacccggagcccctaggtgggtacaggaatgtgagggatgcagctgcagcacttgccctggaatgcaggcgaaccggtcccctcctcctcggagcagtgggctgagggtgtctgtaccttaaccctccagcggctcccaccggttgtaaggattacgctcagtcagttgctgaggcccagggaagggcttcttcctctcagcctggccgtagtgcactgtttctgcccagccacctgccccagggcggcctcccgacccaaagctgcagctgttccatgctgttgctccgaccaggtgcagccatggggtgcagataggggcgcacacggtgctgcatttgcacagggccctggaagcgagggcgtgcacccctctggttctccagagccctgcatgtcacccttgggttgtgccttcaagtgataccaggctacctgtgttcctcccactagcttgctgtgttcctccagctcagccttgttctctaaggatagaaacttccccactgcgcccatggccaggggctccccagtcttccccggctagaaaattgcaagattgcacgaggttacccagtggcaagaagctgacgggccaatggtgccctctggtggggagcagcagacagtctgcaccccttcctcaccagggcggagccaggacatagctccgtggcctttgcccatggctcgctggggactttgcacctagcctgccctcagcctcgagacagcctggcctacctcctcatgttgcatacttccgctggcccagagagacagaaaacctgcagaattcagggtgggtttcctccagaaagtggttgggaagccccagagagagagcttcctccttcagggtgacttgggtctggagggccccaggcctggacctggaaacttagtagagtaatgccaaggaaatttgaggcctttcttagcttgaatgaggtctcccgactacttccgagcagcgtgtctggaatctgtcctcccagcatgtgggaagggagggtgtattcctggtcttgaatggtttcagtgggtaccattttctctgaagagtggatagcctgacaccttctttggggtatgaggagcaggaatatttagagcagagggaaaggctggagccggacactgggggaccccgctgggatggggctctgccttcaagtggactccttcctgtgtgcagtgtctgccagctctgtttgctcaagccaggggggacgtttgctgagcttgcaaggggactctgacccttaaccattttgcagcctatggggaagtctcaggtatttgcacccattggaaatcaaagtaaagctaggagtctactgttggcttgcctcctgtatttctggttttctttcttgaggagtttgtggggggtttggaggcaccaacccctacccctcttgcctagtccttgcctgtccaaatcactaggtgagaatgaagggtggagagagaggaggaagccataccagagaccctgtggctggtggatggacttgctggggtttttctctgtccctcaaatagacaaaactttggagaaaactgaataatgatgtgccttctccctgacatctgcactctatgatttgttcgtttgtttttaagacagggtcttgctctgtcaccccggctagagtgcagtggtgcaattgtagctcactgtagtcttgacctcctgggctcaagcaatcctcctgcctcagcctcctgagtaattgggactacaggcgcatatcaccacacccagctaatttttaaattttttgtagagatggggtttcactgtgttgcccaagccgatctccaactcctgttctcaagtgatcctcccacctcagcctcctgaatagctgggactataggcatgcgccaccacacccagctaatttttaaattttttgtagagacaggctctcactgttttgcccaggctgggacatgctacaatttgaatgttactttattacttttcttttcttttcaaggttgcccttttcatggtttgctcatattctacccagaaaagacttaggagacttagaagaagttagtactttgcatcctacctacactgctctccttggaggaagaccttattctggattttacagagcaaatcagatctgatgtttgtagcttccaatgtgctatggagcttcctcctgcagagtgacttgggtctggagagcctgatatttgcaactgatgtctgcagcttccagtgtacctgctagcccttataaacctcacaccagtactttgaggtcagagttattcaagagcttactgagacaacaggccctgagaagctaagcgatttgccctgtggcatggatggtagagaggggagctggcacttgaactcaggtctggctcgacctcagaatgagtgatcttgtgtctctgtgccccaggactgcatcctctcaccaatacttcaccagcctagggatctgtgctcccaagagcctgttgacattgtaaacctgaatccaatccataaaccaaaagcccaggcttagaatcacattgtggtggagcgggtgtttggtggagtccctgattcaaaatgtttgacaaggaagcctgaccatttgtcttctgttgggtgtttggagtccaagagacctgagatcagagtccagcattgtcacttcatccagccttggcagtgtgggatgtgactctgcctctgaaccgcagttataccatctgtgctggtggcgttgtgaggatggcaggtaacaaaggtgaagctcctggccccagtgggccttcaaggatggcagctgctcctgccccctactggggttgcactcattcgttgcctgctctggggagtcctatggggtttcttagctggccctgcccatggtggagaaagagggatccacccattgctgattgggcccagaggaaatgaggacactgcgtgaagccaagacagcaggtgtggccctggagaggccgtggggattggcctggacactggttccttttctgccgttacctagatacctaccaactccctctagttccggtttgctagagacaggaagccaggcctcctccatgggacccggagggcggggcgggctgtaggacctgaacttccttggaggtcaggcgaccagacccggggtcctgggccttggaacagacatcccctctgtccatctgggcaggagcatggggtaggtgtggccagccttgagggtaggagatcaggacaggcagctgggacaaggtgtggccccatagaccgaggccctgggtgagggccttgcttctctattccctcctctgaacacaggttgggggactgggagcaaggccacaaggaaggatcacactggcaggcctcacagcttgggcctccaacattcaggaagttgaaccctttaagtatggcatcatctggtagtcatagtggcctcttacaggccaggtttttggggtttggggcttctgaggagtcagacaattgtgccactcactggctttgttatttggagcaaacacctctgacctctgcctctccaagcccggctttcctcatcgcttcggggagaatcatttccagctacagggggtattagggggattaacggagacctcgtacatgctgctagaatgcctagcagtctgcctgctactgataagtggcaataaacgcagccattgctttttagatgtttattatcctgagggctagggatcaagctgtcagctccctggacccagcaggttaccggggagctgagagcaagcaagttgtgaacggggcaggaatgagggtgtggcatccagggccaggctgtctgagccgtggggctgttgagggtcccaggaggggatggaggaagtgggggtcagcaggtcctactcctgcccttctatacccttcttttctggagactggggagacctagtgcccccctgttggctgccaggtgccagggtaatggaagcttacactagagggctgatttggctcccttgccgctgttaaaagcagaacagtgggggcctggagcctctggggccgggctgcttgccagacttccgcagaaacagccaatggagcagtcttgccccctgctcactgagggggtggggaccgctgcaccagcctcactccagcccccacctccccgcacaccttaccccataagcctagagcctcaggaggaacctggagcctgggcttctgcttccacctggttaggagggcagggaccatcctgagtgccccttccagtcgggggctgggaaagcctaagctcttagaaatcaagtgagggcctggcatagccagggcccctccctgtgacgtggggcccctcccgcccattctctccgcgttgccctgcagattcagagttccagacaggcacttcactcgcggctgcgcggccctgtcaggagggaacgcagtgccaggtgcctgactcccagaggtaggagatcccacagggcagccccagagcccgcctctagagcactttcagtcctgggtggccagaagaagttagctttgggagccggctcttggttaggctggtcggggctggtggcttcctgtcccaaggctggtcatttctcccatgggtggggcaggtgctagaaggcattaactcttgaggtgcaggcagggagggccctgccacgggagagtccccaggatcccggttctcacctgctacccgtgccttctctttgcagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcaggtgaggcggggacagtggctgggaaggccaaggaggctgggggacagagggaacttagctggcaggggcttagggagccaggggatggaatggaattggggcagtcgacccttcccaaccagacactgctcttcccactcaccacgtgagtggaacagtgaccaagtggttaatcacaggtttcctggcccaactgtggaaattccctggtgagactggctgtgggcaggagcctcctgggggtgactggagctgctcctggcccctgttcctttttctcccctcggggtagcctctgagcattctccttctcgcagcctcagtcctcatcacctgtgtacggctccagtgccaaaacttccagtgtctccaaccctcaggacagtgttggctctccgtgctcccgagtgggtgaggaggagcacgtctacaggtactgccccagtctgcccagggcaccttccctcctgcttagaaatctcagggacctggccagggtgggaggcagcggaggcccgggagcaggcatagcaactgggccttgtggggttattctggtttaagctgcagaaggcctgtcggtgggcccgtctacctcatcagtgccatctccatgcagtggacattctgggctatcacagcatctccgtgtagctgaggaactgaagcaagacttcattcctcccctcttctttttttctttttttttgagacggggtctcgctctgtcactctgtcgcccaggctggagtgcagtcgcgcgatctcggctcactgcaagctccgcctcctgggttcacgccattctcctgcctcagcctcccaagtagctgggactacaggcacccaccaccacgcctggctaatttttagtagagacggggtttcaccgtgttagccaggatggtctcaatctcctgacctcatgatctgcccgcctcagcctcccaaagtgctgggattacaggcgtgagccactgtgcccggcctcctcccctcttcttaccacatcccttccctaccctctgtcctcttgcgggggaagacttcgcatctcctctgccttgttctccttgggaatctgggaactgccaagccagtacaaggccagaaagcatctctcactatcttctttcctttgcctctcaaagcttccccaacaagcagaaatcagctgagccttcacccaccgtaatgagcacgtccctgggcagcaacctttctgaactcgaccgcctgctgctggaactgaacgctgtacagcataacccgccaggcttccctgcaggtaggaccgggtccctggggcagggtctaccagggcccagggcccatctgctgacctctagatcccaggagggctcaagggctgagcagcctttttctctcctctctgcaagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtgtgagtacccactgggccctccccaggtggggaagggctggcccagcctgccccgggtccagtgtctgtccccttagccctggtatcacccactccctcccgtgtctgccatttgccaggcactggggggatagtggtgagtcacatggacaccatccctgccttcagccagtcactgccagtcagaaaggacagacgttgtgcaggctgagggcgcctggagcttagcagctcttagcacaggctttggggccacacagtggggttcacatcttggctctgacagttactgtcagctctcaagccttagttttcccatctgtaaaatgggacaagaacttatgggatcactgggataagaccacctacctcagtaagggtgagaaccagtaatccatgtaaagcgcttggaatggtttctggtgtgtagtgcgtggcacacatggtgagtgcccaacacgcgagctcttaccagtgccgtcgtgttactgcagtagcctcacctccatgtccagtgttgtggaggaaacacagggcgcttgggcttgtttcgcaggccagctttcacttgggctgggggctagaggagtcttcctggcacttcctggtgccattgaactgccctttcttctgacccagtgatgggtccccaggagagacagggagctggtggacctccctggggttggggatggtgagaccccagtgtccgaggtgagaggtcgatctgatccccgggaagtgtggggctgactgtgggctccccactgatgctgtgcccaccctgcagccctgccatcactgtgaaccagggcgagatgagcagcccgcagcgcgtcacctccacccaacagcagacacgcatctcggcctcctctgccaccagggagctggacgagctgatggcttcgctgtcggatttcaaggtgccctgtgaaccctccatcttccctgccctgccgcccctccctcatccttctcctcccttacctcagtgtgggtagctggatcttggcatctcagtgtttgggtgccttgcccctgagccagggacactgtcatgccctggccttgctgtgatgccaggagatggggagggagggccgggtcagcctgcctgaggattgcagtagccagtgaaggcagacaagctggagaagtgctcagctgggacattccttcctccctgggtgctcccagcctctcaggtcgaggggatcaggaggctgggacgctgggacaaagaaccttgtgttgatggctgctctgggtgggggagggcattctctgctgggccatgtgggacttgggagcctgtgcctgggaggtcatttgccctggagccccatctcccacgctagctgtcctcaacacatcctctttctttctgcctctgatcctgaatccacaagcctcccttgctactcttctcccatccttccctctcgccctccagggcctctgagttcccacgagcgtgtctgtgggaaaccatggggccaggcttgcacgaggtacctgcccttcccctcccctgctgggcctccccagtcctgccaggcctgagatgtttaatttagaggattcagtgtttccttggggattgatattgacagaactcaccagcagctgctgacttcatacttccacgtgggtcagctggagacctttggggcatgacctagggaatatgagaggggagtgaacggtccctgcacccttggccctgatggtgtctcctagcctcccttcagctgaggtttcatggtgggagacaggagtgtggctggggtggagggttgagcctggccctgtgacccttgcgtgctatagttccagctccaggccagtggttctgagcagccatggtcagaagcaagtaagttggattcagggcctggcctgagggagctgtgccccggtgcttttaaggctgccgttttctcagacagcctgtgtcctgatgccaggagaagcagcagtggttttagtcagatccctggagcaaggatgtggaagacgtagaggacttggggtgtaggaaagctgggattgtccggagggacatggccgagttgggccagtgtccgaggcgggttcagcagcccctggggctggctctccctccatttgtgcctggggctgtcttccgtagccacctggctccccatttgtccaccttaccgtggtcttttctttctcataccctccctgggtggctccacaggcacggcttggtggctgctttctcttgcttgggtttggtgagggctaagcacgcaaagcccagggaagcttttttggggtctgggtctccttcaagggtcagtcctgtgcgtcagctttgcagccaccttggtcagccctaaggccgagcccaccgcctgcaaggtgcagccgtcctcactcccctcatctctctctctcctctcccctctgcatttctctcttctccagaccagctcctccactgtggctctgagtgccccggggctgtccagctctgctccgtcctcatactgctcccttcctccttctcctcctcccatgccatctgtatttctgccacccaccactataccctcccctcgaggccagggccacactccggagttcccttgtactgagcagagtggacgaggccttctacctcctgtagcccccagctggcttgatttggctggtcttggggtgatgcctgacaccttcaactcaaggtctccctctgtggagggttctctgtgggcagtgggcacagagagtcagggtcgagattggaggcacctgccgaccatcacaagtgagctctctggggctccccgctgccacactgtaccctgtgctgggagcacagctctccaagagcctggggagccccaggggccaccagccagcccttcgtgcccagaggaggccttggctgccacatgggagcagccatgggcttcggaggtattcgggcctgagagaatgcccccctctggagctgctcgaagcttccaagaagtaacagagccagctgtagtggcagtggaccggcaggccatcttcccagatacctggactctcacggaggaacatggcctacagcaggagaggccaaggccagagccagggaggctgggaagcagctcccctgcctcagttaccacggagcagctaggtgcaaagatgaccgagaggggaagtgtggccaggccaacccagggacctgaaaccccaaggagcccagagggcaccacggaagctgccacccaggacgggaaggaacagccagagcttccatgtgccatggccatgggcacacccagcaccacggagaggatttccacctctggccaggcaggcaccagctcgcatggctgctgggcatggccattggcgggtctgagtgtgggccgctcctcgctaactgcatgcagcctcccactctgcgcatgtctgcttgggcagaaaatgctgagacactgtggccggacctgacagtcagcacttggcagtgggctctgtggacccagcatttctcatagcgtcaacccacctcttgccttgttgaggctttttcctttcagatgagctgtccttgacattctgatgtggtgaaatggttagcagcatggactttggaaccagatagacctagatacaaaccacatgtctaacacttgctacctctgtgaccttgggcaaccccctccctcagcctcagttttctcatctgtaaagtggggagaatttccatcaagattgtccggagacctaaatgagataattcctggaaagtgtttagaacacagcatgtggtccctcaataggccgtggctgacagtacttttattacttgctttttgcttaaattaaaactttatgccgggccaggtgtggtggctcacgcctgtaatcccagcactttgggaggccgaggcgggcggatcacctgaggttgggagttcgaggccagcctgaccaacatggagaaaccccatctctactaaagatacaaaaagattagctgggcatggtggcgcatgcctgtaatcccagctactcaggaggctgaggcaggagaatcacttgaacccaggacgcagaggttgcggtgagccaagatcataccattgcactccagcctgggcaacaagagtgaaacttggtctcaaaaaacaaaaacaaaacaacaacaacaacaaaaaactttatgcctcaccctggcacagtagcttatacctgtaatcctagcactttgggaggctgaggcaagaggatcgcttgagcccaggagtttgagaccagcctaggcaacacagtgaaaccctgtctctacaaaaaattaaagattagctgggcgtggttgcacatgcctatagtcccagctgctggggaggctaaagcaggaggatggctttagcccaggagtttgaggctgcagtgagttgtgatcgcaccactgcattcagcctgagcaacagatcaagacactgtctcaaaaaaaaaaaaaaaaaaaaatcccccaagctttatgcctctttggaaaacaaaacgaaacaaccaaaaacccccaaaacactaccaacaagtataatagcataatataatattagcataataatataaataagaaaaaaaaaactagttaaaaaagttcctggctagctgagcacggtggctcacacctgtattcccagcactttgggaggccgaggcaggcagatcacgaggtcaggagtttgagaccagccgaaccaacatgatgaaaccccatctctactaaaaaaaaaaacaaaaaacaacaacaacaaaaattagccaggcgtggtggtgcatgcctttaatcccagctactcaggaggctgaggcaggagaatctcttgaacccaggaggcggaggttgcagtgagaccagatcgcgccactgcattccagcctgggcgacagagcgagactctgtccccccccaaaaaaaagttcctggaaggaaacactttttctattataaattaaaaaaaagaaaaaagaaaaagccgtatgccttgtcaagggcatgcacttacatcctctggaataattcttgtgcaaaccctgtgcggtaagccaagaaaatcttgtggttccattttaaggaaggggaagctgaggcccatggcaattaagtgtcttgcccaaggtcagtggccaacttagaggtgaatgctgggtcagaggtctcgctcgcagcctgtgcttctggagccagtccgatctgccccctccccttgcctctacccacctccaccggtccaatctgccccctccccgtgcctccacccacctccgcttggttctttggtggttttcttttgtgctccctctcctgaggcatctgagtgtggcctgagcagcgttgtgcaagctgggagtgggacggtgacagcctcccctccccctccccctagatccgatctgtgatcaggaggagctgggagtctggccacgcacaccccatgtcccgggagccctcccctcgccgccggctggaccctgccaccttgagcaggaccccatcccaggaacagctcatcgcggagctgcaggggcggctgggcatccagcctgaggcagaggagccggcggaggcggcggggccctctgcccaggactggctgaccgagggcgtcatcatcactgtgcagccacgtgggaagcgggccggggggcagctcgtagagaaggtggcgaggagatgcccatggctggggctgggccagagccaagcacctggggtccgggttcttccctggccccagtgctggccggaggggagatctggggagagggtgggggtttcttgcctcctgtgactttggaagactggccccactcttggtgcagagtgggaaggcccagggggagcctggggaggtcccgccacccctgtgggctgagctggcgatttcttcctcatcgctctccctcctttcttctccccaggttgtcttccctcctggctctcccattcccctgagaagaaccatctctgtcctggcttctccttctgtccctttgctccagcatcgcacagacgccgcggccagcagctcttctcccctgcccagcctgctcgcctcctcccccctggggccctcagcttatacctgtggttcttctggggtccagagtgcaggggaagagccccatgatgagggggtgcagggccctgcccttcccattcctgcaccccacaccatgaggtccgtgggctgccagactgatgaggacccgctcttccccccgatgcaggcaggccttaaaggagcccctccctttctgtcccctgtcctaatgcctgagccatcccccactctgcacacacacacgtgcacacacacatacacagataccctccatccctccatctacaagccccagcacagtaaccacagtcctgccgtaaaccttgaccccggtcttcccccactcagaaggtccgctgccctcttgcttttctgtgggtccacccatgtctgctccttcctcgactggtcctcagtactgccccgggctcccatcgaggaaagaagccactccagaagggagaccagaaacctgtctcctcccttccagcccccaggcccagcgcccggtgaggcctcatcactgagcccggccacctccccttgccatttcctctgcctttggtcgactcccctccctgtccttcttcctttctccctaggcctctctctcagggctctttttctccagattttttcccccaattttggtcctgccggtgggggagaaaccctcagatctcatcctagattcccttttagtccagtgacaaggtcttgtattctttcttaatttttaaaaaagatttcttaccctcatctcttcccctatctaagatccagggcctggagcaaagagcggatggggagcggtgctgggcggccggctggcctcgggacggcgggcggagcagccccggagggcaggacgagggaggggtcagtgccaaggctgggctgggtgtcctgcgtgtcgtgctctccctgggcttggccatgcctgctgggtgccctcagcctttccgaccctggtgggcccctccgaccaccaggagtcctgctgacgtcactcccactttagggctcctggcccctggaggaggttgtacttcttgtctccatcagctcatctgtccaggagggagaaaagtacccccatccctgtgctgccagacaccgtaccccgagcctcaggagtcctgaccagccccctccgtgtccacagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggtgatgagggggagtgggcaggggtgtggccagtggactcctgcaggggtgggggtgctccggggctggccttggccctggaccgcattccatctcctcctcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggatgtgagttcctcatccggcaccgcgcccgcttccgctcattccagcttcaccgcagccctctgaggatgcagggggtgccgtgggaggctcagagaggtcacatgcccgaggctcacagggctagggaacagtggggccggattcacagccacacctgaaccacagcctgtcccgatgtgcatcgggcagccccacctcccttcacctcccatctcgattcctttctgtggagactcccaggactcaggagccctgaggagataaatggagttggatgccagcggcctcactctccctctctgtgaacttaggaaatgcctggcctctctgagcctatgtttcttcacttataaaatgggagtcatagaacttgtgccctctacttggggtgaggagtagaggagagggtatgtgtctggcttgtcccatcctgagtaactctgaattcttagaggcattcacagcacaattaggagagacccccatcttgggagtgttttgctctgtctatggctatgagctgcgggtggaaggacggccttgctgggcgtctcagttgtgagatctgcccagagctcagccttgatcccacattttgctttcacagaaagtggtgacagcccttgaccggacgtggcaccctgaacacttcttctgtgcacagtgtggagccttctttggtcccgaaggtacgggctggaccggcggactgacccaccgcctcttaggagggccggggaggtgggggtgggagacgctgctgaggttggagtcagagtggctccacttctggaagccggaatgaactgtgcctccaaaacccccgctccccagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggtaaggagcccctgaccacatctggaggggcgaggagcaggcagtggggagagaggggtcttcctcattgtgctgtctggatccaactcagaggcctcatttggggttattaattgggggagcaggcaggggatctccttcctccagtccagtaggtcctgggccagggtttgtactgaggctgggacaaaccaggagcaaggtagacatgtcccccagtccagccctgtgcagcggccctgggccattcctatttgggaggagagtgtgtgagaactaaatgagataatgcaagtatttagcagactcaacagaaatgggcagtggtttccaaaaccactgcattctgggggccccacaggggttattaatgattcaacaagggctctctgaccaaatgagtttgggaaacactgttccctgcaggacttctcagagccttttcttttcttttctttttttgagacggagtctcactctgttgcccagactggtgtgcagtggcacgatcttggctgactgcaacctctgcctgctgagttccagtgattctcccgcctcagcctcccaagtagctgagattacaggcacacgcccccatgcctggctaattttttgtattttcagtagagacggggtttcaccatgttggccaagctggtcttgaactcctgacctcaggtgatccgcctcccttggcctcccaaagtgctgggattacaagtgtgagccacctcacccggcccctctcagagccttttctacctatatgtgatgtgaatctccaatgagaatctaggaggcagagtttgactacagaccagtgtcacacctgtgtttctgggaacactgttacagccacctggctaagtgctcaggagtcagacctgtgtatgaatccaggctgtgacctcagtagctgcatgaccctgggcaagttacttcacctgtgtgcttcagttgcctcccctgttgggagaactaaataatcccagccctgtgggaggccgaggtgggaggattgcaggaggccacatttgaccagcatgggcaatatagtgagacccccatctctacaaaaaaaatttatttaataaaataaaaatgaaaaatgagcgtttaggacaacacggcacatgggaaacgcctagcaagtaggagtcactccgagcgtgccgactatgcccacctcggccccatcacacagggtgcagctctagcccgaggggcagctccctgagcccctctctccgcctggcaggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttcacctgtgctagtgctatttcttggtggtctgaacctcatggtcccagcagagaccaaacccaccccagatgcagctggatcaccagatggagggtaaattgtggatgtttcctttcttgaggtcaaaatccctggggctggggtccgtggtccttgcctgtggtcacaggtcctccccgtgggctttgctcctgcctgggcagttggtgaggacaggctggggagcagcgggatggggccctgtggggcagggcctgcccagggtgtgatcacctgggtttaccaagggcatcctcactcacgggcttgtgggtggctttccactcatttagaagtagggaaagaggctctaggacaagaacctacatgtacaaggcaatctgagtgagggcagagccatgatgcggacccagggcttgcctctgcctgtgttcctgcacagaaccagacgcggccgtgcctgagcccacacaacgtgggttagccccttccctgccgaaggcagttacttacagttgaggatgggtctctactgcctcctcgtcgtcatgtccggatttgcgtgcttcctctttgctccggtcagatccagagctccagtcctaggccctagagcagggatgtccaattttttttttttttttgagatagagtctcactctgcccaggctggagtacagtggcatgatctcggttcactgcaacctccacctcccaggttcaagggatcctcctgcctcagcctcctgagtagctaggattacaggcagctgccaccacacccggctaatttttgtatttttagtagagccagggtttcaccatgttggccaggctggtctcaaactcctgatctcaagtgatctgccttggctcccaaagtgctggaattacaggcgtaagccaccactcctggcttttttttttttttttgagatggagtctcactctgtcatccaagccagagtgtagtggcacgatctcggttcactgcagcctctacctcctgggttcaagcaattatcatgcctcagcctcccaagtagctgggattacaggtgcccaccaccacacccgggtaatttttgtatttttagtagagccagggttttaccatgttggccaggctggtctcaaactgctgatcccaagtgatctgcctgcctcgacctcccaaagtgctgggattacaggcatgggccactgcgcccagctgggtgtccaatcttttggcttccttggggccatgttggaaaaagaagaattgccttgggccacacataaaatacactaatgatagctgatgaactagaaaaaaaataataaaatcacaaatctcataatgttttaagaaagtttacaaatttgccctgtaattccagcactttgggaggccgagacgggcagatcatgaggtcaggagatcgagaccatcctggctaacacggtgaaaccccgtttctactaaaaatacaaaaaattagccaggcatggtggcgggcgcctgtaatcccagctactcgggaggctgaggcaggaggatggcatgaacccgggaggtggagcttgtagtgagccaagatcacgccactgcactccagcctgggcgagagagcgagactccgtctcaaaaaaaaaaaaaaaaaaaaaaagaaagtttacaaatttgcattaggccaaattcaaaactatcctgggccgcatgtggcccacaggccatggattggacaagcttgtcctagagcttcctgggcagttttgtttaaccttgagctgtgtcttcacagcttccctgttgtttggaacggttctccaaaagcagcatgttgaattctagtttaaactcttcccatgctatagtgagctcagaagtgaaaattaccttcaacgctcacccaaagagaatgatggggccaggctctgtggctcatgcctgtaatcctagcattttgggaggccaaggtgggaggatcatttgagcccaggagttcaagagaataacttggtttattcttccagcccatgttggatttattttatttctagaaatgggtatggtatatttccttttttttctctcttttttttttttttttgagatggcatctcactctgtcacccaggttggagtgcagtggcgcgatcatggctcactgcaacctctgccccccaggttcaagcgattctcctgcctcagcctcctgagtagctgggattacaggcacccgccaccacgccaggctaatttttatacttttagtagagacggggtttctccatgttggccaggctggtctcgaactcctgatctcaaatgatccaccctcctcgacctcccaaagtgctgggattacaggcgtgagccaccatgcccggccaggtatggtatatttcactgtaatgtgcttttcgctttgctttgtggatattttcccatgtcaataaatatagatctgtaccattttctaatggcttcatggtattccgttatattgatgtactacaattagagatgatatttatatcatcagagccaggaggtccttggaaatgtaccttgtgcatatgtatatacttggaaaagtgcgttcagagggaggctgactcagggtttggaatggactgtatagcacagtgaggcccaggggctttgaacttcctcctagatttcagttctgaagccttcacttactggctgagagacttgggcaaattatttaaccttcctgtgagtattctcatcgataaaatgggagtactgacagtactgtatctcctcagaggattgttgcaaagattagcttcagtaatgtgcacagagtacttaggacaatacgaagtgtgcagtaatacattgccattaaaaagagatctcgggtgtccgcgggttgccgaatggagctgagcatcttgatggaaccagggatctcagggtgaagactgaagccctaggctatggcggaagttgggtgcctgaagtacaagtggaaatatgccaactgaacattggaccaccacagcctgccccctggctcagcgcccagtgccaacagaacacctttcaggatccacagcaaggcagacaacggaatccacacaggcttccattctcaaaaggccatcaaaacataactgccggccggccacggtggctcatgcctgtaaccccagaactttgggaggccgaggccgacagatcacttgagctcaggagtccaagactagcctggcgaacatggtgaaaccctgtctctactaaaaatacaaaaagttagctgggtgtggtggtgggtgccggtaatcccagctactctggaggctgaggcagaagaattgcttgaacccaggaggcggaggttgcagtgaactgagattgcaccattgcactccagcctgggcgacagagcgaggctccatctcaaaaaaaataaaataaaataaaataaaaattaactgctgacgagacaatttatatttccttcccctcactacactccctgaatgttctggatcagtgtgtctcacacctttggatcttacaagctagttgggaaagttctatggagaaggcaaagattttgaaggcacaggagactatcatagacactcacaatgatcatagatagtagtatcatagtaccatagatactcccaatgatcatagatagtagtatcatagtaccatagatactctcaatgatcatagatagtagtagcatagtatcatagatactcacaatgacatctccctaaaggattcaaaagctttgcatcaaccaaaggaaaagcaccagtgagagtcaagatacagttccagacagatgctacctctgattgtaaaggtgtccaggtcttgtgcttatgatgtgctcacatcagtgccggaaacgatgaagacaaagagactggaaggaagaacatgacagtttagtgagtactaagtattgtcagttagatcggggtccctaactctcaggccaaggaccagtactggtctgtggcctgttaggaactgggccgcacatcaggaggcaagcagcaggcgagtgagtgagcttgtcgtcctgtcagatcagcagcagcattagattctcacaggagcgcgaaccctattgcaaactgcatacgagggatctaggttgcacgctccttatgagaatctaatgcctgatgatctgaggtagaagtttcatccccaaatcacactcccctctgatccctggtgtctgtggaaaaattgtcttccacaaaactggtccctgttgccaaaaaggttggggactgctgagttagatcgtaacacttaaccctgataactctgtgaggcaaggtttgttcggcccaataaaaagcagaaatatgggtcaaatctaggttcaaagttgatgctcattctacgatacatactgcctctttcaacaggtatcctaataagtaccttcctggagagttttgttgctatatgactttctgtaattactttcttttcttttttttttttttgtgacggagtctcactctaaatagtcgatattttaagcccttcctggagagttttgttgctatatgactttctgtaattactttcttttcttttttcttttttttttttttttgtgatggagtctcactctaaatagtcgatattttaagctttggggatcacacagtctctgttgtaaccactcatttgtgacagccatagacaatgtgtaaacgaataggtgagcaaggctatgtcccaataaaactttatttatttatttatttatttatttattgagatggggtcttgctctgtcgcccaggctggagtgcagtggcacagtctcagcgcactgcaagctcagcctcctgggttcacgccattctcctgcctcagcctcctgagtagctgggactacaggcgcctgccaccatgcctggctaattttttgtatttttagtggagacggggtttcaccgtgttagccaggatggtctcgatctcctgacctcgtgatctacccacctcggcctcccaaagtgctgggattacaggtgtgagccactgtgcctggcctatttatttacttttattttattattatttttttgagatggagtcttgctctgtcaccaggctagagtgcagtggcacaatcttggctcactgcaacctccatcccctgggttcaagcaattctccagcctcagcctccggagtagctgggattacaggcggctgccaccgagcccggctaatttttgtatttttagtggagacagggtttcaccatcttggccaggctggtcttgaactcctgacctcgtgatccacccgcctcggcctcccaaagtgctgggattacaagcgtgagccactgcgcccggccacaactttatctacagaaacagacagtagccatatttggcccatgagctatagtttggcaaacccttgtgatataccaaagacagtcatttttgacatatttcagtctgcatagtttcagagtgctctgactcctgtaattcttgcaactccctagttctgtatcctgcagtgattccccagtctccctcaccatagaagcctccatgttttaacgtaacaaagccttggaaacaagggtgtgagccaaggactcgagcttgtgcccaccatggtgaaatttgcgtcattagaagaatatttacagctgggcacggtggctcacgcctgtaatcccagcgctttgggaggctgaggcgggcagatcacctgaggtcaggagttcgagatcagcctgaccaacgtggagaaaccccatctctactaaaaataaaaaaaattagcccggtgtggtggcgcatgcctgtaatcccagctactcaggaggctgaagcaggagaatcgcttgaacctgggaggcggaggttgtggtgagctaagatcacgccatcgcactccagcctgggcaacaagagtgaaactccatctcaaaaaacacaaaaaatttacaaaggactttagagaaatcagagtcagtaccctactgcttgcaacagagctagccctgtggtaggaaatctcatacagtgggtaggctctaatttcagagaataagaacctggcctcccacagaggtctcagttggagctactgatttatggtagaacaagatgagattgacagcacttgagctacccgtatctaaattctgttcagggaattttatgccagtcagctgcaccaatataccctgccatgcaagtgtcttggttttaaacctgctaccgccaccaccccccgccccgcccaccactttaccaaattattcatgttggcctgattttcttactcttccatcttttctggcattttttggggggtgtgtgtgtgtgtgtgtgtgtgtgtgtgtgtagctgctttagagacattctgccacctttctggacttcgctcgatcagggagagtaggcagattgtgattggaatctttttttttttttttttttttttgagacagagtctctctctgtcacccaggctggagtgcaggggcacaatctcggctcactgcaagctccgcctcccgggttcaccccattctcctgcctcagcctcccaagtagctgggattacaggcacatgccaccacgcccggctagttttttatatttttagtagagatggggtttcactgtgttagacaggatggtttcgatctcctgacctcgtgatccgcccacctcagcctcccaaagtgctgggattacaggcgtgagccaccgcacctggagtgattggaatcttaataacctgtcaaaacagcatttaaatctcattcatgttattttccatccttcccatggaacacagatagccaagaagacaaataaaagagaccccaggccaggcacagtggctcacgcctgtaatcccagcactttgggaggctgagctgggtggatcacctgaggtcaggagttcgagaccagcatgaccaaaatggaaaaaccccgtatctactaaaaatacaaaattagccgggcatggtggcacatgcctataatcccagctactcaggaggctgtggcaggagaatcacttgaacccgggaggtggaggttgtggtgagccgagattacgccattgcactctaccctgggcaacaagagtgaaattctgtctcaaaaaaaaaaaaaaaaaaagaaaagaaaagaaaaaagaaaagaaaaagaaatacagtaacgtgaaatcgagctacttctaacttttttttttttttttgagacggaatcttgctctgtcacctaggctggagtacagtggcgcaatctcagctcactgcaacctctgcctcctgggctcaagcaattctcctgcctcagcctcccaagtagctggaattacaggagcccgccaccactcctggctaacttttggtattttttagtagagacggggtttcactgtgttagccaggatggtctggatctcctgacctcgtgatctgcccacctcagcctcccaaagtgctgggattacaggcatgagcccccgcacccggcctacttctgacagttttatggtgtgtgatataggatataacatgatgtatgaagctctttgtaataatttttaattttgaaatagctgattctttggggatcatttaatacataattccataggtttcagtgaaaaaaaaaaaaaaaagagatctcagggttgggcaaggtgtctcattcttgtaatcccagcaatttaggaggccagggtgggaggattgcttgagcccagaagtttgacatcagcctaggcaacatggcaagaccccatctatacaaaaagtacaaaaaattagcttggcgtggtggtgtgtgcctgtagtcctagctacttgggaggctgaggtgggaggatcacttcagcctgggaggtcaagtctgcaatgaactgagattgctccactacactctagcctgggcaacggagtgagactgcttctcaaaaaaaaaaaaaaaaaaaaaaaagatttgatggaggtgaattattctatggatgtttgttggctagttttctaggaagagggaatggctaatgcaaaagcccccaagtaaagcctgctctggaaaagcagcagagcatcatctgggtagaaagcaagtaagtgaggaggaaaacatctgagatgatcagagtgggcgtgagggacagataggtaagggccttgtaggtactttaggttttagatttttactctgtaggaaacggaaagttttaagcagataaggagatgagctgacttaggtttttttttttttttttttttttttgagatggagtccctctctgtcacccaggctagagtgcaatggtgtgatcttagctcactgcagagctcacagctcccgggttcaagcgattcttctgcctcggcctcctgagtagctgggattacgggcatgcgccaccccacctggctaatttttgtatttttagtagagacggggttttgccatgttggccaggctagtctcgaactcctgacctcaggtgatccacccgcctcgtcctcccgaagtgctgggagtataggcgtgagccaccgcgcccggccaggttttaaaggatccctctgttttggtaggcggaaaaactagagaagacgagagaccattctgaggccgggcgcggcgggtcacgcctgtaatcccagcactttgggaggccgaggcgggcagatcacgaggtcaggagatcgagaccatcctggagaacatgatgaaaccccgtctctactaaaaatacaaaaaaaaaattagccgagcacggtggcgggcgcctgtagtcccagctactccggaggctgaggcaggagaatggcgtgaacccgggaggcggagcttgcagtcagccgagatggcgccactgcgctccagcctgggcgacagagcgacactccgtctcaaaaaaaaaaaaaaaaagagaaaccattctgtttctaagcatgtgcaattatgtctcagctccacgtcataccttttagtttgctgagctcgccaggtggcacagggaaccgggactccgaattcgcagctccagctccagctccagcccagcaggtggcagcagctcagagcaagctcctccaacgcgaggcagcgccttccttcgcgaccctacttaaaggcggctttccgttggctggagtggcagcgatattatccaatggttgcctgtattcgttcagctttgtctgacgggcgatggcgcagccaatagacaggagcgctatccgcggtttctgattggctactttgttcgcattataaaaggcacgcgcgggcgcgaggcccttctctcgccaggcgtcctcgtggaaggttcgtgtgctagttagatgggcgccaggggtcgccggcgggaagcatggaggggtctttgggggcctttgggaacatggagtcctattctgttccgcctggggcctcggtggcggcttgcacgccccgagatgacggccgctgccctaggcagggccggcgggcgattgcgcgtgtcctgctcctcttaggcccgggaccgcgggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatcgtaagtgcagggtgggtcgcctctgctcttcatgttgccccagcgcaaatagggacagtcagctgctatgtgctgagggtctactcacaccggctactgaattaggccatttttgggaaaatactgtttagttaacaatttcctgagataggtcccttctgttgcagataaacgggctcaggcaagttaagtgggtcctaagatgacagcattcgtataccaggtctgtctggcttctaaaagagcgcgctttatacttttttttttttaaacggagtctcgctctg

SEQ ID NO: 905 - DNA, 3611 bp, Homo sapiens
aaaagttgcggggcatagacgagcggccccgggacgggcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatg

SEQ ID NO: 906 - protein, 564 aa, Homo sapiens
AGARGPAMDDLDALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 907 - DNA, 31400 bp, Mus musculus
  misc_feature (1)...(31400): n = A,T,C or G
tttgaggaccatctgtctatctaaagtatatctgaggagacaaaagctgctggcctcctgccattcgctttctgcttcactttgagaacacacccaggggttaaggaaagcttacttctgtaactagctaaactagttcctaacaagaccacaagtctgattacttagaggtgaccaattcttaattatcctaagcacttttcagtaatatctttcataggactagaactttacatttttaaatgacttgcactcaaattatatgcacatataccttaaacaagagttgaatcagccaggcagtggtggcacacgcctttaatcccagcacttgggaggcagaggcaggtagatttctgagttcgaggccagcctggtctacagagtgagttccaggacagccagggctacacagagaaaccctgtcttgaaaaaccaaaaaaaaaaaaaaaaaaaaaaaaaaaaaaagagttgaatcatacataaagtatgttgtagcaaataagaccttaaatttctatcaatatgcacgaatccataccaatgtaaaatatttgagacttgttacttttttagtctaaaaggagataaaaaacaatccacctttcttttcttcttttacaaggagatacaagaatttatccttttttgtcttaatatccctattgcccatgaaggcaaaggaccatgaacaccagtagttactttgtaacactgagttttgggggctagggcaagaggtttatttgtgtccaagtctagagcagcactgccttcagcagcacacatgagatcccagtacttagttgaggtttttctgcctggtggaccagcaggaaatgctcacatttttcgctgtggggccttgagctggcagagcctcgacttaatttcctgatggcaagagattaccttgtatgtccctgctggacctgcactcgttagtaccctttgccacaatgcctgtgtaccctgggaagcctaggtgttctttccggtttatatctcaggaaaccattgccaccagaaatggctggttcccttctctggcagaaagtactggatttttcacaatgactacactgggcattttgagctctgagactttagcagcttgtccacaatttctttgtaaatggctgaattcactgcaattaaagagccggatatttaatatctgagacctctagttagggcttatcccatggcactggcatgattgctcgtgaggacgatatgagtcatggaccttatccacttgtccatcaacgctgcttctacctttaatggtctaataactcttttacacttggtactagcattctcaaacagcaagtgctctatcagcacctgcctcacctcagggtctgatatgactttgtttacaccaatccttgcaagaaatctgtgaaggctttcccagagacttgtacaatcttagtgaacgaggtgaatctttccccaggctcctcaaccttctcccgagctcttacagccgccaagcgacattgctatatagtgatatcagcaagttgaatccattcttgtcgggcagaataccgcccttcaccaagcaattgatctttagctacattcattccccttgctctatttcttcattcaatattcttggcttcctccttctacattaaacattgtaactgctcaccggcctccagcacagctgttactaaacctttgcatgttgggggaataactctattttgggtagcccagttatttcatatttgtttaacataggggaatgcattccataggaaataatagcctctctaaaaatgcctcagatctaccatttctataggacgacacattatctcatcattatcatgatcagcaccattggaaggcatgtgctgcataattactgggaaaactgatggtgacttcataaccttaggcccctccctcctctggcagcacactggactctagattaaccctttctcttgaaacaggaggaagaggaggaggctgtcaccctgcatagcctcctgctcctccccactccccactcttctcaggggctgtggggacttgaaatggaaactgtgccacacagggcagggccaagatctgccttccaatccagtctgcttccctctttcatcctgtgggaagcctgactctccatcatcaggttccctttttttctggcactactcacttccatttttaccatgacctctccagttgcacggccaattctgcagtcttttcaaaaatgagagaacagagcgaccattctgagtttcccatttcatccagtttttgtttctcaggcccttccatatcctcttgcaatttttcaaatagtgcaaccattctcctaacatatttttgagacagtatacaggagaagggggaggggaaggaggaggaggaggaagagaaagaggaggaggagaaaatgacctttgggaacaaagcaggggaaaacccagtgtcaacagcaataagcgttttgctgacatcccaaaacagaatattcattccttcataccctctacagcattagaaaccaagtttcgcattctgcctagccccactttgggcaccatggttaggtgtacttgtgtgtgtgtgtgtgtgtgtgtgtgcatgtgtgtgtgtgctactttattgggttctcatatctaccacccttcactccaatcctttccaatccccaacactaggtagatgtggagaaaggacagagggggaagggcctacatcaccttagactagtttctgctgattaggggcatagagttattatggggaagtgcaatcttcatcaacaagttatctttaaccagcaaaccggcaatccagtaatgcaacagcaggaaccaccagcagcagtggggagtgnnnnnnnnnnnnnnnnnnnnctttggcaagtttgtctctctgaagtcatcacaagcaaagcacagcaactcaatgtaagatgaaccaactgatcccatgtgtgttgtcaatgaagactggtgaggaacaaggcaaacttgctccagctcctgctgtctgtgggcccacatttatatcctttctaaacatcatgtgtcctttcaagtgtctgctatagcataacattctttcatctgtgtgccccagcaaaacatcatttgacataactaactttccgaagaaaccaggtgtttccacttcaaatcttccttgtcaggatatcgtcaaaccaggtccagcaaatcagcaatccagcaaacacaacagcaggaaccggcaggagcaggggcagcagtaggggcagcagcagcaggggcagcagtaggggcagcagcctctcagggctctcgaatttatagcttctcaaaagtccccaaaattccaaatgtaaactatctgcatctggaaaaaaatcactcccctccaagagcaggagacaatcacagttagcagctgacgacaatctgaagcagccccatagcccacacctgggattaaaacaaaaacaatctcataatgtaactgggcttgtaaagaaaccaaagttaccactaccttttccccctttagtccaataaatggccttgtccctaacaccaatcaactataaacaataaaagcaattatgagaagtatcagataagaattatctttgcaaagtcgggtccatatgtatttagagaactcggagaatgtattccactccctatcctatcctggtgagtctagagttctgtacctaaatcgctttcttatcttaacttccatttatcaacctaaaaacatcttttagatctaaaacattttcatagatcctaaacaactcaagcttttatgtctttaatctttaataaggaaaactgtaagactgtaactatctagtcttcaaccccatcagatcggagaaggataagtactacctgagtaacggagtccagagcaaacagcttccaaaataacttagctagagatagaagagacagagactgctggctgcctggtcagtcacccaaggtccccctgtgtcggtgggtccaatctttggccagctgggccagaatatctgacagactcatctgtgaagcaggagttttgaagaattggcctatcttgtcttggcaaagttggcagttgacttcccagtgtcctgcttatccacagtttggacagcatgctatcatcagtaaggggtgatcttttattttatttttagtgtgtgtgtgtgtgtgtgtgtgtgtgtgtgtgtgaacgtatgtatgtatatattatgtatgtattctttgcctagtgtctatctttgctacatttgaattaaactccatgtggagggttttcggtacccatcatcttctttgaagtagattgagtgctcccaggagctcctgggactctgtcaggaaaagccttttattattaaaacatcttaaatgaaatattgtgcagctctctaaagtgtttgaggaccatctgtctatctaaagtatatctgagaagacaaaagctgctggcctcctgccattcgctttctgcttcactttgagaacacacccaggggctaaggaaagcttacttctgtaactagctaaactagttcctaacaagaccacaagtctgattannnnnnnnnnnnnnnnnnnngggggagaagcaagggggaggagcaggggggaggagcaaggggagcagcattggcagcagctaccccaggccctctcagggctctcacatttataccttctccagagtccttagaattccaaacataaactctctgtagctggcaaaaaagaaaaaaaaatcacacccctcctagagcaggagacaaatcatagtgttctgtggacaatcggaggcagcctcatatcccacacctgggatcaaattcacataatcatattcacataacataactgggttcttaaagaaaccaattttctcactacagcttgacatatcaagttccagaatagccagagctacagatagatccggcctaaaataaaccaaaccaaaccaaaccaaaacatttaaaaagaaagatgaaagtcaccatgtttacagtggatagcttgtgatgcgacaaaagaacatgactacagatacaaaggtcagccctgcacttgtctctgtgaacatatcacagtgaggggcgtgggaggagacaggtgctcatgtagtccaggctggcattgaacttgctaggtatccacagctatccttgaactcctgtctgtacttcccaagagctaggattatacaagttactatttcttatttgtaaataacagtctagaaatcagccaggggtttactagaaagagatataaactttaacaaaggcctctttaaaagtcacacctcaagacaggcagttgtggtacacacctttaattccagcatttgggaggcagaggcaggctgatctctgagtttgtagccagcctgatctacagagtgagtttcaggacacccggggctacacacaaagaaatcctgtattgaaaaaataaaactcacactccaacattaagtcaagaagatggcaagttcaacctggtgtctgtagggctggctaatttgtaggagctcaagaagaacaccatatccttggtttactggtttctggaagctgccgactcctctgctcgctgagccccttcccttcaaagccaaggttgagctcttgcgtcccaccgccctgacccttcctcctcctggaacatctttgttctcttctctagaaaaagaccttcctttgaggtcccctgaagttaaagtgggatgaccaggatagcaagggcgctcatccaactagagagccttcccttgagcacggctgagttttgtcaggtaacaccacatactcataggcagctgggagaggccttctctaaggattttagtattacagctcttttagacaatactcaatgaaacagctctcttagacaaacttcagtgaaacaccttgtgtgcatacatgttactcggtgtgaacgagaactacatatgaaccttggagagtgggaaggaggtttcaagatgaatgtaaatcattggctggagcttaacttactgagaatgcttcatttacataaagacgaatcccagggaccccaggtatttgctgggcaggttcttatttggaaagagggagttgaacctggagttttgtcaaggacaacatgcccttcctcaggtagagggagtcggggtcaggcagagaagcggagatcctgctggaaaggggaggactccagtttgtgctgagctcgaatgagctacctagacgtggtagactatgagcgaacttaaacagcaggagccaacatttgtcatttgtcctcatgctatcagatcttgggtgatgacattgtggtcctgaagtgctctgatctctcagttcttcttttaaagatttatttatttattttatgtatatgagtacatggtagctgtatagataaatggttgtgagccatcatgtggttgctgggaattgaactcaggacctctgcttcctctggcccgaactcaggaactctggaagagctcttaaccactgagccatctctccagctcattttctcagttcttaaaacccccagtgtttctgacatcaggacagtgtgggtagaactgagtcccagacctccatatgcatgtccaactttgaaagataatgtgaatgccaatacaaaagtcttcatgcacactcagggagggaaagactcgttccccttacccattcctacctgtaaaatacaagaccatctagaaatccatcaagggatacagacaggagctctcatgggcatccacagcctacaggatctgtcacatctcatctaccgggtgcttggatgtagacactacaagctgacctaagattaaagggaatagaaaatgtcaagaagagatagttcaccatcaccagaggggctaaagaagagagaatccagatcactcctgatgaagacttctaaggcagtgcagtgagccgagcctctcagcccagctccatctaggggccacttttctaagactctcccagatgctgttttcccatgcatactagaagctcagcgtgggcaccttacatccgggcaccttacatccaggtcttgttcacagccctataatggggctctgagaactgagacattgtttctagtccatggaatccccgccagcctctttaagggcacttatgctctgcccgcccccacaccctgccatgccccgactgtccccacccatcctcgaagccagctgctctgtgccctcctactcactcccccacccctcacaggcccccagggagtcacaagtccactgcccagtctcagggggaggccctgccacaggaaggtcctgggctgttggaaactttaatcaagctgggaccgttaacagctgcagagaagccttaagaaaccaatgaaccaccaaaaggaaatcatttgtaaaacctgttgtcttgacctgtgatgactgtgaaaagatgtcacattgtttgctgctaagacaaaagacagcagctctcatccagcagcctcagcaggatctgtttttccttctccaggggcattttgacacaggcactcacctcccacagataccccccccccaaaaaaaaaggccccgtgtgcagggccacgtgcaatctctctctctctctctctctctctctctctctctctttctctctctctctctctcacacacacacacacacacaagtgtgtgtacaacccatctctcctcagacacctttctctggtgatggtgccactctctctgaggcagactccactatgccacagaaaagggctctcctaacatcccctggccctgcccaataccaccagtcacgtgagttggtagcctgcggtgagagaactgcacctttctttcttcctccccatagttgtagggacaactggtgaaggggggagcggatgtggcccaaagagggggcggttctcacctccatatctcctccaggttcagctcagtccaaccctcaaggcatgagggccttttgggattttttttttttttttttttttaaagatttatttattattatatgaaagtacactgtagctgtcttcagacacaccagaagagggagtcagatcttgttacggatggttgtgagccaccatgtggttgctgggatttgaactctggaccttcagaagagcagtcgggtgctcttacccactgagccatctcaccagcccccttttgggattcttataagaggctacattgtgataaaaagagagcccctctgggcactcagctcagcagctctcctcctgcagtctccctcctcccagatcaaggaggccctcctcttcacctcttcacctaaaataacttaggctgtggtctcccctacaaatacctcttctcacctgtgtctctgtttctttgtgtgtctctgtctctgtgactgtctctgtctatctcccccctccccccaccccctttctctttctctctgtgagacatggtctcactacataacccgggccagcctaggactcctggtgtagatcaggctggcctctgactcacagggatttgctgtgtctgcctcaggctcctgatggctgagataaaaggtgtgcaccaccacacttggcccaagtgttcatttttttttggggggggacaagcatgatgggacaatgtttggactgtatgtgtgtctatgtatgctaggaagtgaggtcagaccatcatatgtccccctggacctctgagctatacctcggccctcaggaccttctaagggaagaacaaggggaaatttctttgcctcaccatggccaccctcgtctcgtttttgttgttgttttgttttgttttttaggttttattttatgtgtacatgtgttttgcctgtatgtatgtctgtgcaccatgtccatgcctggtgggtgggatcccctgatagtggggtttcagatggctgagaatggccctgtgggtgctgggaattcagccggggctctgaacgtcagagccagctctccagcctaccatatcctgtactgaatctcacactcaccgtttcctctcttccctctctggaagggtgtatgagaactactattgctccaggctagacctttagctcagcccagagctgctccaagtggacgctgattcctgataggctctgatgtgggaacacagaggacaccacaggatatcaagggaaagaagggcatggggaggggacagctactctcgggcatggtcaggtagatagcagggaaaagctatgaagtggagagtctgggatgctcacagaggaaacccagcttgttcctgcctcccttgcatcctcccaaaagctgtcagattcccagggatggcttcaggctgacagctcagcaagcgggaggggaggagtcaggtttacctcaggagcactccatgcagaatggggctcatgaaccttctctcctggtaacccacaggaatgaggagctaaggctcccatggtaggaaccccaaatctgatggttgaggacggagctgcaacctggagtagtgattggggtgatgtcctggggtcagttaagagccagagtcccaactatgcattgatgggtctcagtgaatggcagtcaggaggaagtggccaaccagggaacacacagggactggtatgaggatcttaagcaccgaggaggcttaagtgggtctaggatgccggaggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatggctgacgctatcacgtatgcagacctgcgctttgtgaaagtgcccctgaagaacagcgcatctaaccatctaggtacagggtaagtcctgcttgctccccccaccccccattatattccacccccactccacagaactcattccagactccgactttggagctttttcctttccagactgtgaggcctatgaagatggggaactcacctacgagaatgtgcaagtgtctccagtcccaggagggccaccaggcttggcttcccctgcactagcggacaaagcaggtagggcagggaggaccagggacgcctacagagagtgtcttcatccagggagaacagagcagtcttggagaaagaagcagggctatttctgagaacgagatgtcagagagccaaggggaggaggagtgggaggtgctcacggatagctgggttttcaggatccgggcagcccggtgtgagagcggtttcagtggaaaacaggagtggggaggacgtggaagaagtacgaagggtcaccgacaaaggaccctaagaaaatgataaggaagagagagcccaagaagggctttctatggaggacttcctggcgtggctcttctggggacaagcaagaagagagctgagttcatcccaaaagttccgaaggcgacagggacgtgtaccccaggggcagcagatgaagttcagagagtgatgcggctgttccacagcacttagctcaggacagactagggtctcagcgtggggctggagagaagggaggttacagggactttccatcctaacttcgggcgccccccttccacaggggtcgggtcagagcaaccaactgcgacctggagctctgtgaagtcgtctgctctcagggcagattccccgctgtgcgtattcttacccctccttctcgcccccaccttccccttcccccgcagccccagcgtgccattcaccagctgcctgccaggagggcgcagggcatggggacatcagacgctaagtactcatgtgcattctggagaggtggggctgggttctgccccgtgccagacgagcctttgggacttccacgttagcccagccactccactacctaccccatcccggtagcgattgttcccacttggagtcccagatcacaattcccctgttcggatggtctagtcacgtgcctccaggttccttccctgtatgaaatttagtttcttcagccaggtaaagccccctcaatccttttggccagtgtcagtccccagcacttactacctacaacaaaatctgcttaggaatgctttcattttctctcactgtagcttccaggagctgactgcctatcatccctgtcccctaaggtcctacagtctgcttgcaatacttcttgcttggccttctcgtgtcctgtctgatgttaggggtggctgtcatctgcctgggagttcgctgtgagtatgggggccactcattctaaacaccttcccttctctcccaccaagtggcctttccttagcacagctcaaagacactgttctgacatccttggcttttgggtctggtttccagctgggacaaccctggagtgctcctgccttcttatccttacccagttcagggttccttaaactccaggcagccagatcttaagttcaggacatgatacaggaagtttcaagaagtagaaaaggttgatgttgaagtcttagagcaccgggctacagctggaggaagtgcactcaagtctccctgcagcacccctcacccccaacaagggtctccatatgtagcccaggctggcctcaaatttgctgtcctcctatctcagccttccctggattgggatacaggtgtgtggtgctactcccaacagtttctcctccggccaaacagatctgcaggtgtctcggcagttccaggaggggaccaggatttgggaagccaccaatagcagcctgcagcagcagctcagggagaagataagtcagctggggcagaaggaggtggagcttcagaaggctcggaaagagctgatctcgagccaggacacattacaggagaagcagaggactcacgaggacgctgagcagcaactacaagcctgccaggctgagagagcgaagaccaaggagaacctgaaaactgaggaggagcggaggagggacctggaccagaggttgacaagcacgcgggagacactgaggcgcttcttctcctgattcatcaggtatctgctctgggattagggagatggggctggtggccaatgggagatggactaggagtctctaagtggctgggtttgtctagctctcataagtcagtgagttgtttctgggctatgtgaactcggttattgatgatgaccaagctgcacattggatttatgggggtgcacccagctctatggcagatcatgaatgggaagagaagaggaagctgtctccagcgactcacttcacattgtccaaatctttctgattcagggggcatccagatgatcagtgatcaggggcttgctatcttccgatagcaaaactacaggcatctgtccttagctctcattttcttaagctcctgttttctctgagtcatatgtgtaaatgtgtgcctctcttctcccccaagcctctgtgcatgcaagtgtgttttgcactcatgtgtttgtgcgtgcacaggtcaatgaagagactcttcactgaggtagggaatctcaatcagactcagagctcatcaatatggctatagccagcttttggtgaggattctctgaccctgccttccactcacttggcatttacttggtgtcttagttacttttctattgctgtgataaaacaccacaaccaagacaatttataaatgtttaattggtttgtggtttcagagggttagagtccatgatggtggagccaggaacagctgagagctcacatcttgatccacaagcaggagacagcacagcacactgtgagaagcaggggtttttgaaacctcaagcctagcctggtcccacatccttccacaaggccacacctcctagtccttcccaaacagttgtatcaactggggagcaagcattcaaatagctgagcctctgaggaccttctcactcaagcctccactcaggtttggttctcatgcttctgtggcaagagctctaaccactgatccaaccctagttatgggaaatccttcacaaccataaatctgatcacgctgtccctgcctaggccatgccattcttattagttatctaagcaataacggaacataatacactcagcctgtgcctagtcacagatttggagagagagcacaactcctgatgtgaaagtcaacattagtgttctcttcctcttactagaacaataaaatcttgagacagacatggtggcatataacttcagcatctaagaagctaaggcaggaggatgaagaaattgagtccggcctaggccacaccccctctcattaacatgtttttcaaggccctgcctacctttgagcatgtttcttattctctcattcttcaaatcagtcacaccaaattaaaaaaatttttttccctttaagttgccacagtgcagaaaaatgggagatgctggatggagatgtaagaaaatgtagatggcggggggggggggaagaagagagagagagacagggagagaagagagacagggagaaacagacagagacagagagagagacagagagagagagagagagagagtgtgtcaggcagtggattgggaatgatttctgagtgttggaattaggtctgataataggtgattgtgatcaagagtggagtggggtgtgtgatgttgaagaaggatttcatttcttaaagataagccagaaaagaacagagataggcattttaaagtagaaccaagtctgtctgcttacagagttgtagagagagatgtggccatgggctggaggtgtgtggcaaagctctgaatgttccgtggagatgtgttagggtttaaatggaatgaatgagtaaatgaatgaatgaatgaatgaatgaatgaactgatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcttgaaccctcccccccccaaaaaaaattatgatggcatattcctgtaatcctagcactctggagctgaggaaggattgtgagttaaggccagtgtgggctacacagaaagaccccttcccacatctctaaaaataaaaacaaattaggcggagagaagagatttcagcaaggcttctcagccagaggagtgctggcattgacctcactaagccttgacaggctgcccaaacttgctcagtctacgccaactggggcactagaactctctcaggaaagcagagctgctgcagttttgctccaggaaccccaagacagggtgactgcctcatgttccatggagtatgaggtctcctgagtgctgactcctgggattaaatgtgtgcaccatcgcacccagctccttaagtgcagttttcctctgtggtcttaaggcctctgggagctttagttcagaaacctgttcctgaaccatgtgggcctagcaggagctagaatttagactaggttttgcaaagagcaagggaagggaggggcttgcaggggtctaaagtgtatcccaactctgttcaccaggcaggactctgactctcaaagccgacattgtgtcaggataaaaacatattaccagaagtgggaaagaacaatttccaagtgtgcagagcttcacccctgcatttgtgagtcggaggctttcaggtttcctgatgggatcaatctgaactgaaacgggtaagcaagaggagattaggcatgggtgtgtggacagaggacaagagggaaaatttgtcccctcatctgtcacatccatcaccttcagcgtctcagtctgcttacatagggcagggcagggcatggggacagatgtggcctggaacagaagaggagctggggaacataggatgaggagagctaatgacagtcaactgaagctcactgatgctttattttccagacacttgaacaagaccttgtgacctacatccttaacctacggcctgccaatttttaagactgctattcctccagcactccctcactctcgggcatgcccagctaagggatgacctgctgcttgcttgaaagctgctccagaaactggacttctcttgggaagagtaaagaagcctccagaaaagacttgaccttccttaagaacttcccaaactagagatgggtcaggggagggcgctccgctgagtggatggatggcccggagccagccaggcagttttattgaaatatttttaaatactttgcacgtgttagtcctgtgtgtcagcaatgctgtgtctagttcggtgatcccaatgggacagtgaacccaggggtcggctaggaggtgctctgtccattgagaccatgctgaggctcccctatacggggagaagagctagtcagcccatctggggctggcattgtccagcaagtgcactgtccttacagggtatcccgaaggccaaggttggaagcctgagctcacaggcctcactgctaagagcgtgccccaggcagctgcaggctgggtgtgggtggcttggcatgatgccctcggtggcagagaagactgcccgcctcacagttcaagttgcggtagcgggcaacagctggggtagggcgggggcacatggatagaaagccaaagctgaacgggccaaggcagcagccagggcagggcagcccctcctccggctcccggggagctgatgggggcggtgagggctctgtccgctccagggctgctgcccggggaaggctatgctgtgcccggttccagggctccctagcccacccttgtggggaattcaccaccacagcagggggattattgttgaggggaggtcctgatctaggagaccagggctgcgaggctgaggaacaagtactgatgaagttgtcagtggccacagccagaggcagctggggagccaggcctgggggctctggctcagggctgctgccctcgcagtccatcctctcctcagtcgggcccatgggggaagggccaggacctggcagtgcagtctccatccgtcggggaagctcaggggatgaaggtagtgagcgacagcggcggacaggggtctcaggctggaccaggatgtctggagtggtcactaagggcagctgggtagaggtaagtggtgatggtggaaccaggggcagtggagtggccggcttgcagggtgtgtccagcagcttgatcttgccacccctgaggtcttcccgcagtgagaaggggttgactcgtgttagattgtccccccagctggggggtgattctggcgaaggtggcaggaagaggtctgaccggcttcgggagagccgggggtctggcctgggaagtgtggcagagggacctcctcttggaacagaccctgtagaaagagaggtctcatcactgttcccagcatctgctccaagctgaggccctgaatctccaggcaggtggtgggacaagagcttaagaaaggaagtcctacaggggctctggaagggacagttgttatttccagctaccttgtttactaaaaaaaaaaaaaaaagtattcatgtgtctgtatgaacacgtgtgtgaactatgaaccacaggacactaaagttatcatggaggtcggaggtcagaggacatctttcaggagtcagttttctgcttccatgatgtagagcctagaagtccttatacaaatgcctgaacccgtcgatccatctcaccagcccctcctttccgcttttctacctactttttctttcctccttctgctgccttgggctctagcaatgaaaaccatcttctgtgagatgcctctccatcccacctgacttcccacctttttacctcagagatccaattagcctcctccagagaactgactctcaggagaggcaggacttctgctgaggtcaaggtcatgctcactcaccctgattgtatgtcaagggagccttggtgaggggtggcttggcgaggggcgtggcctcaggctgctgctccaggatctgttccaggtgctgggtgatttcagtaaaaggggcccgggtgctgggttccatctgatggataaagacagggcagcttcgctcagggttcatgaagacagtgagtttccaccattctctccccggttttagaagacaactcacggatgtggtcagggaaggagtgacacttacgctgcagcagtggatggccagaagcaggaaaggtagcggacagtcatttcccaccaaagttcggaaagctggcacatccaggccaaagtcctgtggggacagaggaggggctgccagttagccttcagtgggctctccatgtgccccactgtgaggctcaagctccacaaagcccttcttggttgaggcacccagagcagaggttacctcacctcagtgcggggtaggtagtcagggtctgcaggcactcgggcgatgagctcacagaggacgatcccgaaggcgaagacatcggcctggaggtaggtggaccatgccaagggggaggagtcagtgtttatcttatgttggaagggtggcagtgaggggtaagggagaaggctgggggttcccaaatctatataggagggttgttgaatggggctctatctcaaggtctcttaccttctcatcatacagctctccccgcaacacctctggagccatccagtacggggagcccaccacagccaagggctccttccttgtcccttccctgcagaggcagggtggtcacatctccagttcagacatctcccccaaactaaaggggatggggcaagcctcctctccatccacagagaatacccctggggggttcactcatgtatagggcacccctgggaggcttggggtaagaagggtgttcaccttacctatacacaggaatcttctcagccagtccgaagtcacccacaacagctgtgaagcctcggtcttcccttcggaccagacagttctgacacacacacacaagcatcctcacatactcgtcccctgctctggtcttccagtatataccccaaagccctgtgtcactatagcactaagcactaccccaaccttccctcccagttctccaatgcacctcattatcaccacctcactcagtactcaattccccagccctcttgctgtccccattctttaatagtttccaacaccttggcaccccgacatcctaacatatctactacccacatgtcaatatccacaggccaattacaacttaacagtcacaaaccctctttaatcgttccacctgtcttggccagcctaccttggatgtgaggtctcggtgaaacacacctttggcgtgtaggtaccgtaggccttgtgcaatgtccagggctaggtggagcctgactggccaggagaggggttctggggagctgagcagctgttccagggtgcccccattcatatactgggacatggggaaagacaaggtgtgtgaatgtcggtgctctgtgcctgccactcctaagacagttgacactcaggaggctcacaaaggtcaaaagggttggtgggtctgtgctctaaggttcccatttatatactaggctaccctgtctctcacagtaggactatgtacagctatgttatccaatacatttaaatataatcagacattcttttgttacaccagctcttgttttagtctattccacgtgtagctagtggctcctgtattggacccagatacaaaatatctccatcactaactcnnnnnnnnnnnnnnnnnnnntctgataataggtgattgtgatcaagagtggagtggggtgtgtgatgttgaagaaggatttcatttcttaaagataagccagaaaagaacagagataggcattttaaagtagaaccaagtctgtctgcttacagagttgtagagagagatgtggccatgggctggaggtgtgtggcaaagctctgaatgttccgtggagatgtgttagggtttaaatggaatgaatgagtaaatgaatgaatgaatgaatgaatgaatgaactgatcaatatgggagctaggcaaggttgcctagtgttagggcagattttaatctttcagaaatcaaggacagtaaaactaattccactagaaaaatcttcccatattatgaagacataaaatgtttccagaagaggtaaagatcaagggctaaagctgatggagacatgatggagagtagaccttagggactatcattaacaaccagctggccagttggtcactttattatcccaagggttgtggctgtcattctttctgctttgtagacacctgctgtccatgcggatggattccatatcaggaaaggtgcttttacatctcacataccctcggaagtctggaggagagccaaaaatactgcacatctctgtcctccaaactggcagcattcgatgaaccttctaagtattactatgaagtgagcatggccttatctgtattttgagatggaggtatttaaaggggtgtgtgtcatcgagtcgggactggcggtgcacatctgcacacatgccatggtttgcactgcttccccagaacagatacggaagtcacactattagccagtaagtgtggcagtagctttggcatcttctcagtcctgtgttatccctggctcccattgcttagcatcggtgagagctgaagtgtctgagccatctccacttcagtctgtgtcttggcttgctggcttaagtcttgactgcttaagtcttcattggctcctctcgggcagagtgccaaccccctgacactctggaagttcacttcaaatttttaccctgcttggaggtgagatggagagtgagcctgtatctgcagcactggaaggatttgggagcaattaattcatgtagtaaatgggcatagcctcgagctaagtgaaattcacaggcccctagggtgcccccattttactccatattctcattgttcttcagtacctctctgacgccccccaggtttctctgcccagcggcttagaggagttgctagatcgttcgaagtcatattggatacagatgagcaagaagtggaggtattgtcaactcagtctctcataaatgcatattacttccataagccctgctcccaaaactcctccaccaatcagtattgtggtttcttgtttcttctacttgattaacaactgtttaagatattaaaagcaaaatgtgttgggagaggggtgcccatgtggcagaggacagcttgtgggaatcagttctctaccgtgtgggtctcagggactgcacccaggctgtagtcctacctgctagccgttgccatctcactgacctgcattcttatcccatattacatccacagtgcctagaggtctttagtgcttacttaaaaaaattacagtggaggcacatgcctttaatcccagcacttgggaggcagaggcaggcagctttctgagttcgaggccagcctggtctacagagtgagttccaggacagccagggctatacagagaaaccctgtcttgaaccccccccccccaaaaaaaaattatgatggcatatcctgtaatcctagcactctggagccgaggaaggattgtgagttaagaccagtgtgggctacactgaaagaccccttcccacatctctaaaaataaaaacaaattaggcggagagaagagatttcagcaaggcttctcagccagaggagtgctggcattgacctcactaagtaagccttgacaggctgcccaaacttgctcagtctacgccaactggggcactagaactctctcaggaaagcagagctgctgcagttttgctccaggaaccccaagacagggtgactgcctcannnnnnnnnnnnnnnnnnnnagccctcacagtcccctcctttttaggtctccatattaattaatgcctttgcccttgtgcatcttttcttgatcacagtggctctcaaccttcctaatgctgcgaccctttaatacagttcctcatgttggggtgacccccaaccataaattatttctttgctacttcataactaattttgctactgttatgaattgtaatgatgtaaatgtgtgtgttttcagacagtcttaggagacccatgccaaagggttgtatgacctcaaagggctgtgacccacaggttgagaacctacgctctacaaagagggttttgttatttatgttttgttttcagttctgggaatccaacctagggccaggcaagtgcttaacagaatcacacctgcagccctgcccccccccccgccgaatttttttaaaaagatattaagtctgattattttacctgtgtctacaaaacctgcactccaaatgaagctaaaatatttcctatattcttctttcctaagtatttcctaatatttatgagtttgatttcgaatttctcgcctaagatcttcagtataatgtgtgagatggtggtagtggatagtaaacagtcttaccttgctcccggctttttcttaagaagagggctcactctatagcccaggctggtgcaaaagtcatggctgccacctgtgtcagactcctgggagatgggatgataggtttttgatcctatgtattgatgtatttttgagacaagttttctccatgtagccctggctgtcctcaactcactctgtagatcaggctgggctcaaactcacagggatcctcctgcctcggcctctggagtgctggatgtaaaggtgttgggacaccacactgggcctgatcattatttttaaaattaaattcatgtttgtatttatttgtgtgtgtgtgtgtgtgtgaatacatgcatgccatggcgtgcacttgttggagtttagtaggcactcttgtatcctgtgggccccaggcatcacactcaggcccatgactactgagccatctcactgactctcgatctttaaagggatgggtttaacatctaagtgtagtgtttactgtatgagtatttggaggagtaatttatatcaactacctattatcagaagagtgccatgtaacccgctatatcaaatgtcagtcatgtagccaggcacagtggtgcgtaactgtgactgtaattacttgggaggtagaggcaagcagacctggagttcaaggccagccttagccacatagtgagttggaggccagcttgacctatatagagactctgtttcaaaaacaacaaaatacctcgcccaaacagtgccatagacaacagcgattctcacaaccctgtggattggctgaggttggctggttagagctgtgccctctttccacctctctccaggttccctcctagaccagcagggtcgtctgggcatgctcagtgactgagggaaggacaaggagcatgtctgtggagtctgcttgtttgccagcttgattgtgtggaaagacacctagacccaacgctttaacccactgatagagtcagacttgaattcgcctctgggagttggcaggactgcaaggcgggttctgattggcagcaaacgctgacttcttattccggtcctttcctgttagcggctgtgctcctgagtccttaggctgtgggctattccttcctatgctcgctgccatgatcagctgagatcagagaaaccacaaacaaaagagatccttcctccaagatgtctctgccaggcacttggggaagaaaaggctgtgtgtagctgcttttggtgtctccagctcacaacatgtctgcccagtctccagtgatccaagctaagctcaagacagactgtttacataggtggtggtcaggagagcgtattctaaacaaggacatatgaagtgattttctaatgttacaccaagatgtcactcacagctaagcctagtattatgtgttaggtctcaaacctgggacaagtggctgaggagctggcagcctggtttccctgcatccctgtcacagggccttcctgactggcatgtctggtcctcccctgaactctccagcccaggaggttgggcggctccgctctatgcaatcccatcatttggttagctgctctctttgggccttctgctgctgcacnnnnnnnnnnnnnnnnnnnntgtttattatgaaaatgtatatccttcatctagtattaacaggtgctaacatgttgtgtttcagttgtgtctataatatgataaggaaggaatgttagataatgcaggttaaaatctcactgtagggagaacgctcggaggttggagagctggaaagcatacttatgggagttctgctctctgtgatctatgtaaatgcaaggtgggcgtggcagccaaacaggaacatttagagcaagctgtctaccaagctgactagctatgttggacagctctgggcttgattgagagaccctgcctcagtggataaagtgaaagactgatccagaatgatgatccacatcagcctcaggtctctacatgcagttgcaaacccacccaccccccccacacacaggggccaacatacacgtaagacatgcatatacacatgaataccacacatatgaaaaagtgaaattatcatatcactagaagataaattgcccgaatcatgaaacttgttttcaagactgttagcattgtctcctgtgatggttgatgttggcagtccatttgtagggtctggaatcatctaggaggcaaggctccaggcacacctgtgaggtgagccttgactagctctgctgaagaggaagagcccttgaatggagggtgacatccttccctgggcttgggtcttggactataggatatctggtcacactgtgaacactgagattatgttgtgtcctggaaaaacctgtttctagttgtagtgtggctcagcccttcgtcccgctgccctgacttcctcaccatgacggactgtaccctcactgagacagaataaggccactttgtcattaagttgcctatgccagggtacacggccacagcagtgagcagggtaactgaggcattccatgtaattatgccacatgccctgtcaggtcatgtcttgactttccccattggctcttggcagttttcataagtcattgccatctgtctctgtgtgttctttgctgtttttacttcacctctctgttcttccaataggagttcccgcccccccccacttctctatacactctacaggccaagatattgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacaccagaagagggcgtcagatctcatcagatggttgtgagccaccatgtggttgctgggatttaaactcaggtcttctgaaagagcacttggtgctcttaaccactgaaccatctctccagccccacagccaaactgttgaaggaccaatataaaacttattaaagagtctaacaacacagacacatctcgtactgaatatgtatatggatgttcatgcctgtgttggctagttttatgtcagtgtgagctagaattatctgagaggagagagcctcaattaatcaaatgcctccctaggatggggctgtgggccagcctgtgggtcagtttcttacttagtaattgacaggagggcccagcccactgtgggtggttccattcctgggctggtggacctggattctataagaaagcagactgagcatgtcaaggggagcagccagtaagccccacccctattttgtcccatgtcacctagggtggtatctgagctaccattctagctttctttgtaaagcagctctattttacctatgctatacattttttttaaagatttatttatttatttattatatgtaagtacactgtagctgtcttcagacactccagaagagggagtcagatctcgtgattggatggttgtgagccaccatgtggttgccgggatccgaactcctgaccttcggaagagcagtcgggtgctcttacccactgagccatctcaccagccctatgctatacattttaaatagaccacctaggctgtccttgaacttgctatgtagttgaggatgttagagatgatctttaacccccgttctctcctccctgtctcttaactcctggaattatgccctggtgtctatacttttttttttaatttaaatatttcttttcttttaatgattttttttatgtgtattggtgttttacctgcacgtatgtttgtgtgatggttttggatcccctggaactggagttacacacagttgtgagctgccatgtgggtgttgggaattgaaccccagtcctttgggagagcagccacctctctatcccctattttttttttaactaataaatattgtgttgtatgtgatttggggattttaatctttttatttcttgttgcaattttggtagaatttttcaaatgtcttatattttctatttatttatttattttggggtggcattaatggtttcattttatttatttatttatttattcatttatttatttatttatttatttattttggggtggcattaatggtttcattctgtagtccaggctggctctgaactcttgggaatcctttctcactcttcagagtgttgggattacagctgtgagccaccatgtcccggacctgggagccacctgaaactagagaggatcaaggcaggacagaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctgctgctgctttcctcactggacctttgttttgtagaacactgataaagcgaatggcagctcccttgttacttgtgttactgtggcgacccctagggagggaggcacagaggcaatgaaagttcctttttggaaagccattttattattttcccccggttagaataacaaggctatcccaccaactagaacacactttcttacataaataacacaaatctttttgtttgattgtttttttttttgtttttgttttttgtttttttgagacagggtttctctgtgtagccctggctgtcctggaactcactctgtagaccaggctggcctcaaactcagaaattcacctgcctctgcctcccaagtgctgggactaaaggcgtgcaccaccacgcctggctaataacacaaatcttaacaaagtctagtgttttgtttttttatgtagcacaggctaacctcataaggatggctttgacccctccccatctccctatcctcttgcctctgcctcccaaggtctgtgattatggggtgggggtggtacagcacacagcatatgcaacaccagggcctaaagcatgacaggcaagtacctgccaactgaacggtgtctccagctcctaacccatttcctctttttaaaaaaacgctgcaatgcaagggcctgtgtggaccaggtaagtggtccaccactgagccgctttgcctaagcatgtggttctaactgctgccatctcttctgcagaaaaatcttctatataggcaggcttggtggtctatgcctctaaccacaactcaggaggcaggggctggagatcagcaggtcttacaactacacagtgagcctgggctacacagactgtcctcagccaacacccctccctacccagggaggaaaaagaccctttcctaatcctcagctttgaattagaaagctttccaatgttctatctcatacttttcctacccccacatccgggactgcccttgcctcttccccattcccatcaaatattacaggtcgccgttaagttagcaacttagcccgaagcagacactgggtacctgtgtgtcccgtgctgcctgctttactctgaggcaggaacctccttttcctgtgttacagttgagagaactgagctgcagtgattgtgggcaagctcagtatcaagtgaaggtcaaagctgagccagctgttggttttaagacagggtcaggctatgtaggccaggcaggcagtcctcctgcctcagcctcccaagtgccaatgttaggagtgtgctaccacatttagcttttgagcctgtctagccttcaaagactttaagtaataacgctttgactcaaagtaaaaatggccttaacaataacggaatagaaaagtgggtcacttcagctgctcagtctctcatccatctagtccaccctgatgtttgtccctgggaagtgttctcaagggttcaaggtgtctgctcaagtgttccatcatcacatagagggccatttcgagccagaaagcaacctcctctcctcttgtgtgtctccttctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 908 - DNA, 1291 bp, Mus musculus
tatggctgacgctatcacgtatgcagacctgcgctttgtgaaagtgcccctgaagaacagcgcatctaaccatctagactgtgaggcctatgaagatggggaactcacctacgagaatgtgcaagtgtctccagtcccaggagggccaccaggcttggcttcccctgcactagcggacaaagcagatctgcaggtgtctcggcagttccaggaggggaccaggatttgggaagccaccaatagcagcctgcagcagcagctcagggagaagataagtcagctggggcagaaggaggtggagcttcagaaggctcggaaagagctgatctcgagccaggacacattacaggagaagcagaggactcacgaggacgctgagcagcaactacaagcctgccaggctgagagagcgaagaccaaggagaacctgaaaactgaggaggagcggaggagggacctggaccagaggttgacaagcacgcgggagacactgaggcgcttcttctcctgattcatcagacacctgctgtccatgcggatggattccatatcaggaaaggtgcttttacatctcacataccctcggaagtctggaggagagccaaaaatactgcacatctctgtcctccaaactggcagcattcgatgaaccttctaagtattactatgaagtgagcatggccttatctgtattttgagatggaggtatttaaaggggtgtgtgtcatcgagtcgggactggcggtgcacatctgcacacatgccatggtttgcactgcttccccagaacagatacggaagtcacactattagccagtaagtgtggcagtagctttggcatcttctcagtcctgtgttatccctggctcccattgcttagcatcggtgagagctgaagtgtctgagccatctccacttcagtctgtgtcttggcttgctggcttaagtcttgactgcttaagtcttcattggctcctctcgggcagagtgccaaccccctgacactctggaagttcacttcaaatttttaccctgcttggaggtgagatggagagtgagcctgtatctgcagcactggaaggatttgggagcaattaattcatgtagtaaatgggcatagcctcgagctaagtgaaattcacaggcccctagggtgcccccattttactccatattctcattgttcttcagtacctctctgacgccccccaggtttctctgcccagcggcttagaggagttgctagatcgttcgaagtcatattggatacagatgagcaagaagtggaggt

SEQ ID NO: 909 - protein, 169 aa, Mus musculus
MADAITYADLRFVKVPLKNSASNHLDCEAYEDGELTYENVQVSPVPGGPPGLASPALADKADLQVSRQFQEGTRIWEATNSSLQQQLREKISQLGQKEVELQKARKELISSQDTLQEKQRTHEDAEQQLQACQAERAKTKENLKTEEERRRDLDQRLTSTRETLRRFFS

SEQ ID NO: 910 - DNA, 21646 bp, Homo sapiens
  misc_feature (1)...(21646): n = A,T,C or G
gctgttgctctggggataagggaaaaaagggggcagaagtggttatgtatcttctgctgtcccctaaactcccccgacccagcacagacttctgctaaacccacctgactgcagtggctgctgcttgcttgcctcctcgtggagaaccgcagtttcatctttcccctgttgtggaagaaggaaagggcagtactgaagcaacaaggttctgctccatcacctcagtctccagagccagccaagagagagtgcaatttgagatggagacagtgattgggtttttacctcagagaatcacaatcctagtctatctagctcctcacccagcatatgaagcgacgtcctatgtcccacacatggtcagtttgctgaaacacctccaggaatgagcaactccctccggtttgaaaaaagctctggtggctgagtgctgtggctcacacctgtaatcccagcacttcgggaagccaaggtgggtggatcacctgaggtcaggagtttgagaccagcctggccaacacggtgaaaccctgtctctattaaaaatacaaaaattagccgggcgtggtggcaggtgcctgtaatcccagttacttgagaggctgaggcaggagaatcgcttgaacctgggagccagaggttgcagtgagccgagattgcgccgctgcactccagcctgggtgacagagcgagactccatctcgaaaaaaacaaaaactttggttgttagacagttcatgcacaaagccaaaatttgtcctttatgtatcttctttccatagtgcttactggagccttccaaaataatgtctcctcaaggtgacagcccctcaggaatttgaaggcaatggtcacaccctcacccactttcctgagttttttctggtttattaacgtcagtctttacagtcagtgctcattgacggtggttttctctggttgtttcctgaacacgtagtgctcttaaagcaatgccctgaggagaatacaattctccaggggcattctgattggcaggtgaagcacagtgccatgttcccagcactgatttgggaagtggcttgtcacatcccacagtgaactcagtcaactggaatgcctaactctctttcataagacctcctgctacattatgtttctcccagactgtactcaggtccaagaacagaatttactagtctatccttctcaaagttcatcattaaattcagtcattcatcctagcctgtcacatctacctggggtcattattagctatctcttctagtttcatatatctaaactggttccatcggttctattttataatgcaagtacgtaatagggtcacggctaaagacacagccctggaaggtactgtttttcaaaatgtactgtcaacttacatttcagggcctcctcccaaggagaacatgagaccacttcatatctggaactctagaaacactggctgcagcaatcaacctcctgtgccaaggctggccccactcttgtagcatggacactgctagctgggttcaaatcccagctccagcagttgccagcgctgggtgacctcgagcaagtgactactcctcactggattgtaggagaactaaatgtgatagtcattatttacagttcaccacacgctcttcacatccgttacctccctggatcctcaaaataacctcataatattggaaggccaacggactactgtctttattttacagacagggaagctgtgtcttgttcttggtaccctggcacccccatgggagattcgggctcaggggatccccacgcccggcggtcccgcacctgcaggggcacccctacccccggccgccccgtacctgcaaacacttgtacagcacaaaagccgcgacggccgcggtgtacagcgcccccagaggcagcgacccggcccgggtccgctcgcgttgatccttgagcggtggtcgccgccggggttccgtggctccagagccggggtgggctgcgttccctgcggagggaggatacaggcgagtcagccgagctggggcctgggacccgtgcgcagtcccagccctcctccagcagccctagctggtacctgggtgtgcccggaggtcgggattggcgcggtctcctaggaccccggacagcgcagacacaagcagcagccccaccacacccaagagcgaaactgcgcccgccattgccggcccacgggtggagggatcgggcgggcggtgccgaagcggtccggcattggccggccgccccaacgcgcacgcgcacgcgagcaggccggccggctccggggaggccacgcccactccccgtagggcggggccagaccatatttgcataagatagtgtcattctagctttcctgtatttgttcatttcgtgtctattagctattctgctagccacaatgcctctgaaagcctatagtcttagaaagttatgcccgaaaacggtttttttaatctcacgccaccaactttctcaccctaatcataaaacacaatttctttagggctataaaatactactctgtgaagctgaggacgtggttcgtgctgaaggcctgtatcctaggctacacactgaggactctgttcctcccctttccgcctaggggaaagtccccggacctcgggcagagagtgccacgtgcatacgcacgtagacattccccgcttcccactccaaagtccgccaagaagcgtatcccgctgagcggcgtggcgcgggggcgtcatccgtcagctccctctagttacgcaggcagtgcgtgtccgcgcaccaaccacacggggctcattctcagcgcggctgttttttgttcccgagaccacggctcactgcagcctcgacctccccgggctcacgcgatgcctcacctcaggctcccaagtagttgggaccgcaggcgcacgccatcatgcctggctaatttttgtattttttgtagagacggattttcacctgttgcccaggctggtctcgaacgcctggtgtcaagcgatcagtccacctcgccctcccaaagtgctgggattacaggcgtgacaccgcgcccggtcaacgcggctgcttttcatgcgcgggcagctttacgctgttcttggccttgctatgaagtccttgtgctcattactccaaatatggagcattcctgaaacagcctcctcttctacctccctctccctttggcaaacgccatagtagccaccattcactgtgtagctggtacacaacatatggactctgcttgggctagaatcctgcctcctgtactcaagagcggtgaccttgtgaaacttagttctctctccgtgccttcctttccactctgaggaatgaagataagcacttacttcaagagctatgatgattaaatgggatcactcaagttagaaccgtgcctacttattagtgatttttttttttttggaacggcgggtcgctctcttgcccaggctggtcttaaactcctgggatcctcccgcttcagcctcccgggtagttgacattacaggcacgtgccaccccgacggactctagtgattttttaacttgagcagctactactgtaagccagacagttgaaattacactgactctccctgacatgccgctgcattccctttctgcatactgggttctacacgaccttcagttctcagctcaagtgtgttcccatcattcggaacccttaattcaacttctaatttattctttagtgccgctatttcactttcttcaataccactagacaagcagtccccaacctttttggcatcagggaccggtttcgtggaagacaatttttccatggacgaagcggggtggagggatggtttccggatgaaactgttccacttcagatcgtcaagcattagattctcatgaggagcgtgcaacctagatccctcccatgcacagttcacaatatggttcgcgctcctatgagaatctaatgccgtgctcatctgacaggaggcggagctcaggcggtaatgattgctggccccactgcccacatcctgctatgtggcccggagcctaacaggccacaggctggtgctggcctgtggccgggtgttggagacccttgagctaggctggtcctaaattccacaagggcaggagccacctctcttttttctttaccattttactcccagagcctagcacagcacgtggcgcctggcgatagcaggcactcaatgaatcgttgttgaatgaaattaatgaatggttaaaatgacccaaaagggtaatatagttaagctctttcaaagaatgaggcaactgcaattcagcaaggttaagtatgctactaatcaggtaagaggcagggtggtgatttcaccagttttttgcctgtctctataccttctgtcgaacagcctttccccatccttgtcttccatgacttcaccaggcaggcaggtattccttctgttccacagagccttccatggtctcttaattgggatacactgggtcatctgtctagttagatcaagagctccctgacatgaaaccatttccattcatcacatttttatctccagagcctggcatacaaacaggcaatcagtacatcatgtgtgttaaataaatgaatgaagccaagatcggtggcttatgcctctaatcccagcactttgggaggccgaggcaggaggatcacctgaggtcaagagtttgagaccagcctggccaacatggctaaatctcgtctctattaaaaatagaaaaattagccgggtgtggtggcgggcgcctgcagtcccagctatttgggaggctgagacaggagaatcacgggaacctgggaggtggaggttgcagtaagccgaaatcgtgccactgcactccagcctgggcaaacgagtgagacaccgcctcagaaaaacaaaacaaaaacaaaaattaaccaggtgtggtggccagcacctgtaatcccagctattcaggaggccgaggcataagaatagcttcaacctgggaggcggaggttgcagtgaacagagatcgcgccactgcactccagcctcagtgtcagagcaagactccatctctaaataaataaataaataaataaataaataaataaatgaaatatgggtgtgtcttcttgtttttcctgaaaggaggaggaagggcaggacagggagaaaccctcaccaaggggagttatcatagtgtagttcaagggtccccaacactattggtccatggcctgttaggaactgggccgcacagcaggaggtgagcagcggaggagcaagggtgagcggcggagtagcgagggaagcttcatctgtatatacagccactctccatcctggcattaccgcctgagctctgtctcctgtcagatcagtgcagtgttagattctcatagggccacgaaccctattgtgaattgtgcatgcacgtgatgttgtgggctccttatgaaaatctaggccaggtgcagtggctgatgcctgtaatcccagcactttgggaagccaaggtgggtggatctcttgaggccaggagttcaagaccagcctggacaatatggttaaaaaaaaaaaaaagtctctaataaaaatacaaaaattagctgcgcatggtggcgcatgcctgtaatcctagctacttgggaggctgaggcataagaattgcttgaacccaggaggcgaggttgcagtgagccaagattgcaccactgcactccagcctgggtgacagagcgagaccctgtcaaaaaaacaaaacagaacaaaaaaaccacaatacctgatgatctgaggtggaacagttttatcccaaaaccatcccctcctcccatactcctgtgcatggaaaaattgtctcccacaaaacctgtccctggtgccaaaacggctggggaccagtggtctagctgatgacccagtgacagcctgggtacgcaaagcagggtaatagaaatcttgaatctaagccagttggcacagtcggtgtaaataaggggttcaggccagatataataatgataagtggtccccaactgattattgcctttagagaactcagggcactattgccagatctttttttgaaggaatcaacaaattagaattttaaaaatttgaaatctcccaatttttaactgttgacgccgtatcatgggtgtgcaaagggtgttttacatattttgaggctatgttgttaagaacacattggctctcaattattacatcttctgaagaattattccttgtatcactaaataataactttctttagccttaataatgccttttctgaagtctgttttgctgggcattaatactgtaatgctggccaggtgcagtggctcatgcctgtaatcacagcacttctggatgctgatgcacgcataactcctgatgtctcgactttgaactctcgcttggcccttggcacaaccacgtctctctttagagttcatcactccctgcactatcttacatgagctgcactctcctcatctattgacgcttacgccagagctttctctcttatcttcctgtgtagacttttgtgtctcttcccttctccctatctttacatcttgcctctgctcctaactgacctattttctcccttcttctccttctctcactctcctccctctactcctnnnnnnnnnnnnnnnnnnnnaccatggctaactgcagccccaaatttcttggatcagcctcctgagtacctgggactgcaggtgcacaccaccatgcccagctaatttgtgtgtttttttgttgttgttttttgtttgtttgtttgtttgttttttgtagagaccagggtattgcccaggctggtcttgaacttctggcctcaaagggatctgcctgcctcagcctcccaaagtactgggattacaagtgtgagccaccttgcctgttccggatcatttaaaaaacatttttctttcttttctgtcttttttttttttttttttgagacaagctctcactctgttgcccaggctggagtggtgcagtggcacaatcatggcttactgctgcctctatctcccaggctcaagcaatcttcccacttcagcctcttaagtagctgtgactacaggcacacatgcccccatgcctcgctaattttttaattttttgcagagatgggaatctcactatgttggttaggctggtctcaaactcttgggcccaagctatcctcccacctcagcctctcaaagtgctgtgattacaggtgtgagccatcacacctggcccaaatttttctttctttctttttttttttttttttgagatggagtcttgctctgtcgcccaggctgcagtgcagtggagtgatcttggctcactgcagcctccacctcctgggtttaagcaattcttgtgcctcagcctccagagtagctgggattacaggtacctgccaccatgcccggctaatttttgtatttttagtagagacgaggtttcaccatgttgaccaggctgctctcaaactcctgacctcaggtgatccacccacctcagcatcccaaagtgctgggattacaggcgtgagccaccatgcccagacccaaatttttcttgttttctttctttttttgggggtggggggcagggtctcactctgttgcccaggctggagtgcagaggcttgatcttggctcactgaaacctctacctcctaggctcaagcaatcctcccacctcagcctctcgagtagctgggaccacaggcgtgcaccatcacacctggctaattttttgtatttttggtaaagacggggttttgccatgttgcccaagctgttcttgaactcctgggctcaagcgatcctcttgcctcaccctcccaacgtgctggaattgcaggcatgagccaccacgcctggaacaaagttttatttttcaagtggatcatttaaaaaaatgctttatggccaggcacgccacttctctccagcctgggcaagtgagccgagattgtgccactgcggtctggtctgagcgacagagggagactccatctcaaataaataaataaataaaattaaaacaaatttaaacattctttatatgacaaaattattctcaatggcaattataaaatgaataataagggccaagaaataaactcagtgaatattttctttccttgaactttgtaaatataatcatgtcagcataaaaacagccatgcattgcttaacaacagggatatgttctgagaaatgagtcactaggcaattttgtcattgtgcaaacatcatagagtgtattttcacaaacctagatggtgtagcctattacccatctaggctacatggtatagcctggtgctcctaggccccaatgcttacagcatgttaccatactgaatactgtaggcagttgtaagacaatggtatttgtgcatctactgtagagacagggtctctccgtctgtcgcccaggctggagtgcagtggcataatcatagctccctgcagcctccaactcctgggctcaagtgatcctcccacctcagtctcccaagtagctaggactacacgcttgtgtcatcaggcctgtctactgtttttgtttgttttttggtagagatggagggtctcactatattgctcagactggttttgaactcctggcctcaagcaatcctcctgctgccttggcctccaaagtgctggtattacaggaatgagtcactgcacctggtccactacagcaatttaaaagttagatctgggctgggcgcagtggctcatgcctgtaattccagcactttgggagaccgaggtgggcaggttgcttgaggtcaggagttgagaccagcctggcaacacagggagacctatctctacaaaaaatgaactagattagctgggtgtggtggcacatgcctgtagtcctagctgcttaggtggctgagatgggaggatcacttgagcccgggagatcgtcaaggctgcagtgagctgagattgtgttactgcactccaacctgggagacaaagtaagaccctgtctcaaaaaaaatataaaacttagatccataaaatatttttcagggaggataattttatcactgattttttttttcagaatttctggaacatggtgataataagaggactgatttttattttttaaattctctacagacaatgcacccccttattgcctgcaactcaaggggcaggacttctgccatccctattgttggcatgccactgcactgattttaaacttttaaaaaatgttgtatgggctagacaaaacacatctctgacttctggtctcaggtttatatttgcaacttaaaatccctcttcctacatcaatagccttgcacgtgatggagttagctctaggtatggcaggtactacacccgctgaagtgaacatgtgcaagatagggctcagtttcccaggacagtcctacagcaaagagttttaaaatgcaattaattattgagagtgacagttcttacagacagtttggatgaagtgggttgaaaggggaggtttgggggtgtcccccaaattataatgcccccaatgaaacaataacaagcatcatctaaacacatatcctctcagatcagccttagggtgtgatgggatcagaggtaccaggaggctcccccgacccttccactttataccatactcattgaggaatacatctttcttctgggaccagagtcagggaggaaggtgggcatcctggagcagaaggggtgttcctgtccttgttagtcctgcttcacaccacttctgcccccaccccccgccctcagagtcctcagggactcaactgcccgtggcacattacccacaggcctgcttctcttctcaaggggggcaaagggcctgggcagcgagggtgggggaagctcaggagctgcaggagtggcgcaggtgcaggcacagggcggggtctttgttctttttttcatccctcccctcccccttcctccccggaaaccagagactttgccaccaccagtattggggatgctgagctgcggggtacgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactgggtgagctgggcagggcaggggctggtgggggaggggtcatgtggccccaggtcccacctgctgggccctgggggtggggcggggctgttacaccccccttcctttcacatccacaggaatcccctccataacccaggcctggggactgtgggtcctcttaggggctgtgacgctgctatttctcatctcgctggctgcacacttgtcccagtggaccaggggccggagcaggagccatccggggcagggacggtgggtgaaggacaacagggatgggttgactgagagttctctcttaccgagaagtccccactcatcccctaaactctgcgttgcagctctggagagtctgtggaagaggtcccgctgtatgggaacctgcattatctacagacaggtagggagctggcagagaggaggggcacagaggccaggtcctgggtggctgggatgggggcgtgcaggaggaaggacaagttgctgaccagattcctgttccccgtcccaggacggctgtctcaagacccagagccagaccagcaggatccaactcttggaggccctgccagggtgagtcaactgtggctggagaaaagggggagggaaggaagtggggggcttttcgggcttttccgagggtccagtgaacttctaacagccttgcatctccaggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggcgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttccaaaaagtgtttagatttttacctagaaggctgaagacttgcaaagggccctgcagatgggggtgtgagctttgctgtctgcacggagctctttctgggggtgcctagctggggatgaggggccaagaggggctgcggcatcaacagtgcagaggtgggcaccggggtggagggccagagcccagctcctcagctgctgttgctgctgctagaacacccctgggatctgcactcagagccactgcattccccctggggctgcaagctcacagtcctgagctactctccccttgacctctataactgccatcacctccacaacctgccagcctggttccttcatcaagtcccccaatctgacctccgtctgtccgctatgagtcccacctatacccctgttttgacatcagtagccttatctgcacttagtcatcgtatacccctagaggccttctccttaccccatcactatggcagcggtccatctccactcactctctcccactctggcctcccaaagtgctgggattacaggcatgagccaccgtgcctggccttcactctctcagttgtcacctgcagtcttggcaacagttttgcttgtcaccactttcattttaatccccatctaatttgtcctgcctgtccacccatcacctgctgattcttaaccccagcctcctaccccatatagcatgctacatcagccagttggcacagagattaggactctgggctcaggagccggactgcctgcattcaaattccatgtctaccacttaccagctgtgtgttcttgggcaactgtgcctcggtttctgaatctgtaagattgagaggatattaacggtgtttacttcaaaaaaaggtggttgtgaggctgaatgagttaccatttgtaaagcacttagacaataaatgctcaataatgctaggcattattaaaataagagaaatacaggatcctctatgggagctcataggtgaagtgacttctaggtagagacatgacacatagtaggaatctgccaggagaagcgaaggacagaaaatgctccaaggcaaagggaaccacaggcaaaggagaggcttattcagaggacctggcagaagtgcattaggcacagcggagggtagagtgagatgggggcaatggtaagatgaggctggaggggcagacagagccagatcacactgcgcccataagtcatgccaaggagcttgggctttatcctgcaggggaggtgaaagggagtcactgaaagttttaagcgagggatgaacacagtgagttaaaggctctaactccactggctgctgtgctgatctagtggtcagcagtctggagtcaggcggcgcctttcaaaggctattgcaagatttgagtgagaggggatggcggcagtagcggtagggatgcagaggagggatggattacaaagagatgtttagggttttttttttttttaaaggccccacctatcacatcttccagatttctggttagagcctgtaacaccccccaacccaaatcctcatcatcataatacagcatagctccaagttggtttcagctcatcaccttcctcacctggcaatctctctctctctctctctctctctctcacaaacacacacacaccctccaccccttaagcccatctgtgatccatctgtctagcaaaagctccaacctgtcaaacctcttctaggatatttcaaggtctagaccatctccccagggcctctgtagaggcgggccgcgcttgacagatctttctgaggcttgaggggctgaagaaaggagaagctgaggctttcacttccaagcttctcttcttcccacttggagtgccacaggaagccacagaggaggaacccgtgcgcctgattcctgcctggtggtcccaatttgaaagggaccacccttcccttaagcccacccccctacagaccccacaaatgcccctgggtccctggacctctgaggaccccaccctgggcctccccaggagaggcccaggtcgcggttaagggcaggtagctggggatgcggaggagggagggagggaggcttcgggggcggacaccggatgcggggaaccaccggcagcgggatgtggggttctgagggctgcggtgcttctgaagatggctcagcgtcgcgccaggtggacgtgagagctttaccctggaggaggcgggggttggagtcccgcctacccactgggacaagccaagggctcaaacgcccccaacccagcccgcagatctcctcgaagcacccggttctcctggcccgcccagacccacggcgctcgccgccttcgcccgcttaggactgagtccgcagcgccgccgcctggcgaggggcggagttgccaccacttctgcgcaggcgggatgcagcctggcccgcggcatcccgggagttgtagtctcgacgcttcggggccaccccagggtctggtccctgacgacgcgcagtgagggccccgccgctaccccagcagtcgcctcccaagttcgcggaacgcagctgaccggctccctctggactgggtgacatgactgctcccaagcagtcgtttgtaaactgagtttctgtaaaacaattttatttttcatatgtgactgtagcggggtatgatttgaactttgttttccgtcccccagcccggattctctgtcttctcctgtacagccgttccgttttcttacctcgtctccgtcaccgaggccctcagccctgaacacaaggactgggcagtttccctattgattcctgaacctggaacttaagacatcttccgaggggcccccccttgccacaccctctagctgatcgactcacaaatacctgtgatttctctccccgtctccacctccaggtacttccctagtggactcctttccctcaccggcgtagcattccagccagaaggagtgcccgtcctagcgccccgttcccagggacagaccctcagggggagctcctagggccccagctgtccctcctctttcttaaagcctagctaggaggatagggacacattgaaaacggaagagggagggtctccgggacagtcaaaggttcaacagcaggaagttctttttttttttctttttttttgaggcgaagtcttgctcctgtcgcccaggctggagtgcaatggcacgatctcggctcactgcaacctccgcctcccaggttcaagagattctcctgcctcagcctcctgagtagctgggaatacagacgcccgccaacactcccggctaattatttttgtatttttagtagagagagggtttcgccatgttgggcaggctggtgaactcctgacttcaggtgatccgcccacctagacctcccaaagtgctgggattacaggcttgagccaccgagcctggccaggttcttaagaaattacttataggtggggagggtctttggaagccatccggccagggcacctccatctttggccctgctctgtagtctctcaaagatgggtttaaacttccagcttggttttcttacaaggagggaaacagagctgggttgtggagagaaaccaagtgttttttaattcttaatttttatgggtacatagtaggtgtatgtatttatagagtacatgagatattttgatatacgcatacaatgcataatacagaccaagttttttttttttttgtttttgttttttgagacggagtcttgttctgttgcccaagctggagtgcagtggtgcaacctcggctcactgcaacctctacctcttgggttcaagcgattctcctgcctcagcctccctagtagctgggactacaggtgtgcaccaccatgccctgctaatttttgtatttttaatagagacggggtttcaccgtgttggccaggccggtctccaactcctgacctcaagtgatccacccgctgggattacaggcgtgagccacagcgcctggcccagaccgagtcttaatgacttcatttgaaaccttgaatctagacatgcccagagctatatttgccttctgaactttttggctatgtaagctaatgaattcctttttttttttttttttgagacggagtttcgctcttgttgcccaggctgaagtgcagtggcgagatctcggctcactgcaacctccgcctcctaggttcaagcgattcttctgcctcaacctcccgagtagctgggaatacaggcatgctccaccacccccggcttattttgtgtttttagtaaacggggtttctccatgttggtcagactggtctggaactcccaacctcaggtgatctgtccaccttggcctcccaaagtgctgggattacaggcgtgagccaccgcgcccggccttttttttttttttttttggcttcagtcaaagttatgttttctatctctcgcagtcacgagttctgactaattctgtgggggaaagaccaacagacaggagccagctgaagatgctgaacctctgatgtcttcacttattgcccaattcctccttgagccaccctcctctgacttaaatgtactgtcatgccatttggccctaagatatttctacttaacgtgtgagttaatcagatcccttgtctagcttataaatttctagaatcatatagccaaaaggaggctgacagatctggcccaaagttacacccactgcaggaactgccctatgatttcttcttgaacacttccagaagctgaacctctccttggtaaggacctcactacctttccaaggactctcttccaatctttctgattgatagaacttttaaaatttggaaccaaagttggcttccttgttacttgtctcactggttctgtcgatactggtctgacagccctggaggaattgggagccagtccttacaaataacctaggtctttttttttttttttttttttttttgagacagagtttcactcttgttgcccaggctggaatacagcggtgtgatcttggctcacttcaacctccaccccacccctggtttcaagcgattctcctgcctcagcctccagagtagttgggactacaggcactcgccaccatgcctggctaattttttgtatttttagtagagatggggtttcaccatgttggccaggatggtctcaaactcctgacctcatgatccacccaccttggcctcccaaagtgttgggattacaggcatgagccaccatgcctggcctttctttcttttttttttttttccttttcaggagaagcgttctaaagtgccttctacagtttgtttgtttgtttgttttgagacggagtttttctctgtcacccaggctggagtacaatggtgcgatcttggccccactgcaacctccacctccagatttaagcaattctcctgccccagcctcccaacctctggagtagctgggattattggggcgtgccaatacgcccggctaatttttgtatttttagtagagatgaggtttcactatgttggccaggctggttttgaatgcctgacctcaggtgatctgcctgcctccgcctccaaaagtgttgggattacaggcgtgagttacccagcccggccccttctatagttcttttacagactttatttgcagcttactcatcactccctttcggcttgatccttaacgtgtggcactaagaagtcaatctagtactgggaacacatagttgggggccatctctttgactcggcgcgcttagtctaccaggcctttgtttgtaaggaatcaagtctttaagtgaagcgttgtttattgtaaggacacatggggcaatcaggaggcctaaatggaatgggaatcccagagcagtggctatggtgtgagtagacctctgcagactgttattggatctcagatctctgcagtgctggggactgtcacgcgcgtctgtgatggtccagggggcttccaaggcgattgggcagtgtcggtcttcagctgctaagccgagcagatgtgggaaggagtcagccaaggaacgttgggtttgagctccaggagctttaggaatggtggcgatgtgagtcggacagtccaacctccagtgggggcccacacagacagggcacggcctaggaggaatcccgagctgtgggcattctcaggcccagtggccaggcttttggcatttgaagccaggtccacgaggaggttttgaaggagcccctgggaactgtggcttggatgttctgaagtttttgtgtgctggagacgtggttgtgggttgtcttacagcagaggcgagtagctgtaactcagagatgccttgtcacttggctgcctcttctctattattgtacaccttgaaggcaaggttaattaagtcctgttgtggggtttgagggccggaatccaattgttggagttttttcctaatatcaggagcagattgggtgataaaatgcatattaagaataaggcggcaacccaaaagcaactaagagggttccttggcataacaggcttctgccgaatatggattcccaggtacagcgaaatagccaggccattatatacactaattaaggaaactcagaaagccaatacccatttagtaagatggacacctgaagcagaagcggctttccaggccctaaagaaggccctaacccaagccccagtgttaagcttgccaatggggcaagacttttctttatatgtcacagaagaaacaggaatagctctaggagtccttacacaggtccgagggatgagcttgcaacacgtggcatacctgagtaaggaaattgatggagtggtaaagggttggccccattgtttacggatagtggcagcagtagcagtcttagtatctgaagcagttaaaataatacaggtgatcttactgtgtggccatctcatgatgtaaacagcatactcactgctaaaggagacttgtggctgtcagacaaccatttacttaaatatcaagctgtattacttgaagggccagtgctgcgactgtgcacttgtgcaactcttaacccagccacatttcttccagacaatgaagaaaagatagaacataactgtcaacaagtaattgctcaaaccagtgccgctagaggggaccttttagaggttcccgtgactgatcccgacctcaacttgtatactgatggaagttcctttgtagaaaaagggctttgaaaagcagggtatgcagtggtcagtgataatggaatacttgaaagtaatcccctcactccaggaactagtgctcagctggcagaactaatagccctcactcgggaactagaattaggagaagggaaaagggtaaatatatatacagactctaagtatgctcacctagtcctccatgcccatgcagcagtatggagagaaagggaattcctaacttccaaggaaacacctatcaaacatctggaagccattaggagattactattggctgtacagaaacctaaagaggtgacagtcttacactgccggggtcaccacaaaggaaaggaaagggaaatagaagggaaccgccaagcagatattgaagccaaaagagccacaaggcaggaccctccattagaaatgcttatagaaggacccctagtatgaggtaatcccctccaggaaaccaagccccagtactcagaagaagaaatagaatgaggaacctcaagaagacatagtttcctctcctcaagatggctagccaccgaagaaggaaaaatacttatgcctgcagctaaccaatggaaattactttaaacccttcaccaaatctttcacttaggcattgatagcacccatcagatggccaaattattatttactggaccaggtctttcaaaactatcaagcagatagtcagggcctgtaaagtgtgccaaagaagtaattccctgcactgcaggccatacatttcaattccctgtatctttaacctccttgttaagtttgtctcttccagaattgaaactgtaaaactacaaatggttcttcaaatggagccccagatgcagtccatgactaagatccaccacagacccctggaccagcctgctagcccatgctccgatgttaatgacatcgaaggcaccccccccgaggaaatctcaactgtgcaacccctactatgccccaattcagcaggaagcagttacagcggtcatcagccaacctccccaacagcacttgggttttcctgttgagagggggcactgagagacaagactagctggatttcctaggccgactaagaatccctaagcgtagctgggaaggtgactgcatccacctttaaacatggggcttgccacttagctcacacccaaccaatcagagagctcactaaaatgctaattaggcaaaaacaggaggtaaagaaatagccaatcaccttttgcctgagagcacagcaggagggacaaggatcgggatataaacccgggcattcaagccggcaatggcaaccccctttgggtcccctccctttgtatgggagctctgttttcactctattaaatcttgcaactgcactcttctggtccatgtttgttacggctcgagctgagctttcgctccccgtccaccactgctgtttgccactgtcgcagacctgccgctgactcccatcctgctgctgactcccatccctccagatccggcagggtgtctgctgtgctcctgacccagtgagactcccattgccactcccgatcgtgctaaaggcttcccattgttcttgcacggctaagtgcctgggttcgtcctaatcgagctgaacactagtcactgggttccacagttctcttccgtgacccacggcttctaatagagctataacactcatcgcatggcccaagattccattccttggaatccgtgaggccaagaaccccaagtcagagaacacaaggcttgccaccatcttggaagcggctcaccaccatcttgggagctctgtgagcaaagacccacggtaacactaacagggtcatgggaatcaccaaatttatagctagttgttcagaagtgtgggtgacctggggacccccaaagtacagctggaatctgaagagaagatttgtgaaggattaagcccttaacttatggagtctgcactaactgtagatggtcagtgccagaaatggcttttagtacaccaattttggttgaaacagaaaaatgtcacagaatgaaaaccatttttgtaaatagcaataattcagtcatttttggtggaaattctttggtgtgatctaaaccaaaatgagatcagctttgcttcaaaaagattttgccaaataagagaaactgctgaatatttaatgtttaaaatatcaatttctatgcattttttcctttttcatagtgttcaggaattaattttgatagcagtcaagattgcttaatcttcagagttacatttccattttgcaaagtaacaactggttggtttttactcttagtttccctttccccacccagcatgtaaacaacctaccatattgttgcagaaaggcaaatagggttaaaattggagacaagacttccatcatttttgccaagcagagaggaaagaattcagcaatcacataattctgctcaaactaagtgtatctgagaactattcaaatgttcacaggaggacatatcacctctctcttccccatttctcttgggatgttacactttgtcatttgtcatcaaaattggccttttcctttatctctttgtggtaaagcttgatggcatctgaatttacactgtctccttgacagttgtgctgcttctgcttctttctggcagtttctacttttcctttcattttattatcctgctttttatttcaattttgtttttatagtctctgtgtactgtcttgacctttagatggtcttaccttcaacatggcaaggatgtcacactaccacgtacaaataacaatgtgctttcttagctcatttccctagcatgactttttttgagatgtcaaaagcaag

SEQ ID NO: 911 - DNA, 1231 bp, Homo sapiens
gccaccaccagtattggggatgctgagctgcggggtacgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactgggaatcccctccataacccaggcctggggactgtgggtcctcttaggggctgtgacgctgctatttctcatctcgctggctgcacacttgtcccagtggaccaggggccggagcaggagccatccggggcagggacgctctggagagtctgtggaagaggtcccgctgtatgggaacctgcattatctacagacaggacggctgtctcaagacccagagccagaccagcaggatccaactcttggaggccctgccagggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggcgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttccaaaaagtg

SEQ ID NO: 912 - protein, 196 aa, Homo sapiens
MNQADPRLRAVCLWTLTSAAMSRGDNCTDLLALGIPSITQAWGLWVLLGAVTLLFLISLAAHLSQWTRGRSRSHPGQGRSGESVEEVPLYGNLHYLQTGRLSQDPEPDQQDPTLGGPARAAEEVMCYTSLQLRPPQGRIPGPGTPVKYSEVVLDSEPKSQASGPEPELYASVCAQTRRARASFPDQAYANSQPAAS

SEQ ID NO: 913 - DNA, 56258 bp, Mus musculus
  misc_feature (1)...(56258): n = A,T,C or G
tgagttccagagtagtttaatctacagtgtgaaacactgtgatcaaacaaacaaaacgaaaagcccaacagagtaatggatggatttcagactggggatagcgtgggaaagcaggacgcagaatacagaaggggctagagatgagaaaacagactggatttggcaagagggagtcagtctcatcttgactggcagagagagcatggtgtttgggtttaactgttccttcctggtgagaagccaccaggagccattgtaggacactgagggagtgatggcaaacagtacatacatacaaggacacccagtctctctctggcatctccttaataaagccaagcactgagctccagagtggtggtggttcatgcttaatcctagaatttgggacacggaggagggaggcaccatgagtttgggattagtctggaccatagagtgggttgtctcaaaaacaaacatttgcaaaaccaaacaggctctagaagtggaaaagaaacgagatgagtgggcttagtggagcagattcctgccctcccaaattctcttatcctgctactttgttgttgtttgggttttttcctgagacaaggtttctctgtgtagctctggctttctttgtagaccaggctgaccttgaactcagatatctccctgcctctgcctccccagtgtagggattattggttgcctagtgaattttaccattactttgggtatttgatgtctcagctttctagaatggctcccctccacctctgacatctggtacttcagtaggctttcttccttcccccttgggtctctgtcttagggtttctactgtgataaaacagcacagccagaaacaatttggggaggaaagagtttattttagcttacaattctcagatcacagtcctttagagaaagaagtcaaggcaaacactcaaggcaggaccatggaggcaggaattgaagcagaagcaatggaggagtgctgcttactgactcaatctccatggcttgctcagcctgctttcttgcaacacccaagagtaccagcccaggggtaagcaccctccagtgagctggatcctcctacagcgatcttcaatcaggaagatgcaccacaagctcgccacaggccaatctatggaaacgtttttctcacttgaagttcccttttccaaaatgactctaacttgttgtgtcaagtagacataaaagtagcaagcacagtctcccataacagtgtgaataaaaacctatagataattgaaaacggttttaggatctgtgtaaaaactctagcctagcaaagtatcaagtacagttcattgaattattggtctaagatggctgaatataaccagaagtcactctgtctacactttatttcttagatgttttagatgctgtggattgaactcaggaccttgcatctaagcatacactttaccactgagccacacctcctggccacctggaaagtgtgagatgttttgggggaaatgaagttagggctgccttgttgaatgactctccttaggtagacagtttcctacaaacttagaatccagttctacaaaaaaaaaaaaaaacaaaaaaaacaaaaaaaaaaaccctgctttctcaaaggtagaaaatgtggggatgaaatgatcctcctgccccagccttaggtgctgagaattataggcatattgtaccatgttcagttcaaggatgggttcatggagcagagtagtttagacgataggtgcaaggaagagagaaggctaacattcctggactagtgtggtgctgaggaaaccagaattggagctcacagcatgctgagaaaaagtcagtgactttgactgacaacacaggattgctctgataagttagaaggaaaagcagggtgctcttcagttgggctggtcaggtcagagaaggatttggggaggagtaagtcctgtctactcacacgttagaccagcaggcattattcagcagggagaggtggaaatacaagaatgggcatgatatttaattgggtccttgtaaagctgggcctcaggtgggagaaactaatcccaggaaggaagaccaggaaactgttgtctcctcctcctcctcttcctcctcctcctcctcttcctcctcctcctggtcagatttcagaaccaggatggcagctctcacttagtggagtccactgggcaccgtccacttctctttgatgccatgtttcgtctccattacccgcttgtgcgtgttgtgactttgttattacgaatgtgacacgggaataaacaggggccacccaaataggaataagcaaaggagtaagccatcatcacctgaatttggggtgaggggactccaaagctggtttcggaggtgggaagctggtggctgtttactagannnnnnnnnnnnnnnnnnnnnnnnnnnnnnnnnnnnnnnnnnnnnnnnnnnntggctgtttactagatgtcttgtgtgacagtttagggccttgcttgcctttctctagttggtctggttgtgtgtatgtgtttgtgtttctgtgtgtgtgtgtgttatttgtgtatgtgtgtatatgtatgtcttatgtgtctgtgtatgcatgtgaggtgtatgtgtgtgtatgtgtatgcatgtggtacgtgtgtgtttgtatgtgttgtgtatttgtgtacatgtgtggtatgtatgtgatatgtatatgcatgtggtatgtgtgtgtatgtatgtatgtatatgtgtatgtatgtatgtggtgtgcatgtgtgtacttttttcctgagacaatttttcagtgtagccacagttggattcttactcctagttctcctgccaagtgctagattgtgtgtgctgcattgctgtcctctctgtcacccctgtggattccctcactagcctgtgctgaggtgcacttaatggctggaagatgtttgggagaagtgagctgaagcttgggcttgagggaagtggggagtttaaactgagaggcaggagggtgttggtgggtgggtggggcgcctggcccaggattcaggattggttggtaatgggtgtggaaagaccaaaccagtcagtcctgttctcagcctttctgtggctttcctctgaggctgggagctccgtgggacttgttggctcaggcctgactgggttcaggaaggccaggagaaggacagaaccagggaatcatggtggaagaaggatgggtagagctggggaaagcccactgtgtgaagagcctctgctgtgtgtggttcccacggtcttcatgagtgagagcaggcagcctggtggacatgaggaaagagatggggagagtgattttagagtgatggaaggatgctcaggaccaggagtgagaggagatttaatgaaggacttccgctgtgccttgccttacacacacacacacacacacacacacacacacacacacacacacacacaccagtaaacttgaccctgtgcgcttccactttcttctggtcaaatctaagatgagcttcctggtgtctaccactctagctaacaagctgtctgttggatttacaaaatagtgcacaggtctggggtgtacctcagtgtggttgtgtgcttgcctaccatttgagaggccctaggttccatccctaacaccaccaagaataaaaaaaaaaaattcaaaagttcacagcctgctgaagaaggtgtcgggtgtgaggcaggcagtgtgagagaagaacagaatggctgaagtaggtgactgatgggtgtgacctttggtgtgagccccaaattaatggctgcttagctttagacttagagttgggattgggacactgggtatacttaatgtggatttagttttggtctggaggacaggtgtgggggccactgtggattgatcttggtcagataagaaaatgaatgagagatagccaaaagaagccaagactcctggaaacattttacacaaggaaagacgtagggttctgaatggccagagttagctatgggtataggcttattatagattgcctgtaatgaccacttgacttgggggaaaaaatcttctctcttgaatacatggaaagtggaggctactgctaggatgacgatcatggtagtgcactggactaaaggagaggattccctcttctctttctttctttctttctttctttctttctttctttctttctttctttctttctttctctctctctctctctccctctctctctctctctctctctcttcctccctccctccccccctctctctttctttctttctttctttctttctttctttctttctttctttctttcttcctttctttctttcttgtttttctgtcatggatgagagagagagagaggagaaaatatgatatttcttgggtttctgggttctatctctggagtttgatgtagtttttttttataaacagtgcagtttggtgtagtattcaagacttgcttttagatatttttctctctctaagttttggactctgctgggtaccccacttggttatttaatatatttccacatctccataagtgtggggaagggaatcgcaaggaaggtgtgcagtgagtttgtcaggtttgtctggttgtcctggcatggctggagttaggtgaggacagctgttaggtttaaggggcttcaacaaacccctttgcatccttgatgggaacaggtctctccatcttccaggcaggctctctcaggcgtgttaaaggagctgctgggttcttggtttttgtcaacttgacacaaatcgagacatatctgggaagagggaatcttgagaaaatgcttccctaagactggcctgtaggaccttttcttgagtagtgattgatgtggaagggccccaaccactgtgggcgttgccatgcctgcatgggttatcctgaatggcatgagaaaatagaaggagcaagctagtaagcagaattcctccatggcttccagctcagttcctgctttttgttcctttcctggcttccctgttatcatagcaacagacatgcaaactaagacagctggtgtattaaagagcaagagtgggttcctggggccagggtatagatttcttggatgatgtgaacaggagggcaggaaaaaaaccaagagggctgagaaggcactgaagatgagtttcagcttcccagtcaggctgtgctcagaagagagggaggtatggggaagccagggaataaattcatagagatttgtatacataatttagatattatggtttgcacaatccaccagatcctggcgaggcaggcatctgtccacacaaaggtcttggtttgggtttctgcatcaagcagtcatccactgttcctcccattagtataatcgcttgtccacccactaaccattcggctggttcctgtaaatagaagttgagagattgttccagtgtcgaactcatttactctgtaatcatcgcagaaaccaggaaatgggtttaatatcatcttaattttacagacttatgggaaacagatgtatagagattatcaaggctaacccagctaacaaatggcgagtgaactctacaccccagttcataaccacagctgttctagaaataataaaatatatggacatggacatatttgtgttgtaaggccccccacccccgatgctggacctccgctcaagtcccgggatgagctggccaacacccctgatgcaaactgcaagggctagctgaggacgaagtccctctgccatgcagggcaggggagttctaccctgagagctgtgacagtagggggcttttaacagctagctgaggagttgggaggagttgggaggagagttgggaggagttaggaagagttcttctcttccaggtgtccttggtgaaatttacaaggcaggagtggggagtgagttctttctgaatttttatctctgtgtcctcggcacaggaaggcaggcatctctggttgtacagtatagaaacaaaaaggctttttgctggctatagagaacaaagagcttctttctagctgtatttttaaagatcagggaaaacaagcttgggggacgaccaggggctttaccttccagggagaaacactctaagtaggggtctcacagtgtggtctatctcttaatttaataatgctttagaatacactcagcatttatatttctcatttcctcttcctcctcttattcttttcctccctgctcctcttcctccttctcttttgatacatggtttcctgtagcacagacaggttttgaactcaatgtccttaaactccagatcctcatgcctcccccaccggagtgctgggccctcctgaagtacctgaagatcaagcacagggcttcatatatgctaggcaagtgttctaccaactgagctgccggatatgggtgctcgaaaccaaactctggtcctgcccaagagcagaaagtgtctttaatcgcagatccagttctccggcccttgatttttctctctttacatttcctttcacattgtatgggtaacatagtatcaatatagcaaggtctgaaggaagcacgtcttacaatcgtggcatcagaaacagccaaaggagctggccttgttttccattgctgtttgttaaagtgttaacctattaaaatggttgaatgtatttggatactttcttctggtctgcaggttgcctgttagctctctgatctggagtctttctgactttttttttttaaagcaaactgcaatatacatgagcatccatgaggtttaggccattactctttatagaaatgttcactccaagtctggaggtggggctcagtagtgtagcatgtggttagctttcagtaggcctggtttccatcccaagcaacatcagaaaggcaaaacaagaattgtgcctgcgcaagcgggtccttgtgcgtcacatacccgtttctacgcctgtctctccagctacccagggaccctttgtttctttctctctgcaaagcaattgctatgtattggcctcttctccatttgaaatattgcaaacagcctttgtctgttgtcatcgtctattttaagatttatacttctaggagctttagaaagaggatgcctggggctcactggccagccagcctacttgttgagattcagggcactgagagatgctgtgccaaaaaacaaaacaaaacatgcagacaagacctgaggaataatactgaggttgtccgctaacgtttacatataggagtacacacacacatacacacacacatgcacgtgtgcgcacatgtgcatccacacacatccacatgcatcccctccaataaaaaaagatttatatctttctaattcttccttttattctatttttttgaggtgtaaggggattggaagtatttgaaaccctcagtgtttacccagaaatctttcttacacttttaaaaaataatctttttgaatttttaaaagtctatcttttttcttgcttccaaatttctttcattgaaagtccaggtctcctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaaggggatctgcaaccctataggtggaacaacattatgagctaaccagtaccccggagctcttgactctagctgcatatnnnnnnnnnnnnnnnnnnnnatggcctagtcggccatcactggaaagagaggcccattggacttgcaaactttatatgccccagtacaggggaataccagggccaaaaagggggagtgggtgggcaggggagtgggggtgggtggatatgggggacttttggtatagcatgaaatgtaaatgagttaaatacctaataaaaaatggaaaaaaaaaaaaaaaaagaaagtccaggtctcttttgtgattgcctgattgttttttttttaaattactttttaaaacatacaaaaacataacaaactcaaaatttctgcaatcaggttttatacctatcatcaaacagccattcggtatctttgtctaagaatgctttgtgagagtgttgcataagagggtttattttgaggaaactacatataggtttcactttaagttttattccattattacatgatggtcagataatacacctctaaaatttttaattaatttttttttgcattttttgtggtcatgagatatttatagatatcccatggtaatctggtatcagtagtcattagtgatatatatttgtttctgttatctttgattttatttttggtatttgtttgatacgatctcatgtagcccaggctggccttgagtatgttgtcttttgttagtaaaatgaaaaaacaagagcaggaaacacgattaagagtatctaggagtctcgcggtttctgttggtctcatgcctggagcagcctgaaggtgaggctgtattatctggctgcagatgaggccaaggctaggatgaaattctatgctggaacattctctttacgaggctactcctgaaattacagagacacgggcatgaaactcaatattctacatagccttgagtagaaattcttgtttgttcttaggttacatatcaccattttggtgaatttaggtatcaagaggtttagtctcaaagtttctgttgtttatctaagtaatggggtctggccatcctgccaggactcggtgcttatctccctgacatcttacacatactttttccataaagggaaggaaaggagtagtcagatgtgttcctctctcctgcatttgcttctagggctgtagcaagtcacatttatgggtgttttgcctgcgtgtatgtctgtgcacccagtgtatatggttctcatggagaacacaagagggccctggatcccccgagactggagttacagatggttgtgaacaccatatgagtggtaggaatcgaacctgggtcccatagaaaagcagccagtgctattaacccctgagccagctctccagtccccattttagacctctttttccagtccataaaaatatgttgagcatctatacagtgctataaaaacatactggacaaatgtcatcatagtcctcatccttgcctggttcgtttgtcgtctcaaaattggattaaacatagattaacatgattgttacgggagtgtagatgctttgtgggagattagacgacgacgcgtccacctttccttgggagtagggggttcagagagaatgaaacattctggctaatgcttgaaaatgaaagtgggtaccaggctggtagagaagtgagcgtctgcattccatgtgaccatggcgaggaggatgatagcagctttaggaaagctattaggaaagcatccctttgcctggatggtgccatgcagttagagtttgggaatgtgaagctggaggagctggtgaggagacaaacactgaagagtgctgactgacagagggatttgcattatattttgtggccagcgagtcattaatgaaaatcgtatggatgagatttgaacctgacctggtttattttggaattgaagttttggttctctgcgacgcatgcacgttgacttctcgcctttaactttctgttcctgcaacgtgtgatctctgactcagatgtagatgtctgtgccacatgccatgaacatgccacatgccagcaaaaggaagggaagagaatctgcatttgcaactatgggttttggggcaacgggaggacacggtgtgttggtaagtatcaatggtgggttacgctgaaaatacgaataaaaaccaaaggttttccagttttagagtcagtgtccatgtagggtaaacattgttattttgttcacatgtttttcttagtgggttttttgccaattacaacaaaatcttaggttttattgtttagatacattcttattttctggtgtttctaaggaaggccctctcatattagatgttgttgacctgaactctctggaaattccttgacctacgcagactggaagtctgttttatgtcttgagtttaacttaacaacaaaagcaaatattacatttcttaatttctttgggatgacttcaaggaatactttaagataacttgaaggttgtttagactagatgcagctaagattatttatttattttgcctcatgatttctatgcggggacaatcagataacactgacatccaagcacaattcagagagagcgtcacagcaatttaactataataaatgtagtaatggcttctccgtttcctccttgctatgtgttgtaaaagttttgccttgtagctgtggatagacagtgtctgtgtctacccttgttatcatgcctttgtgtcgactttcatgtgtgagtatatgtgtgttgcgtgtgtcttatatacacatgtgggtgggtggaggggcatgtgtagaggccagaggaagatgttggatgttttttatcactgtcacctggacacagggtctttcatcgaacccagagacaggctgtcagccaagaaaccacagtgggtctccatggccatgcctggctctgctctcttttttcttttctttgtttttccttccttccttccttctctttctttttctttttcttttcttttcttttcctttcctttcctttcctttcctttcctttcctttcctttcctttcctttccttctccttctccttctccttctccttctccttctccttctccttctccttctccttctccttctccttctccttctccttctccttctctttctctttctttcctttcctttttttttcttttcttttttcatttttccttgagacagggtttttctagatagccctagctgtcctggaactcactatgtagagcaggtttgtcctcaaactcagagacccacctgtctctgcctcctgagttcgaggtttaaaggcgtgcaccacagggcctggccatgactggggttttatatggctgttggtgggggctttgaacttaggtgctcatgcttgtgtacagcaaatgcttttacctgccgagccgtcctcctagccctttgtcctgtgtgcatattttctcgttttcagtacttaaagaaaaataacaattcaatcctacattcaaagagcttattccaaaggttgggcgagccacattccattgcacaaataaaaactgtccttgtgaaccatcgtccactccacatgctggacttgctttgaccagccccactctagagggctgttcttattagaagtgtagctgccctgcagtcagagtctctcctactctgtccccaacaaggcctggtctcttgctagcaacgaaagttggaattgaggggctggacagatgttcctctaaggcaatggttctcggcctgtgggttgtgacccctttggcaattgactgactctttcacaggggtcacctaagaccattgaaaaacatagctatttacattatgattcttaacagtagaaaattacagttatgaagtagcaacaaaaataattttagagttgggggtcaccacaacatgaggagctgtgttaaatggttgcagcattaggaaggctgagaagcattgctccaaggaattcctcctctcctggatgctaactgtgctctcgattgctctttgccttctaagcaatacatgcatctcttaggagaggagagggcttcacaacatttgtgtaattgttcccactgggcactgcctattctggtactgggactgctgtgtgcacgaagcagggtactagtgaggttacacatatgccaaaggcaccttaatatggtattatgccaaacgacttaattctagaactttatctaagcctaaatatcccacatgaaaccttcagggagacattaaatgtctccaaaggacaccaaatatgcctgttgtgtgttggtaggtgtattgtgatgattgttgttaggttttgttgttttgttttgttttgagatagggcttctctgtatagccctggctgacctgaaactcactacatagaccaggctggccttgaagtcatgaagatctgcttgcctctgcctcctgagtgctggcattaaaggtgtgcaggcattagatgcgtgtatgaccatgacccacaataggtatattttatggctgttttttaaggttcacaagcagaaatggaatgtaaagaaaatgctttctggcccctgccagaagtctgcgatggaggctttaacttcgttttaaccttccgttgtgacttcagccttccccgttctagctgtcctacactagaacgtgtggccgccgtggttcgcacaggtcgccgacaatgtgagcatctcctgcctccgtatgaactctgctctgaggcatcactgctaattccgttgtgtttcctgggggctgacaattctaattttccagttaaataattggatataaaattcatgttagggtcaggaaaggtggttgagcggctaagagcaagtgccgcccttgcagaggaccagagttttgttcccagcagctttatctgatagctcaaaccactggtgattttagttgcaggggatcagatgcctctgggctcccaaaggcaccttcacttactggcatgaagcttgccagcacatcatagaaacgttaattctctaatacagaaaagaccaacagaatggctgaattggaaaatgagattattctaggctcatttcccctggcttataaaatgtataccaaattaatgtgtgtgcatgtgtgacgtgtgcctgtgctcgagcttacatgtccttgtgtgtattcatgtgggtgtgtgcatgtggtggtcagagcacaacctcttgtgatgggtcctcaccttccaccttgcttaagatggtgtcctttgttgcttgcaactgtgtacgccaggcatgctggccactgagcttttggggacccttctgtctccatctcccatctctccataagagcaccgggttgcagatgcatgccatcacgtctggaattacataggttgtggggatttaggaatcatcttacccactgagacaccgtcccggtctctacatttaaaatttttatttttactccattctatctgtgtgtgagtcacatgtgagtcagggtgtcacacttggaggtcttggaaatcagaggaaacattttgggaggtggttctcgccctccccacttaaatgctagggatagaactgatgttaccaaacctcaggcaagcacctttattctatgagccacacagctgacccaccaatattttattttaaaagtgttattactctcatgggactgaacgcagagccttgtggatactaggcataccagcttcctacagacttacagctccaaccctgatttttttttcttaaacatgaaagaaattcaaaaataacctactgccagtcatcaagtaagatggattctgagagtggaaggttgtgcttctcctgcggtttcttatacagcaggtatataattatgagccagctccttttagcctggaaaacatagtggagggaaaagaggctggagaagccgttagatcaggaaacggttgtcacagagtagtgagggaaacttctgggtaagaacacgttgtgtggatggaaagccgttgtgtgagttgttcccatgcatccatctgcagacaaagatgagtgccagtttggagccactgtgatctgtgggaaccacacatcctgccacaacacgcctggagggttctactgcatttgccacgagggctaccgggccacaaataacaacgagacgttcatccccaatgacggcactttctgtgcaggtaccgaagggggctgcagtgggtgggtagagtgtggggtcatggtcgagagccttgtgcttggacacagactgagtactgtttgtcaatattagagaatttaatactaatagtatgagttggccggccttctgtcaacttgatacaagttagagtcatttgagaagagggagcctcaatgggggagtgggggatgcctccataagattagcatataggcaaatttgtcatgcattttcttaattagtgggcggggccagccctgaacagtcggtcctggatattttaagaaagcaggctgagcaagccatgaagaacaagccagtaagcagcattcttccatggcttctgctccaggttcctgccctgacttctctcagttgcagagtgtgacctgagagttgtacaataataacaacccttttccttcccgtgttgtttgtatcccagcgatagaaactctaactaagatgtattgttagatgggataatgttactgcggtccatagaatgttgttattttgagagatgcatgctgaattgtgtggggcactattatgaagtattttgtgattttttttatttctttgagatattttaattgacaaaatgtgaatagtgattgaatagtttatgatattggagggtggacacctggtaatttattgcactgtttttctagttttatgtgtttaaacatttaaaatgttatgtgttttcatgagtatgtgtgtttgtgtgtgattacatgctgtgtatggatttggtatgtgagtgagtgtgtgtgtgtgtgtgtgtgtgtgtgagtgagagagagagagagagagagagagagagagagagagagacaggaatgggcctgtgtgccacagtgtgtgtggtgttagagaacactttcaggagttctgttctttcactgcaggtcctgggtgttagcatttcctctaggttccacccaacagttacctagcagcagccaggtatgagcctggctcactataaaaggattgtttggcttctctctccctctccctcctccctccttgctattcccctcctttcccctgtcccctgtccctccctctcttcacctattctcccccacttcccatgtgtctctagtcagcctctttcctctttctctcctttccctttttgtcctctgttcctctcctgtctctgcctctaccccattccctgggacctcttcccctcctcccaaataaactcccgtttatattaggcctgcggcatggtttgactgttacagggggacaccttggcagggcccaccagggccctccctcacggtctataaaacacaacaatgggcattgaattgaggtccctgcacttgagaggcaggcacccttagtcactgagccatcttgctggctctttttacaatgaacaaagaggctggcactctctggagactgtgccagctacatgttctgtaactaagcacaaacacccactaagttccagggcttctgtgcctcattggaggtctgagctgggctgtgcagggggcttgccaccacaggactcagctaagtgactaatgtgactttggtcaccacagtaactttgttggtatgattcttagcatgtgctggttgaatggaagccatgggctaagccctcctgatgttcagtgactataggtgggctgtttctaggtagcatgtcctgataatacagctcttcggctctctcagatccctgaacagtctcaaaggggagaggccagaaactcctggttctgagaggcttggcagagactctgtggcggcttgaaagctttgtggtatttcaaggttttcagggaagaaagcagagtgtttactttttctatggcttggaaccgcagcttctgacctctgccattctggctgacctgggcaagaagaaattcctggaaggatacattcatacattcagcttgttcctagcaggagtgagtgtattctctcagagaacacattgtttccagtgtctattgtctttgcagcaagttactggctatgtggttttaaaactgatgttgccatattaaattaggcacattaataagaaagaaaacttttgatttgtttgtttgtttgtttgtttgtttttgagacagggtttctctgtgtagccctaactgtcctggatctcactctgtaaactaggctgtcctcaaattcagagatctgcctgcttctgtctccttgtggagacagtgctgggattaaaggctagtgccatggtgcttggtgagatgctaattctaaaaactatgtatggtaatgatctattatctagctcattcagatacttttctcatgtttttcttctctgctgccagtgggaggtaacagaggtgacagacagacaattccattgtcacatgttggagaaaggtcacatggatgcggagggtggctcagtattgttctgaggcatgcattcaacttgtaaaagaatggtgaggtgtggttgctcggccctttagcctcagaacgtgagaggtagtggcaggtggatctctgtgtccaggccagccagagctacacagcaagttcacggccaggcagatatatatcaagttcaaagacaggcagaggtactctatacagtgagtccctgtctcaaaaagaaaaatacaagcaaaacaaaacaaaacaaaacaaaacaaaataacaacccaaaacacccaaaagataggaaggaagagtggaggtggtgctgtagctgggtggtagatcttttacctagtacaagcaccaaacaggcagaggttagaaaggtggagagtaaggagggggaggggagagccaaagagcaggaagggagagaagaaaatactttcttccagggtcaaatagatgtcagccaaacaagagccaccttgcctggaacacaatcccgcgcaggccctgctggatttattctatttcttgcaattatttagtgactttcctttgagagagagagagagagaaagaaagagagagattgagagatttcgtgtttgtcagtgtccctccctgtgaaatgtttaatctagtgcctttatcgtgtccacagagtcacctgctattgccagcagccacaacgcctcagggaagcctataccgcaaggcagtcgttgcctgacttctcatttcgaggtagctagcggttacccaacggggggggggggggggggggtgtttcttgctggtgctgagaagctcaacccttcggaatcagttgccagagagacaagagtgcatgctagttggggtgtggttcaagtcttgcttggaacctcagtcctcaaagcctgacctctgcactctaagacatcttcttccgaggaatgggttataattggccaagtttaaatcagcctcaagagctggtaacagatagccctccatgacagaggactaagctacagtgtagtgcgggctgattcccgtcaattctgaagaaccagaaaatgtgtaatgtccagagatgggccttcagtgactcttgcaagccacagatggatgaatgaaaaagaaagaaaggaaggaagagagagagagagagagagagagagagagagagagagagaaggaaggaaggggcatgactgctcttaggtatggtggaagagaagagaagagaaggtttattgtagataaaagggaaaacatagccagaggcagagacagggatggtcctgagtggccatgaccatactgagctatgccatgttgggagagggtgaggggaaggaagaggagagaccaacagagccaggtacagcaaccatgtgacccaaagttataatggcagtcaaacgggttggattatgtagggaagaacacccagtctcctgggctggagagttcagggtagagggcagggtatgccaccaggaggtccctgtaacaggtagggactaaaggatgagatgagaacctggaggccaggtttgctttgctatgtggtataggcacctcagccatttggcctggggtttgaaacctaacaatggggactgccacgaggcaaggttttcagcaatagcaaggagagggtgatctgagagtaagtggagagagctgagacccaggtggagtaagaccagggactgtcatttccctacccaggggcttctgagcaggcatgggtctcctggggtctgttgaaaacttcagggtgacttccctgtgcttttcaagtctccaagtcttgcatacaatcctgactggcaacagcaaccttgtcacaggaagttcctgcatcaatagaccattgtgcttttgcttcaggagaaatggaagcccctcggccctggctgggaaaggagaacaagggagctctgccgctcaggagctctgctcccaaagccagtgttcctcaagtctgcctcacaccttcatgtctagatattggttcttacccacttcccagtccaggttaggtttcttagcctctccctagggcaggagcctctttcgaagaaagcctctattcccaagcttctctgttcttgctctctggtgcctgagcccgccctggccttcggctcaaatgtgcaatctcaggaagactgcctgccctctgtggggaaccacccatttggcttgcttctgcctgaggggtttcccccaggaacttttccaaatgggattgcaaaagagtagattcactgtgaaaagaataagtgtgatagttcctcaaatattaaaaagaaaatgactacatggttctgcggttcaacttctggacacttgcccctgaaacagttgaaaatggcatcttaaaaagatacttttgtatttgcttgttcacagcagcatcactcatggtagccacagagcatcactgatgaaattcacctgttcgtccacagatgaaatagaaggacagtgcatgccagagagcattgctcggctttaacacggattggggggacatggtagggcacatgcttagcatgagcaatggtctagggtcaggcctagcttgctttctcacctctcccatgccccctcttccctcccagatgctgttgttgtggattccactgaggcatgaagttgtcagatttatagagtcagagaatagaaaggtgtttgcaagggagatgagaggaacatggacagggctggcgagatggctcagtgggtaagagcactgactgctcttcaatggttctgaattcaagtcccagcaaccacgtagtggctcacaaccacctgtaatgagatctgacgccctcctctgttgtgcctgaagacagctacagtgtacttatttataataataaataaatctttatgccagagtgagtagggactgaacaagtggggccgaccagagcaagcagaggttctaaattcaattcccagcaaccacatgaaagctcacaaccatctgtacagctacagtgtactcatatgcataaaataaataaataaatctttttaaaaaaaagtctgatggacatagaactttagaagatgaaaggaatcctaaaaatgactaccagggactgtggcacaaccctgtgactattcctagcactaactgcactctcaaaaatgattaaaatggtaatttttacattattttatcatcattaaaatgtcatatatttgctctgatgttcagccacaatgttcaagtgcagtacaaattatcgacaaaaacatagtataccattaaatgcaaagtcttgggtgacatagaatctttcccatgggaggaaggcattctaataagcttggtatgggtcagtcacccgagattccagcacagactagaaaaaaatagtttctaagcattataagcatcaggtgattaaaaaatcaaaatcttgggactagaaagatggctcaggagatgagagcacttgaattcaggtcccaatacccatattcgatggctcacaactatggtaactctagcaccgggggatccaacatcatcttctggctttcaagggcacctgcattcatgtggcacacacacagagacacacatacatataaataaaaataaatcttacggaagtcaataccacattaatatcagttgtacgtgataggtgacatcaaagatgaaagccattagttacctcttcagtttcttaagataggggactcttgactgcaggatacacaatcagatgatagtcctgactggttatgaatatggactttcaggcaggtacttggcttcaaattctggcattgctattgctgtctggaccaagtgcttaaccattttgtcagctttagttacctcaaaatgggctattgtagaaattaaataagatgagtatagtatttaataaataatgaagtgtttaggacagcgcttgatatgtggaagatgacacacagcaattattgttattagcataattatgacaattatggctattaggttattgagtgactgtacacaaagctagctaataaaggctctgtaactcctgcagagttactcagcatccagaagtcccatgtcttttccataccccggctacttacccatgtttggaaatccggtgagaagctctgtgtttcttctcacccgatctttttaaagctgtctgcagagcaggtgggatggctgtgtccatgcttaggtaaaagatcagattttctcattaagttgacagaagtgaggaaaagaagaccaagggcagattcctaactggcaaagaaaccttgccaagctagaatgagtcaaaatgcagatgtctccagggataacatcatcttaaaatttgtcatcaggaatggagagatggttcattggttaggagagctggttgctcttgcagaggacctgagttcgattcccagcacccacacagaggctcagaaccctctgtaactctagtcccaggggatctggtgccctctctggcttcttcagaccccagccacactcacggtgcacatacacacatgcagacaaacactcacataaaatgtaaaagaaaagaaaagaaaagaaaagaaaaaacccacaacttttaaaaatatgaaataaattgatctagattgggatcacattatattatattattttatattatttatattttatgaatctcctcgtagcaagcgctcctagttctgtggtcactgactggttctagacctcctcattctttgtggtgtctttaatttccctcacttttggcagtgctgggaagtgaacccaggcctcctgcctgctgagtgcatgctctgcctctgagtgacccccagcccttcccttcctgacaccgtttcttctgcgctgattcgccgcctagagtattttctcagctcttctttttttggaagagaaatgtcagtggcacaattcctgaaaccgtttgtattctcaactgtcgtttcgctgcttagccagagcgtgctgttttgttcctttctcagaactctaaatgctactcagttcctaggaagccctgtgttcccgacaggaagtcctgggtcaggttgagtggttgctcacaggtttctctttcttttctccagaagtttcttattctcttatttatggatttcagatggccttcatgttttgttttctttttcttttaacagctaccccttacataatacatatttgtgtttgtttctgatgatacatcctgagtcctgtatatgcagatctgcctgcctgccttcctttctgcctgcctgtctgcctgcctgcctgcctgcctgcctgcctgtctgtctgcctgcctgcctttccttccctccatcctcccctctctcacccaggctgggtatgaatctatagccaagggtgttttgaaactcaccgagtatccctggctggtcatgaactggtggtaagctaccagccttagccttccaagtgctaggactgtaagtatgaaccatcacacctggcttgttctttctcttttaaaactagctctttcactaagtgtccttgaaagtgcctacctacttaaactatacaatacagcagtggtattatattcatagaattctgatttttgaagatcttccatctcctcaccaaagtctgttgtctcgccacttcccactgagaaaacaacgggaaacccacttgtgtctctgtagtttgcttctggagactgcttttgaatgtgggcatggtacctagccttttattatgctggggttttgaaatagttctgttaattatgtcagagattgtcctttctgccagctacatcattgtcttaacagggttgcagcaggtgccctgtatccaaggcatagagagactacgagtggggcccggagctcagagagacccagcaggaagggtgtgctcagcccctctggagccctgatggccaggtgtaggtttcctctctcagcccgtgtgctgtgctgtccctatgagaatgactttcgtttcatgcctgtgaccttagagctgtgcttggatttgcatggacgagctgtggctgatggttccctcactttgagatgaacccttgcatagcctctccttcattatcttccctttctcttcaacacgtgctggctcttttttgtctgtctctgtaagattttgcttttggcttcctggtttctgtctcacgccagttttttcactgtgtcttgggagggctcctcaggttgggatttgcaaacccgattttcagccgtggcctctctattgtttaatgcccctttgagtttttattctgggcattcatattttgtttttaatttacaagatttcattgttttcctagaaatctcccatttaaatttgatgtattattttcttaattgcacttgtttgagctcttcaagtgtttggggtatttggattatttattgctgccacccagagatctccctcaagcttagtggcttaaaagagcgacttctgggccaaggaaaaggtttcctacgtaaatgaagactggaggctggacccccagaatctatgtaaagccacatgtggtaacacatggtagctgcaattctggctctcttctggagagatgggagctggagacagatgtggacacacgagccggtttgcctggtgtgtgccacagagaacaacagagagaccctgcctcagaggaggtggaaggcacacacggatatctgaagttgttctccagcccacatgcgttccatggcatgtgcatgcctacattcacacacatgaacatgcatgcattaacttgtctgtgtgtgcacatacacacctacgcactgaacaatttggtgtttcccacaacttctggtttgaccatataattctttttatatcgcctatggactgaaaaactgtgtgatacactgaactgtgatctaggtgacaggcaaaagagtgtaacagtgaattgttagtcctcactctctggggggatctcacttctaacctcctaccagagctctctagactagtgaatgaaaacagagacacagagagacagagagacagagatagagagagacagagacagacaggcagacagagagagacagacagacagaacagagagggagggagagaccaatgggagagagagagagagagagagagagagagagagagaaagagagagagagagagagagagagagagatttttaatatgcctttctagctcaatggctgggcacttccaaatttccctgcagctaacacatactccctctgctattctttaattaatatttgctaaatctatattttatctctgctaccccagacccaattgaggaagtggtccctgggaccacttttctggattcttacatgtcggcaggccttcaagtctgatctctctgtttccccttcatggcacttctgttccttctctcctctgctcttcttgcccaggaatcttaaaagtcctgcctctttcaccctgcctagccattggccattgactctttacttatcagtcaaaaaacaatcgggggcaggggccctcatgcatattagtgtgatttggggagccaaattaagacaaagcattaaaatcaatcctcaacagaaagcagctgttcaagtattaggaactccatcctgacaagtggcttcagttctccaagcggcttctccctccctccacatggaaggtcaccttgggagggctttttcttgaggcctctgtaagcacaacagcctaaatgcaagaggaagctgccagcttcttctagaccaggtcagcaggctctgcactccctctgctctgttctgtccatccaagcaattcttaggacttaatttaattatgtgttacttatgtatatgtgtatgtatctgtgtgaacatatgccacctgtgttccgatacctctggagtccagaagagggtgctgaattccctggaactttaggcagttgggagtggccccgtgtgggtgctgggaacgcagctcaacatctcaagaagagtgacacggtgcttatgaagtctgagctgtgtctccagctccactctcccctcttcttttatttgttttgtttttcttttgttttttttttttgttgttgttgttgttgttgttgttgttttttgttttttcgagacagagtttttctgtgtagctctggctgtcctggaactcactctgtagaccaggctggcctcgaactcagaaattcgcctgcctctgcctcctaaatgctgggattaaaggcgtgtgccaccacacccagcttcccctcttcttttaatgccaagaattgaactacatttcaaccctggaaaataaaatgcaggaaagagaggggaggctcagtgagcttttccttattactccgactcctgcaccaccatactgtcctctgctcatgggctggaaagccagcttgtctgctgatagattttttttttttgtaaagtcttctgtaacatttttttttatacctggaacttcagtttagaacttttatttgatttagtagtagtagtagtagtagtagtagtagtagtagtagtagtagtagtagtagtagtagtagcagctttggtggtcaaattcagggcctggtgcatgccaggcaagtgtttcaccattttgtaaacatttgtttgtttgtttgtttataaattttgagacaggatcttactatgtatagcctgggctggccgggaactcattatatagaccaggttggcctcaaatgcataatgcatacagatccacctgtctctgtctcctgaatttaaaagtgtgtagcactatgtttgagctattaattcacttatttctctctctctctctctctctgtatgtgtttgtgtgcttgtgtgtgcatgtgtgtgtatgcgctgggcattgaaacaacgacctcatttgtgctgggcaggcattctaccaccggctatatcccaagccccctaacattgcttgtttgattttttgtttgtttttttagtcccaatttgttgggaattaggaatctttgtttgtttgtttatctcagaacacactggcaagtatttattgaacatatcctatgctttcagtggttttggtatgaagaatttatatggaaaacctacaagaagcaaaataaaagtatagtgcaatcacaagcaagtgcgtgcatttatttggtttgatgggcagcatgaaaccgggctgccacaatgtccctttctctgttcttctcccttcgttttacattttgggatgggtctgaagacatcgatgagtgtgaagattctggcctgtgcagacatggagggcggtgtgtcaatactcctgggagctttgcatgctactgcatggaagggtatgtggcaaagaacgggcctgagcctttccacccacgcacggatgccacatcgtgcacaggtaggtgtctgccggggaagcagtacctgaaggtgagatttggtaggtgtcatctcctcatgttctgatgtttataggtctgtattggaggtatgagtatgcattaccttcacatatctttatgaaataaaataaatgacccaatcaagatagaaagagtcgtggtttttaaaaagttaaacaagcccagtagtggtgaaacattcctttaatcccagcacttaggaagcagagggcaggctgatctctgtgagtttgaggacagcctggtctacagatcgagttctaggacagccagggctacacaaagaaactctctctgtgtgtggagggatgggatagcgctaaacatgagggactagatattttggtactaactgttgcctgtcagatctggtaagaacccagtatctccaaagtgactttggaaattaagaaagtgcatcgaatataaggtagtttgcagtcagatttgtacttcattggacaaggcatctctttagtgagaatgagtcagagccgattctgtgtagatgctgttgtgtatggagcgcccggagcatgataaagacaaccattggaaatgtgctcagaaacatcgtggaaatgaatctaacacagggtctggggtgtgaggcatggggtatgggtgcagagagatggtggattctgaaaacttgcatttgtaaagtaaagaagttgacacggttttgttttcagaaatagactgtggcatccctcctgaagttcctgagggctacgtcgtgggaagctacagctccacactgggcggccaggcccattatagctgcaaggaagggtttctcagcgtctcaggagacagaatttcacgatgcacagccctgggtgtgtgggaacctcccaagttacattgccaaggtgggtttttaaaagcctcagctttctgcttacagtgtccctaggttgcttttcagtttccctttgggaataaatgcattcagtaaagccgatacaccggtatttgttcctggcggggtttgtgtctctagtatttttcagggtctgtatcttagtgtctgcaaacaatgaccctacttttgttctgcatttataaaatttttctattacaggatcttggctagtgtttgcagagtgaaaacctaagcaattaacatagaaatgttttttaatcttacttctgacttgtatggaaatgattctgatgtttcaacatgaattcagctttttaaaaaaatgcaaattcacctttatttatttatgtgtatatgcatgcatgtgtacaagtgtgtgtgtgtgtgtgtgtgcgcgcgcgcgcacacgcgcgtttgtctatgtagcggtcagaagacaacctcatggagtcagttttttccttccctcatgtgagtcctgggatccagttgaggtcatcagacttggcagcaagccacctttacccgcaaagccataccattggctgtgatctcagccctttgatgtgtggataccgacctatttatgtgctgtatgtaacactatgtgccacatacattctaagcaagttccctgaaactgactctcttagtccttagacgattcctgtgtgagacactcgggtgagaaggctgccctcttccaggcgtccaggtcacagtcaggggcagttgtggaattagaagccagagatgccagtccgaggctgggttttcagttgctctgctgtttgctttgttttttactattgtgattacttttgtactttttactttctcatctctagtgatttccagttcaacagttcccgggtttcccaataatcttaaggacgtgttcgtccatgttcacttttgctttttaaatcagacactaattatttttttgttatgccttctaagcatgtaaggtgacttcatatattttgacattaaggtgactctgctttttcctttaatcagtaatataagtttcactaacacatttcctgatagtgattagtgtcattaggatgaattattttcgaggctttggcttcttattattttaatcaggatagtatttgctaaatactatttagaattcttcactgataaccgaaggaatgccatttttgttatatttagtatcaatgacattctgaatttaaaaatatcaaagcattttttttccttgctctgtaggatttttaaagatttgggagatttcgtttggaaaaccatctggatatgacactttgggcatatccagcccttgaagtatttataaaactctgatttttaagaatcatctctctgggtaactatcctggctaatctttatcttatacactttttaggttgaagagacttttgatatatatttaaaagtaaccatcatagctaatatcgatgatcaattgaaaggatctaggatcattaaggagataagattctgattgcgtctgtgaaggattgtcctaggttagggtcactgacgtaagtgactcgccttaactctgaggggcatcgttctgtaggctggtctcttaggttaaaggagatcactcatacaaacattaactgctccttccctcctggctgtggatacagtgtaaccagctacccccccccccagccacagccacagccacacccccaccacagccacacccacacctcccgctgccatgccttctactggggtggactgtatcccttcacaccatgagacaaaatcaactctctctttctttaagttgcttttttttaaaagatttatttattttatgtatatgagtacactgtagctgtcttcagatacaccagaagagggcatcagatcccattacagacggttgtgagccaccatgtggttgctgggaattgaactcagggcctctggaagaacagtcagtgctcttactggctgagccacctctccagctccttgaggttgcctttgttgggtgttatttcacaataagaaaagtttctaatatagtaatgatgaaaaaggaaagtattcatttttgttgaatttattgcatggctaagttaatcttgatgctgttttgacttactggggctttaaaacatgtttagatatatttttatcatcctcagagttaaggggctgggtaatggtgccacatgcctttaatcctagtcttgaaaaacaaacaaacagaaagctataaggatatattttagttattagattatcttttaatggatcagttccctccctccaactctgatatctatttgatttccccttctaagaaagattcagccatcctcccttgggccttctttgttatttggcttctttgggtctgaggattatagcatgggtaccctgtactttacagctaatatccacatattagtgagcatataccatgccatgtcctttggggtctgggttacctcactcaggatgatattttctagttccatccatttgcctgcaaaatttatgatgtccttgtttttaatagctgagtagttattccattgtgtaactgaactacattttctgtatccattcttcagttgagggacatctgggttgattccagtttctagcaattatggataaagctgctatgaacatagtggaacatgtgtccttgtgagatggtggagcatcttttcaataaatgctcaacagtggtatagctgagtcttgaggtagaattattcccaatgttttgagaaactgctgaattgattcccacagtggttgtacaagtttgcactcccactagcagtggaggagtgttccccttgctccacatcctcaccagcatctgctgtcccttgagagttttattttacccattctgatgggtattaaaagaaagaaagaaagaaaacgaacaggtaaattggagctgggaagatggctcagcacttaagtacatgaactgctcttacagaggacccaaatccaggtcccagtaccaacatcaagtggctcactatagcctgccgctctgtctccggaggaccccacattactgttcctcatgagtacttgtacagacacacacccatatacataattaaaaataatagtacagtagatattttttaaaagaatggggaaatgatctgagtaaatgtttctcgaaagagtacttgcagctgtatggggggaaagttcactacgactaatcatgagggacatgcaaatccatctctacagtcctgccatctcagcccaaatgtggggagggcgaggacaatggggaattcctgacaggatgtcaattagtgcagccactgtaggaagcaccaaggaggttcctccaaaatggaaacaggaattaccacacaagctagctgtccctctactggacgcaagaggagaggaaatgaaatcagcaaatcaaagagacacctgtatgcacattcctaatacagccacactcccaacaagtaatcaagacttactcaatactggtgtccattggcaaatatacaaacaaagaatgttgtgtattcaaatatacagtgggctattgcacactcataaaaagaagcaaatgctgccatttgtactgacataaacagaattggagaaagttgttaagtgaaatgagccaggcacagaaagccaaacactgtaggatctcacttatatgatgagtctgagttcatctcaggccagtgaaatggctcaggaggtaaaggtgcttactgccaagccagacaacctgagtttgactcaagatccacatagtggaaggagaaaattgacagaaatgtaagccgccctctgacttccacagggtcatcacacacactcacacccccccacacacacacataaacacacacatacatacacacaaacacacacacataaacacatatacatacatacacacaaacacacacacatacaaacacacacaaacacttgcacacacacatacaaacatgcatggacacacatacacaaatacacatgtgttcacacatacacacaaacacaaatacacacatgcacacacacacacacacacacacacacgacaaacagacaaacacaataaaagccttggcattaaaaaaaaaacttaagattaaactgggcatgggggtgcatacctttaaacccagcagcagaggaaggaggatttctgagaatctgaggccagcctggtctacatagagagattcaggatagccagggctgtgtagaaagaccttgtctcaaaataaaacaaaacaaaacaaacaaacaaaaaggcttaagattaaaacaacttaaagaggggggctggagagatgactcagtggttaacagcactgactgctcttctagaggtcctgaattcaattcccagaaaccacatggtggctcacaaccgtctgtaatggtatcggatgccctcttctggtgtgtgtgaagacagggacagtgtactcatatacataaaataaatagatctttaaaagaaaaaaaaaaaaacaacttaaagtttctctccttaagtagaaagcaaagcacggttgtgggattaggaagtgttctagaagttccacgggaagccatccacactgttcattgaaacaggatcaatcacggttgtcttcttgcttcaaaatgtttgtttcttttaaaaaatatatagtatttaatgtattctttgaggcccttgtgcaatgcattaaccacactcacctccccactccttttcctaactcctcctagacctttcccttcctcccattcttatgcccctgtggacccccaagaccactgaggagccaattctgatacaaacatctgacatgtacaaacacacacacacacacacacacgcgcacacacacacacacatacacacacaatatatatattatatatgcaatttgctatacttttttcttttcacttgaccattggcatatttgctgatggagtacatactgctaacctgactgctacccagtcacatgcaagcttgggaaatttctatatgggtcagcaagttcatattttaaaaaccacatttctggcgtaatctgcaggaactgaacatgggggcagaactacctgacaaacagcatggctaagttatctattctctgtaggatgtcttaagttatctatatgtaccttgaccctgcttttgggacagtgctccaatggattttgtagttttcttcctgaaattagagtttagcccctggtctcacacaaaatggagtttcctaaaaaacagagttgattgggctttccactgtccccgttctgatttcatgtcctctttctaagcatatgcctctcagacccctttgtgctgctcatggacgtgggggtgggccattccctgctgagtagtcaacattctggggaccagacccttaaagaaaaacggactcttcctccccaagaagccatcagctgtccacagctcctcaggggtggagcaccatgaacctcgttctgctcagtgctagaatgttggctggcttgatcttatgtgggtcttgtgcaggcagccactgctccatgaatttggggtccagtggtcctgtcatgcccagaagtcagcgtgtgctgctccagttttcactgtctctgtctcccttgctgctggggcttcctgggcctggggtggggagtgtgtagagtgtttggcgacttacttgttgcatgtgcgggnnnnnnnnnnnnnnnnnnnnacgggtctgcaaccgtaatgcctggtgcgtgtgtgtgtgtgtgtgtgtgtgtgtgtgtgcgcgcgcgcgcgcgcgcgcgagcgtgtgtgtttgtacatgtcagatgtcagacccaggtaacattcctcagtagccatccactttttttcccctcttttcctttttttaaattcagaatctctctctgggacctgggactttcagtgagccccagatgtccatccacctctgtcttgccccagatgtccatccatctctgtcttccagcacggggattacgaacccacaccagtgtgccctggggagcaagctcaggctcaggttgtagggacaccaagtgctttgctgactgaactatcgtccacagtttacagcaatcctttcaacattttaaaatttctttggtgggagggtataatttttaaaataaccagtgaataggaatttgaaggttctttcataaggaataactaatgtttaaggataggggaatgtgctaagtgctctaatttgaccatgagacactgtgagtgcatgtatcaggttagcagtatgtactccatcagcaaatatggcaatgggtcgagtgaaaagaaaaaagtatagcaaattgcatacataaaacctggggtttatgtagaggactctgtgatgcagtttgtctggactgagagcggaggaagataatttggagagagcttctcccattcccccagggcattgttatttaaagaatcttacctcctcccatgtcaccaccaggcgccagctcctcactgcatcttctccccttgaggcattaacttttcttatgtacccttcagccttctctgggctcccgaatctgggctacgtgccagctgacactgtatttttagccgtgttctgaagctacaggaattgggaatcccaccaaatgcaccctggaactgtgaagttggctgctacggagcagggtgcttgtgaaggggacagctgtgtgacaggcagtggctttgagggctgaggatgggattcctttaccaaagaaggagtagttgatggacagcgtttgtcttctcctagtcgccgtatcccctggagtggagcccgatagggagacatccatttctttggacttgaaccggtaacaggaagtgaggtctgaaagcttccaatggcagatgttcctgtggtcccccttccaacgaagtgcctgacacacatttccattaactctgtggaatggagagaattgcctgcccaaactttacataagtgtgaagcaatgagaggtgtagggggaggggagctggggagggggagaacaggaatggggtggtaccaaggatggtctgtgcaggtagagtctgctctcctctacaaggcccagtgagaaatggttaatcatgtcagaccaggtctgttttccaggtcttcttccctcctttgtgtgaccaaatcatcatctatcctttcaggatggggcttctcctcattagtgtgtctgacagtgaggatgtaatgtactttagtgcttgccgtgtgtgtgtgtgtgtgtgtgtgtgtgtgtgtgtgtgtgtgtgtgtgtgtgtgagagagagagagagagagagagagacagagacagagacagagacagagacagagtcagagacagacagagagagacagagagagacagagatagacagagagagaggccctgggttcagtttcttgtactggggtgaaagactggatttgggacaatcacttccttccttccttccttccttccttccttccttccttccttccttccttccttccttcctttctttctttctttctttctttctttctttctttctttctttctttctttctttctttctttaaaatgtggaggtgtggtagtatatgcctgtaatcctgacaggtggcggtgaggccaccttgggctatatagtgagaccctgccttaaaacaaaagacacattctatgcttgtcctgccctccccacatttcgggggtggggaggaggcaggggggacgggggagcaaaacaaaacacattctaaagtgtaagtcgtataattctcgctgttaaaacatctaaatgaccacagaatttaggaaatccaactcctaaccatggcctctgaatacatgtgttctgattagtctctcccatcctctcccgtctctttcccatccctatcaaagtgaagagttcccttactggagcccagtctcatcgtgacaaagttcataaaagtttgaaaacgttcttgcataaatcagaacacaaatccataacaggagacaggttaccttccctggcgtggctgcttctgagtgtcaaccattgtggaaagaattgtcttggtctgtttgagagttcatgatcctactgttgcccagtctggtcttgaacccttggcctcaagaactcttggcacaggctcctgggtagtggcaatgacaggcttacaccactgctcttggatttggaaaggatcctaagaccacctctggacctagcctggggagtgctctccttgactaatggtacccagcagggatgcaggagggtggagtggcatccagcacatttggtgttcgtgggctctgctcagatgatgggaattttagttcatttggaatctattttctagtatcttactgtatactaattaaaaaaacatttcagtaagctatattgcctttcttccttttaaaaccatttttaaaaatcattgctaagtagacgctgttaagatctgactctattttggaggcacctgactgtgccagttgaactaggacttcgatcatgagactcactgctaagagtatgaaacaagagctttagagactgagagacctctgtgacttctgggtcagccacctgctggaagcttcttgtttccttgtatagaaggggtaaggcgtatctcagctatagttttttcacccttttaacatcttgtgaagctttgctgagagaatggtagtactgggcctgcctgctttccagttgctactggattaatgctgctcacaaaccagagggtcattctccaattctctctctctcttctctatttccaccctgtccactccacccaccgtgtgtgtgtgtgtgtgtgtgtgtgtgtgtgtgtgtgtgtgtgtgtgtgtgtgtgtgtgcgcgcgctgccttggtatatatgtgtacatatgtatatgtatgaatgtatttatggaggctcagggtcgatgttaggagactttcttgttttcccacactgagacaggtctctcacaaaaccctggttagctggcctgctcagggattgcttggattgctgggggaggggcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagccctggctgtcctgaaactcactatgtagatcaggctgaccttgaactcacagagatcctcctgcctctgcctcctgagtgctgggattaaaggcgtgcgcccccatgcctggttaagtgtgaaatgcttcagtctttgcttcaattactcattgtcaagctgtagagtctgtttacaactggaacactaaaacagggactctaatgttgtcctttgagaagagaaacatccgcagcccagaggtttgagagccttggcgctgatcaacacctctacagatagaagatccggacaagcccgctgagaagccccgtcctcctcactcaggctcttacccgccctgtcacctcctccgcagcttctgaagtgtttcaattctagccgtttccaaactaaacactagttattgacagtaagtgccattgtgtgaaatggaattgttttttctcccaaacgagctctctcaatgaacatgagctggagaaaatatattgttttgtcagggcaaaagctgatagaagtcttcagattgcaaactacatcaaaaagtaatttctgtctccctccggccttaagggcatgtggccttttgggtactaatgagctcattagcttagttagagcaactaataagctacccgtgcacagagagcacagtggcatagaataattcttccgttttcctctaacaattacaataacattttctaaatccaactcgccccgtactgagacattgtattccaacccccccatctcaatgatagacacaatgaggtgcccaaacagccccacagggagggtctaactacacatagctgaattcagaatgtgctgggcagcatgtgaaactctgctgtcggctacagattttagcttctttcctcgggccgtgttacttacacgtgaccgtaacaatcaatgttaatgccctcaatggtgtttgtcacttggacacacagtctgtgagggatgcttaaagatataggatgataggcacagcccacggaacctagagattgtgttggattatatggttcagtctttagagtctggggtcagtctgcctaggtcacgtgggcccttacaaaccccacattccactgctctccaggtacctataaactcgatttgatcctaagcgtcatagagctgtttctatttattgatggataaaaatgaaaaccaaccttaatattttttttccttttagtgtacacacttgtttctgctcttttttagagctttgtttgtacttagttttatgacactttttgccggggagggagctggaatcgtcggaatggctctcttatccattctcttggggactggcaagacacctgccatgctttacaggcactcttggtcactttctttgcttccttagcttattatttattgatctctaaacagtttttgatgaagccttatattactctgctgtttctggcatcatttcctattactgtgccagcgtttataataaacagtagccaatgtgggcgaccttgtggcacagtcggttttgattagatgctgaaagtcgcctgtacctttcatcagacagattgcctcctggactattttcatgagtaggaagaccatcacagctcaatataagacatgatttctaccaccaatgtggcctttgaaacttccacagcacatccccccaccggggagacctgttttgaagtttattattcaaataaaattgtagacaatgggaaactaagggaaaattcccagctatgctcataattagttgactgtatttctggtgcaggttcaggcgtcgttacttaataatgtaattagtcagagaaacatgagctttaatgatcaaccccatgcatatgccatacaaatttgtgtttttaagtcttcctttcctctgcatataaattgctttaatgtttatttcccttgcgatggtaagggctatggaaggttttaatatagaatttgtatctttattgccattgctgaattgattgttaatagaatgatctcaagctttctggggacatgtgtggcaggggaacatgtttcaggcaagacccagaccagactctcatatcatgatacatcagctctaaagtttcagggggttactgtgttgtgcttttcttggggacatataacaaacaccagtttaccccacctaaagcacccatgacagatcaaagaaatgattccagccaagtccagcttggtgaaccagaagttttgctttgtgttttggaacagagtcaggggtgttacatataaggcatgggtgactcaaaggcagctgcatttcagaaaacctcaccccagcctaggtgacaactcaggaaaaccgagtcttgcctaacttgcagactgctccactaaaaggtctgttgtcacaacaacgtcccatttatgtgagcctgggcagggcctcctgggtcttgcacttttccaagcttcttgtcagcctcccccttccctatgggagggagtgtttccctttcaactgggagatgaccgatgaccgacacacagctccagtgaagaagtctgtatggctaggaggtctgctcctagctccctcttcactctgggaaatgtctcatagacaagcttgggctgagagggttatcttagagtctttgtggtctgatctaaatgtgccttcatgtggcttcatctcaagggttaactactctgtctggtctgtcctattcaggacctagtgtgaactccttcattgttgcctggatttaaagataccaaatttaaatggctctcacaaagtgcagtgcctctgttttttgctagcagtgtggcttttgaatgtattgtaagctctaagaaactccgtgttcatatcggtaaacaccatgctaaaagaaaccatctaccctacatggttttctgtggggataaatgtgatggtgtaaatcaaggaggctgcttatgtgtggtgggatttctgtgaatgctattgttactgaattattgaagcttatggcatatgacatacccttgatcgtactcacacacccctgggctcctcctttcaaatctccccatctttctctgacccattgcctcttctcagatactctcccttctagttttgcatcttttaaacaatatagattgcggtcacctcgtcactcgcatcaagggactgattgaagattgaccccgatgcgctggaaaataaacttcttgcttttgcatatgatatgtatatatgtataatatcatatgtatgtatatatatatatgcacatatgagaggaaacatgaggtactttctgaaaatggctgacactatttaacatcatgatccccagttccagacattcccttgatcctggatggtttaagtgttctttaaagctggataatgctccactgagtctgtgggtctgtttttctctatgtgttagtatcacttacactgactccgtacttgaccgttataaataactcctcagtaaatataaacaagtgtgtatgcctatagcattttaacttaggtttcttatatacccaggagtgggatagcaggatcatatggtgttctgtcttagctttttttgtgaaacctctgcacctatttccctgttggatgcactccattacattcccaacaacagtgactgacactgaatgcttcctgcccctgcatcccagtcagcacttgttgtcatggggcgattttatttgactaaaatattctctagttctgcacatggctgggtcatctctcaggtcctaaaaaagaggtgacatctccatagagttcacgtgactcctgaccctctattggaagctgcttttgtgtgctgtcactgtgtcttttacttagtgctcagcttttaccagagtctggattgttctcatgatgtttagaccacgagagtgggggggggggaacgtttatgactcacagctctgtcagtcatgcagcattagtccttgagaagggttcttctagggttgagggagaaagtacttctggaagactaaggacaggtggagaggaaagtactagacaatttcagagatggggtagctcttgcgtgagctctggggcatcccatagatacttctaggacttcggacgtccgttatccacttgagacatctctacctgcacgatgggagcataatccttactatgaaaggttaccgtgagtagtaattatttaatctttgagccctgttggagttcatgtgatgaatttcattcatattccattgctgcgagcttcagccagaatagcctggacaatacagcaagacactgtaaacacacacaaacacgcacatgtgcactcagaaagagaggtggggggggagggagagagagaaagaaagcaaacaaatcaccccacgagaacaatcaaaacaacaaatacaaaaacaaaaaaacctcacccaaattccagctgaggatatacatcaaaaccagttgggttttataccagttgggtactactgagaagttatctctaggtagagacagaggtggcctttcatcatgctatcacgaaatacctgtcacaactttaaggaagagtggtttctcctgggtcatgttttgggaggtagagaccatcatgccactggagagtctggtttgaggcagtagggtctgggggagtagtttgctatatctgcagaggcaaggaagcagagggcttgagctggaatcaggaccagtctgtgatcctcaaggtttactgcccatgtcactcaggaagactttggacccccaagtttctacaacgttccaaaactgcaccaccaaccagggactaagtcttcaaacacgggagcctgtgggagacatgtcacactgaaatcataatattctgcttctggtctcagtggaccccccatgctgaccctcacagaatgaaaaatacattcagcccaattccaagcgtccagatagttttaacagtttcaacactggtcaaaagtctgaagtcttttctgaactataggcatactctcggctacgaagtcaaaaccccacatatgtatttccaatacactgtggctgagggtaagtcttcccatcccaaagggaggaattggatgatagtgagcaaaggctagaccagagcaagactgaaacccaccagggaaagcaacaacctctgaagctctgtccagtactcgggacagcatcgggcctccaagggccttgagtagctctgcccatacagctctgttgcccgaaacacgtgtgtccttacccttgggccagcacagtcacatttctgacgtgtctgccataaccatcagagcttcatgcacagcccactcaggagccccgtgtagggagtccagctctgccacagattgtctggcctccctgccttttttcctgaaatcttgatgtaagcccccataacctgagaccatttgattctatgtgcctgcagagccagccccaaattccactgtcatcagaggtgcatcctggccttcacttaccacaagtggagtggtactcggggaccctgcctgcctggccccaggaaaacattttctaggcagtcctgtttaagcagcggcaggnnnnnnnnnnnnnnnnnnnncccagcttgggtcttctgcaacctctgaaaacagtgctattggctggagaccaagtcttcaaacatggagcccacgaaggccactgcacaccaaagctctaatagtcaacacgcataacttcatacctcccctgggtgattcctcttgacaaatgcttagaacaatgtgttttatccagatcatgcagtattcctaaatatcttctgacaaggaattatgcaacttgaacatctcagcaatggaagctcacagagctgtgggtaccgtcagccctgagtcttcctctcgagagaccaatccaatgacttcccatacatctggtgattttttttttactattaattataaacttcttgtaatcacaactaaagtcatcatgccttcattgctcttgagtatgtgcaagacagaaaccaactccactctcctccatgttcttattctcttggaatctacattcctctaataattcagctttctattactggtttcctgtcctaacctcaccgctgagatctttgggggtccatattcagggtgcacaaggctgtattttcaacttcagttcttcactgatgtttcaattttcagcctttctctcttattccctctcagacctgctgtagctgaatcctagatgttttgtatatggataactgggaagtcttagaaaacattaactactcatttggttggctgctcatgtgcacacaaataatgagcacactgatgccttgcaatgtttggggccaggaaaggattggtgctgggaaaacacagtgagtaaggggtcttgtatctggtaaacattcataaaaagagaacagagccctgtgaccaaacatgggatctaagaagtaggtagagatgcgatcttatgaagtgacttccttattctggccccccgtaactgcttatgatttgagtctatgttggctgaaagctaaatttcaaccagcatactaatatactgaatattctgatatactatattaaatacagaatcctgggctactgtatttattttagctctctggatagctccaacagcaactggtgagactctgatcttggaagcgtctctttggaaagtaagtctaggtcttacaacaggccaagcatcgagaatgaggcagagaagagctcctttatttagatcccctaactctatatcaaggatgtaagagaaacttcctcctctccaaccttcttcctcttcttttttttttctttcttttatttcagcattgggcattgagcctagggccttgtgcatgctaggcaagcattctaccactgaactacacccctgacccacattttactttctattttgtagcaaggctttactccattttcccttcttgcctcagcttccagggtagctgggcttgacaccttataccaacaggcttggtgaggccacctgttcttaaagccaggcatggttgatggggttgtgggagcataagataccattgtctttattctgaatgctttaactcaataagtgagcctttattttaaaggtgtggatgtcaggaatggcagcttttcctggctttttacagatgaagtagaaaactcaaaatcaaaatgaatgacataaagattctttccttttcatttttaggtacagctgagatcactttagagttattattatatttctttcttgcacccagtgtttttatttgtgtgtgtgtgtgtgtgtgtgtgtgtgtgtgtgtgtgtgtgtgtgtgtgtgtggtgtattgatactgaaatgtatcccgggctgacttttaattaattaattagttaattaattaatttgtgagacagtgtttctcaatgtttctctggctagcatataacccactatgtagaccaggttgtccttgagctcacagagatcctcctgcctctgcctcccaagtgctggaattaacagcatgcactaccaagctgactttgatcctctgattttcctgcttctctacctcctcaatgctaggagtgcaggctcgcaccactatgctgtgcttagtggtgttggggatggggatggaacctcaggcacactgcgagggcaccctaccaactgggctacatccccagtcctcctgttttatgtttctttcttgactagcatcatacctgtgaactgccatgccagtggcagatatagctctcctgtcccttaagccccactgctcaagttttactaaggacctttggaactgtgtttctgttgctaattgttttacattgctcaacctttagaagtgtttaagaatactatattaagtggtccagtttaaatggttatagagacgtatctgtgtaccttgccaatttcattgtccacccatgtttttcccgaaacccatgtgctccgtttctcctttctttctttctttctttctttctttctttctttctttctttctttctttctttctttctttctttctgtctgtctgtctgtctttctctctctctctctctctctctctctctctctctctctctctctctctttctctctctctctttctttctttctttttggtttttcgagacagggtttctctgtatagccttggctggctacaactcactttgtagaccaggctggcctcgaactcagaaattcgcctgcctctgcctcccgagtgctgggattaaaggtgtgcaccaccacgcccggctatgttcttaagctatacctgttctgatttgttttcttgtcaaacaggtttactttataatttttggtaggaaccataagagtctattaacaaacaataaccagtattttttcaagttcctgtgtatttttgaaacacacattatacaatcctttgctcaacatatgtctgtaactaactttggaatcaaagaaagggaaagccatgtaatagagatgtctgtgtattttatatggatgaaacccactatttgactcaataatgtattgtggacatcttttcacactagtatgtggatctttctggtctttttatgactgctcagtaacactgtggcttatgtttctctgtctcctcttgggcctcttgtagtccaggctggcatcaatgtagcctaggctggcatcagtgtttttttttgtttgtttgtttgttttggttttttgccttcacctcctgggtgccgggataagaggtgggcaaccacatttagcacccaattctcttttgataaacatttgagttgtttctgatgtttcaatattagagacagaattgtgtactcatccatatttatttttatgtcttaagtcctttatctgaaataaaattaaaaagtccccaaaaggatgtttggaaagtgggcttagatctaaatggtgaaccccatcatctaagtcaacacaatcagtggaatttcaagaaggagactgagtccaagctcagagacctcgaagccatggttgcagccaggaggcaagagcaggagatgagaacagagaaccatctactcactagacccatgctgtgttggagacagtctcgatctgcagcccaggctggccttgaacttccaactgccctacctcagccccaatgctgggcttacaaggatttattaggccagtattttattaaatgcttttgagtttttatcagaaaaggtacacatgacatttttgaaggttagaagtctctggagatgctgtccttgtgctctgaagcctgctgctttggctggatatatataagtgtgtgtgtgtatgtatgtgtgtatatatacatatacatatgcatatggatacacatatacatatacctatacatatcttaaggttatagaaaagaaacttgaaatcactctaatgcttttgatctatccacttctttgcaagagacctgtcccccttgagagttgaatgtgatgtgaacctgcaaaggtaggcactttctcgctgcgttgttttaagaatgtcaagggttctgtaatattttatttactagccagctaacaacagttgctacaccggcactgtcatccactgaagagttaaggatctgaagatacatagtaacaagttccagagcaccttagcttgtagatgaaccctaagatgtattatttcattcacgaggagctccgtacataagccatcccctaatctggctcttctgtctgtatgcacgtttgaaaacgtcattaaatccaggcacaccggtctcctatgcttctgaacagccttaattttatataattacatttgagggagccagttttctcttttcccagatgaatggcctctgttaacatgacaggtttctttctgagatcctaatgcggggatggaagtcagaactcctcactgttgttttcttgcctctcattgcagagatcagctgtggcagccctcctgaaattcagaacgccatcttggtcgggaatcacagctccagacaggggagtgtggctcattatgactgtcaggagggctttgagagtccaggaggaaagatcacttccgtttgcacagagaaaggcgcctggagtgaaatcacttatgcatgcacaggtacagactcctttctgctggcctcctgttacctgggagcaacaccagaggggtcatggagtaatggctgcctctgggtcagctcacctctcccgtttactcgggtaggcatttggcttcggatctaccagcttcatcttggtgatttagaagatggattgggaaaatataataagaaggaattttacacatccatcttttgaaacaccataattcattgtgtttgtgtgttttgccttctctccttagccagctgagaaaatgtattctatgaaccattttcttgcaggagtatacccttaacacattttgatatgacatctttttcacacaagagatgataaaattcaaggagttaagtcttatctaattgcattataccggtttgttttcattatgcagtccgttggtgttgtgtacatctacaccatggtagaactagtctccagaacatcttatcttctaaaactggaacccatcatttcttcctcccctcagacgttggcaccctgccattgcgctttctatctcccaggaatgagactactgtaggcactccatggatgtaggatcatatgatacttgagatttttttttcaaagcttggcttatttcacttagcataatatttttaaggctcaccaacaatacaggatatgccattttcctcactttttagaagtgaaaaatattctattgtatgtgtgtatacatgcatacatacatatatgcaacactatcttttgtgtgtgtgtgtttctttttgtttttgtttttttttttttcaagacagggtttctctgtgtagccctggctgtcctggaactcactttgtagaccaggctggcctcaaactcagaaatccgcctgcctctgcctcccgagtgctgggattaaaggcgtgcgccaccacacccggctgcaacactatcttttgtctgtatccgctttcacagtactaagactatacaagtaggccaccatgacctatctttttatggaagttctgggtatcgaacttgggacctcacacttgcgtgacaagcacctatggtctgagccatctccccatccccaagagagaatttgatgacatccatcctgcccatctttccgtcccacagatagatattcggtgcgctctgtgtgtgaagcacacatttgaaatttacagtgtggtaggagaaccagatctctcctgaggaagtgcacattcatatgtccttgtaatggtttgtaaataaattcaaagcattagagactgctgaagcctgtggggaaggaaccctgggaggagatagacaatgcttacatttagctatcgccatcatacctgcaaaagatgtaggctgcggagtcaggaggaaacagaaggcaagaatccagagatggaggccaccttgtctccctggccaagcagagaagcaaggacacgccagtaccatcttccactttctctgaggccaagctcacgagactgatggcctctctggccctccaggacttatctgaaggatgtaagacagctttctcccagaaccgtccccccaagaaacagcttgtgtgagagagcttcttacagccgtggtccctttgccatgtgtacgctgctcaaggtcctctgctgccaccattcagaatccagtgggggcacaaggattagtcactacgtgaaaaaccaggggatctgcatggggcacagtaagctattaattagctggtccttgtacagcactttgaagaacaaacatgttatgtaaccgctaattataattactgtcctcagccctccaccttttactaagtctgtggctccagctgcagctgtttccatgggcttatgcaagctttgatttcgggagagaaaaaaggcattctccctgggagctgggctctttctgcgaggaggctcgtgtgccctccgtcaggattggcagctaaattcgattttcacagataaagggagcgatttgcatgctgatgaagtcatgcatctctggagaggtgggctggagaagcttctggaagtggagcaagaggtgctggttgtcatggttcttgcctagctgcccctcctttccctttccccgtttttcaccagtcttacgacatcccgactcccaccccccgtgtgtcttgtatttattttactgtgtctcacggttcacttcttcccctatcatcatctttccttgtagtccctccgtcttcccctctgtctgtatgtctgtgtttaattccaaactggggagaatggattatctgtacacagattgctttgaattattttaaaatacttttgaggctctgtgcctctgagttagtggctcagatctgtcatgtttttaatggagtgcgaactctaacaaggtaggaggtgaggttttttttttttccccctctacggccagtttgaactagaaactccagacagctgggaattaggtaactactttcgtgtctggaaaaacccgaggtggaagcttcacattaatgactcagttttacttcaggatcaaagaggctgatttgttcctgataaggctgtccctgcttccattctgtccaggtcatttgccttttatgttttgagtctgggttaataattacaaggttaacactccacactccatcactccatgttcttaggagagcaacaactccgtcgaaacactgactgttcatctctcaggagcctttctgcatcccggaatctgccctgggtactgctgcaaatgctaccaagctcctgttcccctcggtctcttcttggttatcagcccttctcaccagcctagcaagtgctcacttgcagctaggaaagaagggctggctgggataaatgggcacagtactacattagccacactactgggctgagtctgaatatgtctgtaccatttggacgactgacattattgctgtgtccctgcacaccaccttgcacacccagggttctcttggggcccttatgcttgatctcattccgtcctcaaaacctgtaagacgagtattttcagttcatagctgagtgatctgagactcatggaggttaagcaatttccttagggtcattctgtaaccagtacttgatggagttctgatttgaacccaagcctggaagccctggaatcccacacgtccctcttcatgctcgcccaagcttgaactatttgcataccaccctgatgatctttgacataactaaagaattattttcatagcttgtttcttaaaataacatatatgtgattatatatacacatatatacatatatatttacacattttatacacacaggcatatttaggtagaattttgctacattgctcaagctagtctcaaattcctgttcttaagagagctccctgccctaacccaaacagttaaatctatagacatatatcaccatatctgagaaacaatttaagtttgtagttttaatataccaatcaaggattccttgtaatatgtggtatatcatgactctgatgaagtagatgtatttttcctaatgtacacaaaaattaatacccagtgaacatataaacatttattcatgtgccataaaaatcattataaagtgtgtgacttactttagtagttaggcatgctgctcttacccactttacatagctttaccttaggactttacacaaagaaaggaggcattgggctgtttatagtcaagcacagatctattcagtgatgtgtccccgtgtcttgttgccgtagtcatcaaagtgtgcccactttgcagtctgtttggaaatggcgtcaaagcttggctgtatgctctgtcataagatcatcgggtctcttttggaatcaggaaatgtttagactggagataatattgaacttacccacctgaatttattctttcagtgttttcaaaaaaacaaagaagggccccaaattaaaccaggagagtaaactagactggtccctgaccccgtacagtgggtctcttgagagggctctctggacactctgtgtccttcccttcctttgctgtctcagcctatcatggaagggaggtaggcatcacttcccttcccctatgagtgactgtctaactgctaaacctgtgttctgtcttaaccccactctgctaacccttctgaactttagtgttgctgatcacccattcgttcatttaacccatcagtcagagaagaaaacactttatgagtgtctttgtctgaggcatttgctaagtttagagagataaggacagcttttgctatgacaaagtttcactctgaggagtacacattaaataactaattaaaaatacagtgaattcctcacagagaaatactagatgttaatagaatagcaaaatccatatatatatatatatcatataaacatatgctatatttatacaagtacccatccacccctgcttttactttatgggataaagtaaagctgagtattttattatcccaaacctaatacaagttcaataggaccttgtagggcccttctttgtgtcaaattggagatgcctatatgttccacagctagacagacccaaggcctgctctccctacttctacccaatgtcaaaccccaagtctaagcttgactggacgtccatttcatcaaggaaaaaggatagagggtgggagagggggaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgagcctgacatagttgtcgtggaggaaatggcattagattctattttatgacctccggttcttctgtaccctggtgcttcctttcagatggaaaactgtccccctcattaccctgcagcttgcctctgctcggaggaggggtgtctgtcctccgtctggcaggcaagcccttccccgggtgcagcctgtgcttcctctgcagcctcgctctgtacctagctgacatttctccctcactcctcttccccgcctcgctagccttgatgtccagactcgctgttctctctgccctctactctacagccacttatgccccaaggcagtgcccactatgaaactcagtttcccaggtcctccaggccttccttctttgtgcccttccgtatttgtgtggagcctgcgatgatgctactgagctctcagttgcctgcagcagtgactgctccgtccattaggcaacatgctccttgaaggaagaactggtggtctaatcctcttcacagtccagtgtttgacacaggtggatgcttgccatccagtaacaattctgtaaatcatgggcagtaaatggaagaggacaccagtccgaaaaagactttcgtatggttttttttttcttttttccttgttttcaatttttatggcatttgtttacttggttgtgtgtatgtgtaggtgcatgtatgccactgtgcacgtgtagaggtcagaatccaacttgtgagagtatgtttcctcctcagggttttggggatcaaactcaggtcattgtcttgctggcaagtgcctttatccactgaattatcttgtcagtccctatgcgtttttcaattaatggcatagttagaattagcgtacattttgccaagtgttgtatattcaaagggcagcattaatgcaggcatttgacacctgggatttttgtaaaaaaaacaaaaaaaaagtcttttcaatctgtttgtagaacttgatgggggaagacatcagcttgggtaggcttctctttgggatggaatatctggcatcgctataatcagatctgggtcccatctgtgcagaacatggcacaggctacaggcagatggcatctttgagatgtcatttacagttgtcatagtgaacgagcagaaaggaagaacaagaaaggaaacccttttctaatctccacttggatgacacaggcaccccgaataggaaggctgtttgctttattggcaattgagggagaagatgaagcgggaaatacctctgctccctctgcaccagctgctgagttaccgtcagaaggctgtttgagggagcagggatgttaaaagtcctggactttaatgggcagccacagatgtggccagttatacttgaagtttatccagtgatggactgactggaatcagcatcacccttgctaaccaaggagacgaaagaacaaggccattactttgtttgtttatttgtttgtttgcctggggtttgtttgtttttggtttttcctgctgacaactgtattctttttttttaaaccacattattatgttctgaagaggaatattgatgtagaaacctatgaatttttttaggcttcatagctgatactctgatgtctctgtagaaatttgtgttttcttctcagcctcaatttattttccgttactaatatatgacttggatttactcaaaaaaacaagtgtggtgcgatgcagacatgtgaccatttcagtagtccaggtgaatccaaagttgaccttggttctgtacaagagaattatgttaacctacgggtgtttccaggttccttgttcctcatggtggctaaatctgttcttagccaataaaaggagtatcaatggtgtatcatttcctgaggtaaagaattattgaattatcattctcatttctccaccctccccctgtgtgtgtgtgtgtgtgtgtgtgtgtgtgtgtgtatgtgtgtgtgtgtgtgtgtaagccagagaggtcaactttgggtattgttccacggtagccatctgttttgttttttaactttaaaaagttttattatttttaatgatgtgtctgtgtgcagtgactagaggtgcctgtgtcaaatcccttggagctgatcttataggtggttgtgaactgtttgatgtgggtgtgggtgctgggaaccaaacttgggcttttgaaatgagatctctcactactctgatctcacctactagatgggacagggatctatccatcagtctccactttcctagtgtaagcatataatgctaagcccagttctgggcctcgctccagcatcccggagtagattccagtggtatctagtggcccatcaagctgattacagtaaataaataagtgaacaggaaacaaatgaacatcgggtctgaggctcagacacaactccttgtgcctgtgtggtaagtctcttctcacttatcttgatggcggtcttgagttagtttttccccaaacagaaccagaagtgcgtattattacattaatggggagtaaagactcaggaagcaggattggggaccaacagaactaactaagggaaagaaagaaacagtatgaggatgctacaacatcctggactctctgagggggcggggggcggggcgctgcagcatccgggtctccctgggtagagggcgctgcagcatcctggtctccctgggcagggcggtgcggcagcatctggatctcctctgggtacgggacactgctccactgcggatacaactttcggaaaggctgtggaaactcagtcacttatgacagtgcctccagggacaaaaagggcaatagctggttcactagtgccgatccccaggggatttaactcctctccccttccaggctgcatgtgctggagtgcgtgagccacagaaaggaaaccccagagcaggaggcaagaaacagtcacgttgccaaggtgtatgcagggctggcatacattagacttaagaacctgggaagtgtctggctccgcaggaaagctcaaacagggtcatggaatattctttttggatggaatggcaattcttgtctccaggaatgatagagcaatgcctaacttaaaatgggtatttgttgttatttttcccctcctttttgatcttattgtaaaagaaagttgttttattatcctttaatcatctgttcctagtgtacagaaacgcatatttaccttatgtcctgcatcattcccggactcctttcctggccttcataggtttatgggtttgtttgtttgttttttagggtttgaattctttaggtgtctgcatctaagatcatgccatttgcaaatagaaataactttagttatctgtcagagatttgattttaagaagtgaaaaggtaggttcccccatgccatgctgaacaacttttaagtagttggatagcagcgccccttggaaactgtgctacttaagggagtcgagtgttttcccacactgccagagtcatcactgaagtgcaaggttttttagaaccagcacaagtgggagaaatctggcttctcaccagatcaggatcccatggcttctgctagaggagaccgtgggtgaccaggaactctgtggagaacttacttctttgccccaagcttcacctgagggaccgtccttcatggtaacacatgccacttcccccttgggattctgcagtcacctgagtgaatgcctaccacccaggctgagaggagcgaggagcagtagctctctcctgtatgccttaaggaagcttccattcggagctcatttctgggcctcgctgcagcctctgagtggaacagcagtggcatccagtggcccatcaggctaatcacagttggagcccttccccacccgcaggcaggaatcttttcccttttttgcctggtcaggcaatgggccaggctcattcatgatgaaccatctgggattgcttgaattgctcaattcagcatccgaaccagcgcgtgactggtgagcagccgagataccagctggacagaggccctgagtccaccaggagctccccaaagcccatggttgaggttcatgtgtcaattcttttatttatttatttttctattctagaaataatgatagaaattcatgatgtgttggtgtttaatgacacctgtgtgagatggcaaataagtccagagagagtgaacgccaggatcgtgtacttggtaagcaaagggaggtgctttaccttgcaaatgcagaaatggaaatatgagccaaaagaacttgcctataggcgcttcacttcccctcccccattttccctcctccttccccaccacccaccatctccttcctttccttctgctggctcctcttccttccttcagtcacacaaagtgaaaccatatttgtttgcaaatgtatagtaacaagctacagatagtgtaactcatgaaacagcacacagttaattacttggtataagctggtgtagactcttgcttgaatatgcaagtctccgttccttggcacatcttcttaaacagagattcttgaaaacacacatcaacgtttcagttagagccaacacaaaggccaagacaaggttagaagatgctttcaacctccattcatttagaaaagaattgttttctctagcaggccgtgaacactgttatcacgcaggtgaccatggtggaaggcaaaccaatgatgcttctataactaggaaaacaccaactaaaccacactgtttagtgctgctatcttccagctatacggtttcaatgagaaatatgaaggttcttagtcagtctaattgttttctggttctattgccctgttttaaaaaa

SEQ ID NO: 914 - DNA, 630 bp, Mus musculus
atgtagatgtctgtgccacatgccatgaacatgccacatgccagcaaaaggaagggaagagaatctgcatttgcaactatgggttttggggcaacgggaggacacggtgtgttgacaaagatgagtgccagtttggagccactgtgatctgtgggaaccacacatcctgccacaacacgcctggagggttctactgcatttgccacgagggctaccgggccacaaataacaacgagacgttcatccccaatgacggcactttctgtgcagaaatagactgtggcatccctcctgaagttcctgagggctacgtcgtgggaagctacagctccacactgggcggccaggcccattatagctgcaaggaagggtttctcagcgtctcaggagacagaatttcacgatgcacagccctgggtgtgtgggaacctcccaagttacattgccaagagatcagctgtggcagccctcctgaaattcagaacgccatcttggtcgggaatcacagctccagacaggggagtgtggctcattatgactgtcaggagggctttgagagtccaggaggaaagatcacttccgtttgcacagagaaaggcgcctggagtgaaatcacttatgcatgcacag

SEQ ID NO: 915 - protein, 210 aa, Mus musculus
  VARIANT (1)...(210): Xaa = Any Amino Acid
VDVCATCHEHATCQQKEGKRICICNYGFWGNGRTRCVDKDECQFGATVICGNHTSCHNTPGGFYCICHEGYRATNNNETFIPNDGTFCAEIDCGIPPEVPEGYVVGSYSSTLGGQAHYSCKEGFLSVSGDRISRCTALGVWEPPKLHCQEISCGSPPEIQNAILVGNHSSRQGSVAHYDCQEGFESPGGKITSVCTEKGAWSEITYACTX

SEQ ID NO: 916 - DNA, 104062 bp, Homo sapiens
  misc_feature (1)...(104062): n = A,T,C or G
agttttttttttttttacctttattttatttttagagacaagggctttctgtttcccaggctggagtacagtggcatgatcatagctcactgcaaccttgctgccacacccagctaagctagtgtttttctttcttcttctcttccttctctctctctcccttctctctctttctttctttctctctttctttctttctctctcctttccttcttttccttccttccatccttcctccttctcttccttcttcttcctcctcctcttctttcttttctccttctccctctctccttctccttcttcctcttcctcttattcttcttcctcttcttcttcattctcttcttccttttcttcttccccttcttcatttttagtagatacagggtctcactacattgcccggggtggtcttgagctcctgggctcaagtgatcctcctgcctcagcttcctaaagtgctgggattataggtatgagccaccgcacctggccaccactgcactccagtctgggcgacagaacaagatcccatctcttaaaaataaaaaaaagaaactaaaaacaaacaaacaaaaaaaccaaaaaaaaatccccactgagtcttgtcttcaaaaagtcacctttcactttgcagacacaagcttttacagtcacccaccattgcccattctgcaggctggagtgaagccttctttgactcttgttttttaggtttctacccatgagaagtttggctaccctgcagtctgaggctccagggggaatttctcctaatgcttctcaccctcccgttcctcacccgcacttgctagcagtgagatagaaatgaagttgagaagaatggataaatttttctgttcacttcccaaaggaattcctcctcccatgggtgctagcttgccctttgacttttttttttttttgatggcgtctccctcggtcacccagactgaagtgcggtggtgcgatcttggcttactgcaacctctgcctcctgggttcaagtgattctcctgcctcagcctcccgagtagctaggattacaggcgggcaccaccacgcccggctaatttttgtatttttagtagagacgaggtttcaccatgttggccaggctggtcttgaactcccgacctcaggtgatctgcctgcctcagactcccaaagtgctgggattacagacgtgagccaccgcacctggccctgccctttgatttttgaacaaagaaactcctcttaatgggcagaaagggctttattaatttatgtggtactactcccaggcactaggcactgtgcatcccgatgcttggcctgctgagactttgccttacatagattgcaggcaaggttatacatgtgccagaggtgctataacatggtattaagcctagggtcttgagaattctagacgcctctgcaaaccgaaatgtcccttccagtgaggtccacagaggaggcctgtctcaaaaacaacagcaaaggacaggaatattccattttatggacagctggacttgtttctaaaaccactggatagtgttctgtaacctaggacggacacttggcctaactatggcttgagagtctgctctgtctctctaagctcttatgcagatctccccaaagatagttttttttgtttgtttgattttctttcagacagggtctcactctgttgtccaggctggagtgtagtggtgtgaccatggctcactgcagcctcgacctcccaggctcaagtgatcttcctgcctcagctcctgagtatctgggactacaggcacacaccaccacgtgcagctaatttttctctctctttttttttttttttttgtgtgtgtgtgtggaggtggggttttgccatgtggcccaggctggtcttgaactactgggctcaagtgatctgcctgccttggcctcccaaagtgctgggattacaggtgtgagctactgcacctggccccactgatagttttaatatggtgaatcatgttccaaagccaattacattttacaaaggtaatacagtcatgtgccatataacgatgttttggttaatgatagaccgaatatacaacagtgggcccataagattatataatggagctgaaaaattcctatcacctagagatgtcgtagctgtcataatgttataacacaatgcattatgtgtttgtagtgatgctggtataagcaaacctactgtgctgccagttgtataaaagtatagcacatacaataatgtatagtacataggccaggcatggtgggtcatgcctgtaatcccagcacttttggaagccaaggcaggaggatcacctgaagccaggagttcaagaccagcctgtccaacatggtgaaaccccatctctactaaaaatacaaaaattagccaggcatggtggcaggcgcctgtaatctcagctactcaggaggctgagacaggagaattgcttgaacccaggaggcagaggttgcagtgagccgagatcgcgccattgcactccagcctgggtgacaagagcaaaactccgtctcaaaaaaaaaaaaaaaaaagtatagtatgtaatacttgaaaatgacaataaatgattatattactggattatgtatttgctatatgttttatcattattttagaatgtactccttctacttattaaaaaaaacttaactactaaacagcctcaggcaggtctttcaggatgtattgcagaagaaagcattgttatcataggagatgacagctccatgtatgctcttgcccttgacaaccttccagtgggacaagatgtggaagcggaagacagtgataacatgatcctgaccatgtgtaggcctaagctattgcctaagctattgtgtgtgtgtgtgtttgtgtcttagaatttttttttttttttagccagggtctcactttgtcacctgtgttggagtgcagtggtgtgatctcggcccactacagcctcagcctcctgggctcaagtgatccttccacctcggcctcccaagtagctgagactacagaggcaaaccaccacatcaggctaattttgtttattttttgcagagacaaggtctcattatgttgcccaggctcttcttgaactcctgggctcaagtgatcctcttgccttggcctcccaaagtgctgagattacagatgcaaatcactgtgcctggcctgtgtctgagtttttaataagaaagtttaaaaagtaaaaacattttttttccaattaaaaaattagccaggtgtggtggcaggtacctgtggtcctagctattcaagaagtcgaggcaggaggatcccttgagccgaggaggttgaggctgcagtgagctatggtcacaccactgcactccagccttggttatgatgcaagaccctgtttacaaaaaaaaaaaaaaaaaaaagattaaaaaaaataatagaagaaaaaagctaataaaaggctggatgtggtggcttatgcctgcaatctaatcccagcactttgggacgtggaggcacaaggaatccttgaggccaggagttcgagatgagtctgagcaacatattgagacccctccatctgtacaaaaaaaaaaaaaaaaaattatccaggcacagtagcagtcacctgtggtcctagctactcagggaggttggggtgggagaatcacttgagcttaggaggttgaggttgcagtgagctatgatcacaccactgcactccagtcagggtgacagagcaagaccctgtctccagaaaaaaaacaaaaaacaaaaaaaaccatatagaatttcatataaagaaacaaaaaaaaattcttcgtacagctgtagaatgtgtttgtattttaagttaagcattattacaaaagagtcaataagttaaaaaaattgaaaagtttaagtaaaaaagctacagtaagctaaagttaatttattattgaagaaagatcccttttttttttttttttgagacagagtctcactctgtcaccctggctggagtgcaatggcgcgatctcggctcactgcaacctccgcctcctgggttcaaatgattctcctgcctcagcctcccaagtagctgggattacaggcgtgcaccaccacaactggctaatttttgtatttttttttttgagatggagttttgctcttgttgcccaggctggagtgcaatggcgcgatcttggctcactgcaacctctgcctcccaggttcaagcaattctcctgcctcagcctcctgagtaactgagattacaggcatgtaccactgtgcccggctaattttgtatttttagtagagacggggtttctccatgttgaggctggtcttgaactcctgacctcaggtgatccgcccacctcagcctcccaaagtgctgggattacaggcatgagccaccgcacccggcctaatttttgtatttttagtagagacggggtttcaccttgttggccaggatggtcttgaactcctgacctcaggtgatctgcctgccttggcctcccaaagtgctgggattacagacgtgagccactgtgcccggccaagaaagatacttttttttttttgagatggaatttcactcttgttgcccagctggagtgcaatggcatgatctctgcttgctacaacctccacttcccgggttcaagcaattctcctgcctcagcctcctgagtagttggaattacaggtgcccgccattatgcccagctaatttttgtatttttagtagagatggggtttcaccatgttggccaggctggtctcgaactcctgacctcaggcgatcctcctgcctcagcctcccaaagttctgggattacaggtgtgaaccaacgtgcctggccaagaaagatacttttataaatttagtgtagcctatgtgtacagtgtttagaaagtttacagtaaggctggatgtggtggctcacacctgtaatccctttgggagctctttgggaggctaaggtgggaggatcccttaaggccaggagtttgagaccagcctgggcaacatagtgagagctgatctctacaattagaaactagaaattaactgggcacgatggcttgtgcctgtagtgctagctgctcctagccccaggaggctgaggcaagaggattgcttgagcccaggagttcaaggctgcagtgagctatgatcgtgccagtgcaatttagcctgggtgacagagggagaccctgtctctatataaaaataaaagtctacagtcatgtatcataacgttctaggccttcctattcactcactcactgacttacctagagcagcttccagtcctgcaagttccatttcatggtaagtgctctctagagatgtatcagttttttacattttatactgtatttttactgtaccacttctatgtttagatatatttagatacactaatacttcccactgtgttacagttgcctacggtattcagtacagtaacatgctatacaggtttctagcctaggagcactacactctaccatataacctaagtgtgtagttggctatgccatttaggtttgtgtaaatacaccctatgatgttcccacaatcatgaacttgcctaatgacacaatcctcagtatgtgtccccatcattaagtgacatatgactgtaaaataaaaataataataaaaaacccacccagatcttctggagggtacttttggttgaataagaattgagtgcaattgtgagaggccattaaacggatatgaggggcccactggtgaaataaaacacgaagtaacaaacaagctacaaattcataagttgatgatttttctcccaaaaaaagctaactgggtagatcagctctaaaaggatgcataaacaatttggtcacaggagtttcctcttaaattagagggttaggcagagtcagcaaactatggcccatgggccaagttcgacctgctgcctgtttctgtaggtggagttttactggtacgtagcattgcttggtagtttacctgttgtctacagctgctttcgtgcccatgagcacaggtgagttgttgcaacagatactgtgagaaaaagtttgctgacccctgagctagagggcagagatgagagggagatttacgttcattttgcatctttcactttcatattattcaatgaaaaacactctgggcaagcttctggggactcatcgagcatccatgttccaggcctctgcactgagggactaacattattcaccacaggtcattgaccattagcatgagctattcctgcttctgcattagccctgctccggatgaggctgcagcactaattccattgtgtttcttggtagttcagaaggaagaaattttccagttaatcactggctgtaaagtcaccctaccctggctttcatggaaaaccatgagaatggctgaactggaaaaggggaattctgctggtttgtttccgtgggcctctgaaaagatctttttaagcttggaaaagttcaaagagaaccctcttctcccaatcttcaaatcagacggattgccagattgaggtgttgtgtttctcttggggtttcatacactcctggcacataactacgaggggcccaggtcctgtagtctggggagcatcgtgaaaggagaagaggctggagaaatagatcactaaggtgtggtcacagaacgttggttcccgagtccatagcatgggaggacagtctgggctgttgaagtcggtgtggattgatagctcttccggtgccttgtctgtgtgtcaacagataaaaatgagtgccagtttggagccactcttgtctgtgggaaccacacatcttgccacaacacccccgggggcttctattgcatttgcctggaaggatatcgagccacaaacaacaacaagacattcattcccaacgatggcaccttttgtacaggtactcaagaagggggctgcggtgttgacaattggcgatggcaggatagtatctgggctgtgtatttgttaatattagggaattaatgttagttttgttagatggcataatggtattgtggtatataggataatattcttattttgggagatgcatgctgaggtatctaggggtgttatgatgatgtatctataatagtgttcctttagtctgtaagctactttaaatggcaaaatgtaaacaacgattgaatcttggggggatgtgggtctatgggagttcattgtaatattctttttctttcattgtaatgttttgtttgaacttttttttttttaaggggggggtctcactctgttgcccaggctggagtgcagtggcacaatctcgactctctgtaacctccgcctcctgggttcaagcgattctcctgcctcagcttcctaagtagctgggattacaggcacgcaccaccatgctcagctaatttttgtatttttggtagagatgcggttttgccccattggccaggctggtctcaaactcctggcctcaagtgatctgcccgcctcggcctcccaaagtgctgggattagtcatgagccactgcacctggcctgatcgttttcataatgaatagtgaggagggactctctggagatggtgtgcctcctgcaggttcctgtaaccacaggtcgggggtccttggggtgagtggcactcctcagctcagagcacactaatctgggggctggcacccggctgttggctcacaggaggtcagagttgtccctgttaagagatgtgggcttgcctcccacatgtgtgcgctgagtgaggagtgcgagttttgggagcatgggagctttgtaggctgggtctctgagcataggctggtcgaatacagggtggggacaaaccctcctaatttttagcggctcctctgttatctgaactctataaacagcatacgctatttaatgttgctctctggctttctaggaaaatctttgaacaataatgaagaggaaaggcagaaaaagcctcctggttctaagatgcttttgcatagacttaatgactctgctggaaagcttcgtgatatttaaaggttttcaggaaaaataaaatgaaaggagaacatattttatcttcttagctaccaggaaccgtaggttcttatgctcggattcatcctccctcttgacctgtaccaaggcagaatctctcaaaggatacatttgatttattcttggcacgaatgaacacattccttcagagaaaacattttataatatcctgttgttctaggtagcaaattactggctgcatggttgcagaagtacaatgttacagtattaaattttgtatattaagaagaaaagacactaaaaaaaaagcatataagatgatgatctagtgttttgtttattcaatacacatttctcatgtactttttcttttcttttctttttgagacggagtctcgctctgttgcccaggctggagtgcagtggcatgatctcggctcactgcaggctctgcctcacgggttcaagcgattctcctgcttcagcctcctgagtagctgggactacaggtgcgcactgccacgactggctaatttttgtacttttaggagagacggggtttcaccatgttggccaggatggtcttgatctcttgacattgtgatctgcctgccttggcctcccaaagtgctaggattacaggcgtgagccactgtgacccaggctggagtgcagtggcacaatcacggctcactgcaacctctgcctcctgcgttcaagcgattcccctgtgcttctcctgtctcagcctcctgagtagctgggattacaggcacccgccaccatgcccagctaatttttgtattttagtagagacagggtttcaccatgttggccaggcttgtctcgaagtcctgacctcggctgattcacctgcctcggcctcccaaagtgctgggattacagacgtgagccaccacgcctggcctttcatgcacttcttatatgacaagactgtgctagtggaagggtgacgagcagacagctaatttcagtataaagtgttagtcataggtaagcaaacagcatttactggaatctaggggtcacttatcttggctgtgaggaaggaatcaggggaatcttctggagaatatgatccctgaaattgtgttttctaggctgtgggagtttgccagggaaaacttacaactgtatatttatcagtatgtttatagttccaagagatgaattcagcttttgaaagttatgaagaaggctgggcatggtgactcacgcctgtatccccaggactttgggaggccaaggctggaggatcacttcagaccaggagttcaagaccagcttgggcaacataatgagacttcatctttacaaaaaataagaaaattagctggatgtggtggcttgtgcctgttgtcctagctacttggaaggctgaggtgggaggatcgctggagcccaggactttgaggctgcagtgagccaaggttgtgccattgcactccagcctgggtgacagagcgagactttgtcttaattttttttttttttaagttaggaagaagaatgaggaggaggaagagtgagaagattggtgggaacaggaggagggaagaagaggggaagaggaaagagaaaaaaatattttatgtaagggccaaataggtgtcagccgaactagacctaatctgcctggaactaaatccagatctaggctctacttttatttattccattcttgcaatgattgaatgaccttctcttttgtaaaaaattgagctatagtttacataccatcaaattcacccttttgatgtatacaactcagtggtttttagtatattcacaaagttgtgctagcatcaccactgtctcattttggagcattttcatgcccccaccatgaagaccatgtccactggcagccattcccatgacctttccttgtgagttctccagttatcactttgtaaaagctgatgaattgcttttcttgataatactgtttctttcagaatcacagttgccagagaaacatcagcgggctttagctggggcagagcttagcaagtgttggggtatcagcagttagtcactgtttgcctggaaccacaggatgtgaatcctagttcctggattccaaggaatcctgcatccaggtgtttattgtgctttgcagagtcaacatcaagctcaggagctggttgcaggtaggcctctgaatgtcaccaatgttagaggaggaatgaattgctggggttctagtgtgagatgattccagccagtcatggagaacaggcagatgttctggcccttagaactgccccctgaatgactcctgggaatcatggaaaccaccatgagccacaacccaggagaagaagctctgtggcacttcttgtgtgagggtggtttgacttggatgggctccttcagcaattgaatagaattactggttcccaaacaataattggtgtgagtggagaggcgttcattgatccaagacccaaaaggaaaaagaataaagaatataaaagttcaaaaggattctgaggcaattttcttttatcttttgggggctaaaatgtcatttaagaaaaagaaattatagccaggtgcattggctcatgcctgtaatcccagcactttgggagccaactgggtggacaatttgaggtcgggagttcgagaccagcctggccaacatggtgaaaccctgtctctacaaaaagacacacaaaaattagccggcgtggtggtacacacctgtagtcccagctactcaggaggctgaggcaggagaatcagttgaagtcaggaggcagcggttgcaataagccaagatcacaccattgcactccagcctgggcaacagagtgagactctgtctcaaaaaaaaaaaaaaaaaaaggaaattatggtattactagctttttgaaattttttttttaaaaaacagactttcttcaatcatgctgcttcctgtcttctgctcaatccctgatgtttttatgccaatgtcctaggaatttcagttagggtgcttttttgttttctccaagtggaattgaactatgtggctctgatgaaaatagtattattattatttttagagatgagggtcttgctgtgttgcccaggccggccttgaactcccggacttaaagcaatcctcctgcctcagcctcttgagcaactgggaccataggcatgcccaggcatgcccagctgatggaattcttaaagttttaaagtcagttctgagggaaaaaactactaactggaagagagatttcttctccagcctctggcttattgggcagtttttaccctatacttgctgcctctgatagtcttcagtcaggtgcaaaaaatctgcaaaagggcatgtcctgtccttccagaaggctgttttaaggctgtctcattttcataaaattagtaagacctttcctaattaagttaccaccttattacctgccacaccatcctatactcatgggctggcattttcactctcctggagattgttttccttatttaaaacattaaaaatgttgtttatattttaagttaattttaagacaggttctcacttcgttcccaggctggtctcaaactcctggactcaagcagtcctcccaaagtgccaggattacagacatgagccaccgtgccaggcctgtaaattgttttctatctgaagccctactttagatgttttagtatgaggttgggaccattcttttgttataatgattgggtatatttatagtgattggatatatttatagtgattggatatatttatagtgattggatatatttatagtgactggatatattttagtgactggatatatttatagtgactggattcttttagtgattggatatatttatagtgattggattttttagtgattggattttctttttttttttctttgagacggggtcttgctctgtcacccaggctgagtgcagtggcgtgatctcggctcactgcaagctccgcctcctaggttcaagtgattctcctgcctcagcctcctgaatagctgggactacaggcatgtaccaccatggctggctaatttttgtatttttactagagatgaggtttcactatgttggccaggctggtctcgaactcctgacctcaagtgatccacatgcttcggcttcccaaagtgctgggattacaggtgtgagccaccatgcccggtcaggatattttttagtgattggatatatttatgtttttggttcattttgttgggtgtcagggagccggtgatggttatcagcttttgtaaaatcccagaacacactgacaaacatttattgagcacttgctatgttttcagtgcctatgatatgaacgatatatgagaagaacccataaggcataaaataaaatgtatgatacaattgcaaacaaatgcatctttttacaagagtagcttgaaaatgtgaaaaaatggctgtcacaatatcctctccttttttttttcttttttctgtttttatctccttttctctatttggattgggtcccaagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacaggtgggtttctgccaaaaattgcggcatctcaacgtgaaattctgttgatggtgactttcttctgctccaagcctgtgttggggaggcaggtggaggtgatctgatcctttgcacattttgtacaacctatgacataaagcaaataacaacaatcaagttacagggggccatgttaaaaaagctaaaattaggccaggagcagtagctctgtaatctcagcactttgggaggccgaggctggtggatcacttgaggtcaggagttcgagaccagcctggccaacacggtgaaaccctatctctactaaaaataaaaaaaaatagccaggtgtggtggtgggcacctgtaatcccagctactcaggaggctgaggcatgagaatttcttgaacccaggagacagaggttgcaatgagccgagatcatgccattgcactccagcctggacaacagagtgagatctctgtcttaaaaaaaaaaaaaaaaaaaaaaaaaaaaaagctaaaattcataaacttaaaggatttttattagcagttaatagatattccgatattaactactatgttagatagtaaatgccaatgatttggtaaggtccctgcatctcaaaagtgaccctgaaaataatcaaggtacatatatcttaaggtattttgcaattcagattttttatttcactggacaaggcttctctttagttagtgtaaattagtgagggttgattgctaagttatttcagctttgtgcatgtatagatgctttacctatggaaggccaaaagattgaataaagacaattgttggaaatgttcccagaagtcatgtgggaatgaaccagtgtacttaaaatatggctcgggggtgtgtgtgtgtgaggaatagggtagaggtggagagagattgtgaattttgaagatttacattcacgaggtaatgaatttgacattaatttattttcagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaaggtgagttttcaaaaaatacaggttcccaattcataccaccttgaaactgttttcatatttttctctaaatttcagtttcagggaataaatgagttaagtaaacctttaaaattcctatttgtttctcatagattttcaggtgattttcttgatttttcaggaatagtatcatatcatctgcaaatcataattccattcataaatttttctttctttataatagttatgtttttctcttgattgatcactttgtatttttagaacaaagacttaaatggtagtgttgcctttgaatattatttttttattcctgactattagggaaatggtttgggtgtttcttcattcctgatgttagttttttgatgttaggtgtatatatatatatatattcccagaagtcatgtgggaatgaacatatatatatacatatatatacacacacatatatgtatatatatacatatatatataaaaacgtcatgtgggaataacatatattatatataatatacaatatatacaatatatgtaatatattacatgtaatgtattatatattatatattacatgtaatatatattatatataatacattacatgtaatatattatatattttttatatatatatatagtttttgagacagaatctcgctttgtcacccagtctgcagtgtagtggcacaaccttggctcactgcaacctctgcctcctgggttcaagcgattctcatgactcatccactcgagtagctgggattacaggcacccaccactacacccggctaatttttgtgtttttagtaaagatggggtttcaccgtgttggccaggctagtcttgaactcctgaccttaagttatctgcccgtgttggcctcccacagtgctgggattacaggtgtgagccactgcgcctggctgatatttggcatatctaatcatgtctactcatatggcactgtgtgccaagtattattttaagcactttatatatgatgatggaccacattgtagtggtcccataagatcataatgagactgaaaaattcctattgcctagtgacatcgtagccatcataatgttgtagtgcatcacactcacgtgtttgtggcattgctggtgtaaacaaacttactgctctgccagcaagtacattactgtatgtatattactgtatgtacattactatacataaaagtgtacagtaatgtcctaggccttcacattcactcactattcactcactgactcacccagaccaacttccagtcctgcaagctccattcatggtaagtgccctattacaggtgtatcatttttttatcttttattctgtatttttactgtatcatttctatatttagatatataagtacttcttattgtgttatagttgcctacagtaatcagtatagtaacatgctgtgtgaatttgtagcctaggagcaataggtataccatacagcctaagtgagtagcaggctctactatctaggtttgtgtaagtacactctgtgacttcacacaatgaaggaattgcctaatgatgcatttctcaaaatgtatgcagattgttaaatgatgcatgactgtaatttgtttaaggtcacacaactagagacagagctgaacttgaacccaggaattctagtttcagaattgttttcagccactttgttttgctgcttctgcttttatggtgacactggcttttggttagttttttaaaaattttggctttctgtttctttttccttttcctttttcctttcttttcttttcttttttctttttttttttgagacagagtcttgctctgccacccagactcgagtgcactggtgctcctgggctcaagccatcctcccacctcagcctcctgagtaactggactacaggcacgaactaccatgcctggacaatttttgtattttttttttttttggagacggagtctcgctctgtcgcccaggccggactgcggactgcagtggcgcaatctcggctcacggcaagctccgcttcccgggttcacgccattctcctgcctcagcctccccagtagctgggactacaggcgcccgccaccgcgcccggctaattttttgtatttttggtagagacggggtttcaccttgttagccaggatggtctcgatctcctgacctcatgatccacccgcctcggcctcccaaagtgctgggattacaggcgtgagccaccgcgcccggccccaatttttgtattttttatagagatggggtttcgccatgttgcccaggctggtcttgaactcctgacctcagnnnnnnnnnnnnnnnnnnnnctcagctgggcctgctctccttccaaagttggactcctctctctcagttactctcgtgccctttctctggtaaaaaattaaaaatacacagagtaaacagagtacaaattattggtttatttttaaactttacaggttccctcggagacataatcatttcccgtaagcatgtcagctcaagcttgcttttcctggctctctgctgccaccaccattcccacaatccaagctccttggaacctcacacttccccattttcagtgccatcgggggctgccctctgggacagtcattatttcagttccatttctcagtctttctgtctgcctcctactcctccatcaattcgtggtgctgacatttcaaatagttttgtacatgtccaaatacagggaggccccctcgttagtaaattttattttaatgttttttgttgtttggttggtttggttgagacggagtctcgctctgtcgcccaggctggagtacagtggcgcaatctcggctcacggcaagctccgcttcccgggttcacgccattctcctgcctcagcctccccagtagctgggactacaggcgcccgccaccgcgcccggctaattttttgtatttttggtagagacggggtttcaccttgttagccaggatggtctcgatctcctgacctcatgatccacccgcctcggcctcccaaagtgctgggattacaggcgtgagccaccgcgcccggccccaatttttgtattttttatagagatggggtttcgccatgttgcccaggctggtcttgaactcctgggttcaagtgatctgcctgtctctgcctcccacagtgctgggattccaggcatgagccaccacacttgacctggttttctgtttctctgtctacaaatattatcattttatgtgcctgtttccatctgaaaagtgaaaaaaaatttttttaattaccatttttctagtttttggctatatgtccataatctaaaggaaacatcaatctattcccactgtttaggaatttcttttttttttaattggaaataagttatttttatcatgtcttttaggcaggtgattatatattttttttcttcttttaaataacgatgtggccagatgcagtggctcatgtctgtaattccagcactctgggaggcccaggcaggcagatagcttgagcccaggagttcaagaccagcctgggagtggtggtgcatgcctatagtcccagctacttgggaggctgaggtgggaggaccacttgagcctgtgaggttgaggctgcagtgagccatgatcacaccctgccctccagcctgggtgacagagcaagatcctatctcataaagaaaaaataataataataatgtgtgggttatattgttagatttcctgataatgatcagtactaattgctggaatgaattaatctgggtttttggtgttttattcctttcatttggattatatttgctaaattttacttataaatcttgcattgatattcataagtgaaattgctctattttcttttcctgtgccatctttgttcagttcggtattaatgttattctgaattttaaaaaaaagaatgtaaaaatttccttctttctctatttctggaatactacaaatagaatttttaaagatttgggagatttcacctataaaaccatctggatgtggcactattggagaggtagcccttggactatttggactacttttaaattcttcctatacttgctggtatatctaatcatgtccattctttttctttccctcttaagatcaattttggtaaattatgtatttctagaaaatcatttacttcatccagattttccaatttatttgtgcatgcaaagaagtgtaaagccttctaatttgctgtggttatatttgtttataactatttattgtagtgaaatattagaaacaatctcaaatgtctaacaacaagagattggttaagtgaatcaatcccttaaaatggaatattatgtatccaataaaattatgttagaaaaacaatatttaaaaaagaatatttattgcaggccaggcacagtggctcacacctgtaatctcagcactttgggaggccaaggcaggctgatcacgaggtcaggagttcgagaccagcctagccagcatggtgaaaccctatctctactaaaaatacaacaaattacctgggcgtggtggcgtgcacctgtaatcccagctactcaggagtctgaggcaggagaattgggaggtggaggttgctgtgagctgagattgtgccactgcactccaacctgggtgacacagcaagactccgtctcaaaaaaaaaaaaagaatatttattgacatagataagtactaatagtatgtttcagagttacaaattctatgaataataatcttaattttgaaaaagttcctatatacagataagcttagaaaaatgtttagaatgccatacatcaaaatgttaatggtgatagtttccaatgggagggtttgggatcctggacttcatatatatatatatgtatatacacatatatatatatatatatacacattttttttttgagatggagtctcactgtgttgcccaggctggagtgcagtggcacaatctagctcactgcaacctctgcctcctgggttcaagccattctccctgcatcagcctcccacgtagctgggattacaggtgtctgccaccatgcccagctaattttttgtatttttagtagagatggggtttcgccatgttggccaggctggtctcaaactcctgacctcaggtgatccgcccaccttggcctcccaaagttctgggattacaggcatgagccaccgcacccagccaatttttatattttatatactttctgtattgaaagaaatttttttaatggaatgcttaatgcatttgcatgtcatacttgcacagggatcatgctagtctctgtatcgttccaattttagtatacatgctgccaaagtgagcatgatggaatttttcacatatcagacaaagaaacctgttttcattttggagaaaagagaaaccctcacaattttcattgaatttattgcataattaagaaaccccagtgatgtgcatggctaagttaatcattttgatattctgacttgctgtgtaggctctacacgcattttgatcattaattatcatcctcaggggttaagaatttctaaagataacattttagttctaagatgatctttcaatggatcaactaaaatgcagaacttagattaaaatgtgccatagtgcctatcaaagaacgctctaaggatttacataggaaaccccatataaaaccatttagattgccttgaaaattagccatcatctggattattagactgagaatgtagaaaattaatttagaggagagtgcttgctgcattttcccaaagaactgttatttaaaagatcttcgcttcttttttccttctctaataactgctccctctgcccgctgacaccttcctcctcctcctcctcctcctcctcccctgtgtcactacatggcctcggtttctcactgctgtgcctgctcctttctgagcacatggtttccaaagtccattaatagcaaagcctgattctctagaggtggccagctctttaaggtgtgtaagttttatagattggtattatttcccatttcacagaggagtttaaggaccaggataaggaagtgacttactgtatgtcatgagcttatgcaccaagatgagagcccgatgcacttttctagaaggcagccccagtcagtgtgccctggagatgggaggtgatgatgaaaaagctggagggccctaggagaggggtgccaagacaaacatgcacgttcatgcacagtgtggtctaggacccggccagaagggtattcattgttgccgagtcaactcttcatcttttgagatttttcttagtagagcctgatttatctctacaaaagtggaaagagtttgaaaaagcttcgacataaattgtaccacaatttagtgcattcaaatgaagagtggcagataagcttcattacacggctgcctgtggaattttagtgctggtatggaaaggatcctgagaccacatccagacttagcacaggtgaatgctgtgattgactaatgatgccaccatgggtgagggaggagcgagtgagagcacatttaccttgtgtctgccatctgtgttccaggtgataggatgtttgctcatttgaaatacattttctggactgggcatgatggcttacacctataatcctagcactttgggagaccaagaagggaagattgcttgaggccaggagttcaagaccagcccggaaaacatagtgagaccttgtctctacgaaaacatataacattgtctgggcatgatggcacgcgcctgtagtcctagctgctcaggatgctgaggtgggaggatcacttgaacccaggagttcaaggttacagtgagctgtgatcatgccactgcactccagcctgggcaacaggggaagaccctgtctctacaaaaattttcaaaataaataaataaaaattaaaaaacaattaaatacattttctggcacctcacgatatactgatcttttaacacatttttaaaaactgcattgacttacccgttgcatgcaacagctctgttgggttacacttttgccaagtaaatgccattaaaatatgtctccatatttgtaaatggttgaagtcatttgagtgtgcagaatgagtgatgacattggttataaggctgccaatagtggggacgatgcatgagcttttggctcagaaagacccgtgtaagttttatctgagccactaactagttgtgcaaccacttctgaacctctctaaactccagtttccttttgtggaagggaataaaatggtgttcatcccttagagctattgtgaagatttaatcggataatgaataaagcccttggccctgtgcctagtgcagaaaaggtgtggctcaatgtcacggtcatgagcaagtgggccattttctagtgaggagtggcaggtctcctcatcaaaaacataaggtctttctgaaacttcttactataaaatgagaaggtctaaagttcttcagtttttactttaccttatttatttattttccattcagacattctatttacaactagaacattagaatgaagagttttaatgttatcttttgataaaaagaaatattcatatgcagctcaaagcatcaacaaacattattgtcacttctgcaaatggaagatccttacaagagatcttgctaagccctttttttcccttaacattcatgcttttacacaccctatcacctcctctgcagtttctgaagtgttcagattccagttgtttccatattagacactatttattgatgataagtgttatatgaaaaggaaaatgttctttttcctccaagtgagctttctgtatgaatacgatctgaagaaaatatattgttagtcaaggctaaataaagttcatggaagaatttagaatacaaaatgcatcaaaaagtaatctgtttttctttctatcgccttaagagcaagtagacttttgggtactaatgagctcattagagcggttaataaactacgcttgagaatgtgcttcatggcaaactataaccctcccatttttcttttatgcttgcaataacattttcttttcttttttttttttgagacagtttgctcttgttgcccaggctggagtgcaatggcacaaacttgactcactgcaacctctgcctcttgggttcaagcgattctcctgcctcagcctcccgagtagctgggattacaggcgcctgcctcacacctggctaatttttgtatttttagtacagatgggatttcatcacattggccagctggtctctaattcctggcctcaggtgatcctcctgccttggactcccaaaatgctgggattacaggggtgagccaccgtgcctggccacattttttttttttttaaataatttcaacttttattttagattcagggggcacatgtgcaagtttgttacaatggtatattgcataatgctgagatttgggatatgaatgatcctgtcacctatgtagtgagcatggtacccaacagttagtgtttcaacccccttcctccctcctccctctatttgtcctccatgtctgtcgttctcatctttatgtccatgagtacccaatatttagctcccacttatatgtgagaacgtgtggtatttgattatccgttcatgtgttaatatgcttaggatattagaattttctgttcctgcattaatatgcttaggatagtagaagtggcctctagctgcatccatgttgctgcaaaggacatgattttattttttatggttgtgtagtattccatggtgtacatgtatcacattttctttatccaatccaccactgatgggcatctaggttgattccatgtctttgctattgtgaatagtgcagcgatgaacatataagtgcatgtgtccttttgattgaatgatttattttcttttggatatataccagtaatgggactgctggattgaatggtagttctgttttaagctctttgagaaatctccaaattactttccacagtggctgaactaatttacattcccaccgacagcatataagcattcccttttctctgtagccttaccagcatctgttattttttgtctttttaataatagccattctgactggtgtgagatggaatctcattgtggttttgatttgcatttctctgattagtgttgtggagcattttttcatatgtttcttgattgcttgtgtgtcttcttttgagacatgtctgttcatgtcttttgcccactttttaatggagttatttgttgtttgcttgttgaattgtttaagttccttgtagattctggatattagacctttgtcagatgcataggttgtaaatattttatcccattctgtaggctatcagtttcctttgttgatagtttcttttgctgtacagaggctccttagtttaattaggtctcacttgtcacttttgtttttgttgcaattgctattgagggcttaataaaaaactatttcccaaggctgatgtccagaatggtgttttgcagtttttcttccagcattcttacagtttgtggtcttatattcaagtctttaatctatcttgaattaatttttatgtacggtaaatggcaggggtccagtttcattcttctgcatatggctagccagctatcccagcaccatttatgtatagggagtcctttcccctttgcttgttattgtttacttctttgcagaagataaggtgactgatcaggtgtgtggcttcatttctgggttctctattctgttccattggcctattggcctatgtaccagtaccatgctgttttggttgctgtagctttgtagtatagtttgaagtctggtaatgtaatgcctctggctttgtttttctttttttcagacatgaggttgcccagggtggagtgtggtggtgcagtcatggctcactgcagcctcaaattcttgggcttaagggatcttcctgcctgagtctcccgagtagctgggactacatgcctggctaactaaaacaatttgttttttatttttgtagaaacagtgtcttaacatgttgcccaggctggtcttaaactgctgggctcaagtgatcctcatgccttggccttccaaagtactaggattacaggagtgagctactgcgcccagccttgttctttctgctgcataacattttctaagttcaacttgctagatattgagacattagattccaacctccactatgagtgatatgtgtaatttagtgcccaaaggatcatggaatgaggggccaacctcaacagtcaaattcatggttgtatgtagacatgctgcaagatacatgaaactttgtcgcaggttccttagaccatcacaaagattaatgtttaaaataatgtttataatccaaaggactgcaggggatatttaaaaatacagggtataagcacagcccagaaagagcttaccatttagtaggggagagaacactttcacagatgaaacaaatgaagtaagtatacgtatcaagctgaattatctgatttggaacgtaagcattgtgcagactctggtattaatctgcctggactgtttaggcccttacaacattccactaatttccaggtgatgtgttagccttctgactggattctaaggcatgctagtgacttatttctgttattgttgggtaaagatgaaaactgactcgaatgtgattttcttcagtttttagcacttgcttctgctcttttgcaaagctttacatataacacttgcttatttttctggggagattttattttggggtcaatatcaataagtggaataggtctatcattaattcccctggcagttggcaaaatgtctgcctcaatttattggcattgttggtcacttttttctttctcagcttgttatttattgatctctaaacagtcttagatggagcctttatattactagattctttctgtcatcaatctatgttattgtgctgatgcgtataataaacagcagccaatatgggtgacatttgtgatacagtcagttgttgattagatgccgtaagttgcctgtacctttcatcaaacaaatttccttctggaatatttccttggtagaatatcaaagctagccctgtggataaacatttttatcttcaagatatgagatataagttatattataaatttggcccttgaaaccagcacaacacattctcctccactccctcaggagtcctattttgaagctgattatttgaataaaatcacagacaatgggaaagtaagggaaaattcccagccatgctcataattagttgactgtatttctgatgcagatgcaaacgttgttacttaataacgtaattagccagagaaacatgtgctttaatgaatgcccctatgcatatgcaatgcaaatttgtactgcttattttttcttccttgggggtatgaactgcttttaaatgtttatttccttgtgatagtaagagttttgggggttttttatgtattaaataggattatatttttatttcccactgtggcctctgttggattgatttttgagtatttcttagtaggaactacctattttcttggatgccatttggtctgagcagaagtggcagtagctgggaatatctgtgacagggtcatgttctaggcaagccccaggccagactataatgtcatacatagggttaaacatcaggcccaagaaggtttcagggagtcacagagctacagagagacatctatttccagcagctctcttgctctgggaaagctcttggagacaagattgggcaggaggcgttgtcatcgaacccttccagactgacttgaatgcttattcaggcaacgttttctccttaggttttagctaacctgtaagattagagaaccaagtcagggcctaggtggagcccttcgtggtgaaactgcccagatttactggacctggactttgaggtcatacaaaccacagtttgaatatcagctcttttacgaatggtgtgactttgaatgtgacttaagctcttagggcctccatctttgtatctgtaaactatatgagatatagtttccacctaccttgaaggattttctttttttgttttttgtttttgtgtttttgggacagggtctctgtcacttaggttggagtgcagtagtgcgatcttggctcactgcagcttccacctcctgggctcaagtgattctcccacctcagcctcccaagtagctgggactacaggcatgagccaccaatgcctggctagttattgtattttttttttttttttgtagagatgttgcccaggctgctcttgaactcctgagctcaaagtgatctgccctcctcagctttccaaagtgctgggattacaggcgtaagccaccttgcctggctactttgtaggattttctgttgtaataaataaggtagtgtatatctggtagactaccttgtgtttgggagtatttcaatgaatgctatattctctctctctttcttccttttcctttcctttcctttccttcctttcctttccttcctttccttccttcctcctttcctttcctttctttcctttcttttctttccttcctttccttcctttcttttctttcttttccttccctctcctttccttctcctctccctctcctttccctctcctctgcctctcctctccctctcctttccttctcccctctcctctctcctctttcccctcccctcccgttccctcccttcccctccccttcttttatttttgagatggagtctcgctctattgcccaagctggagtgcagtggtgcattcttggctcactgtaacctctgcctcccaggttcaagcgatcctcctgcctcaacctaccaggtagctgggattacaagcatgcgccaccacacctgactgatttttgtatttttagtagagacagggtttcagcatgtttgccaggctggtcttgaactcctgggctgaagcaatcctcctgccttggtctcccagtgttgggattacaggcgtgagccaccatgcctggctgaatgctattattattaaaattactgaggcctgaacaactttcttataattccctggcacaagattaatactggtttttgtggggctttttctcagctctcatctacttggtgtttggtatgtgtgaattacctgtgttggataataaatatggaagtaatgtctgtcctgttatttagacgtatgatctgctgatgtctggtttcttcctgaggggctgttggcatatcgtagcagcatttattgcatcttgaactgtgataaagtagtagcaagctatcaatgaacaacggtgtaaaacatacgattttaagcggaccttgtggaggtacaagaattataagacaaagactctgtccttgaggaactgtccatatattcgggaaggcatgtattcataaaaagacactaaatctgcaaggcaggaaataaaggtcatatgaacagtatagataatgcttgtataaggatagataatactcggctgagtgatggctcacgcctgtaatcccagcactttgggagggcgaagtgggcagatttcatgagcccaggagtttgaggccagcctgggcaacatggtgaaaccccatatttacaaaaaatacaaaaattagccatatatggttgtgcacgtgtgaggtcccagctacttaggaggttgagctggaaggatcacttgtgcctaggaggttgaagctgcagtgagctgtgattgtgccactgcactccagccttggcgacaggagtaaggccctgtctcaaaacaaaacaaaatcccctgaaacaacagaaagaacagataatactctatacttcgtatatctctaagtgtaggtaatagtctttattccaccccccttctcaccctcacatccaaactatcaccacgaacattcagttctgcttccagaatacatcacaaatccatctcttccttccatttccatcccctctgaagtccatccaagaccctatcatctctctgttggactactgctgtagaccctggctgatgtctctttttttattcctattcttctcccaacctttctctacctaacagccaaagtggtcttttaaaaacctaaatcagatttttcattcccgtacttaaaacccaacaagagcttcagttgcttttaaaataaaacccaagatttataaggccctgtgtggtttggctctgcttttttctccaccttcatctcatgccagtctccctctcactaactaggctcctgccatgcaggttgcttttccctttttggaacccaccaagagctttcttatctcagggtctttgcattggttctttcgtttgattgaaatattcttcctttggtcccaaacatggcttgctcattgccatccttcaggtcttaatgtatgtgtcatttcttcagagagatcaaatcattctaactactactctatttaaaaagtgtttctgggaggatcacttgaggtcaggagtttaagattaacctggccaacatgatgaaactcttgtctctactaaaaatactaaattagctgggcgtggttgcaggcacctgtaatcccagctactcaggaggctgaggcaggagaattgcttgaacccaggagacggaggttgcagtgaaccgagattgcaccactgtactccggcctgggtgacagagtgagacttcatctcaaaaaaaaaaagattgtaggccgggcatggtggctcacgcctataatcctagcactttgggaggctgagacaggcagatcatttgagctcaggagttcaagatcagcctgggcaacatggcaaaaccccatctctactaaaactacaaaaaattagctgggtgtggtggtgcatgcctgtagtcccagctacttgggaggctgaggcatgagaatcacttgaacctgggaggcagaggttgcaatgagctgagatcgtgccactgcactccagcctgggcaacagagtgagactgtctcaaaacaaacaaaaacaaaaataaacaaaaaacaaacaaaaaaagtttttttgaagttgaggccggtaagattgcttgagtccgagagtaagagaccagcctgggcaatacagagagaccccgtctctacaaaaaactgaaaaattagctgggcatggtggtacatgcctgtggtcccagctcctcgggaggcagaggtggaaggatttcttgagcccaggaggtcaaggctgcagtgagttgtggtggcaccactgcactccagcctgggcaatagagtgagatcacaacaacagcgacaacaacaatggaagttttccccatcctatcacttaataataattgttattattatttctatataacatttgccacaatcacagttatgtgttgacttattattattgttattttttgcctattggctctccctaagctccatgagggcagaaatcttacccactttgttcactgctataatgactagcatgtaataggcactcaatagacaggaataaataaacgaatgaacatagatcttaaaagttcagaggaagacaggatccctttgttagtaatggagcagatcaggcacggggaaggactttgctcagtgtgagggtgaaagagtgcacctgcagaagaaggtgtgagtgcaaaagcagaggagagtaagctgagatgggaggcacggggactatagaatttcagagttggaacagcatttttctttttctttttgagatggagtctcactctgttggccaggctggagtgcagtagcacaatctcagctcactgcaacctctgcctcatgggttcaagtgattcttgtgccccagtctcctgagtagtaggattacaggcgcatgtgccaccacgcccgggtaatttttgtatttttagtagagatggggttttgccatgttggccaggctggtctcaaactcctggtctcaagtgatctgcctgcctcggcctcccaaagtgctgggattacaggtgtgagcctctgtgcccggccaactttcgagaagctgtgggtgtagggaaaagaatatgactgacatgccttaaactcctggccatcccacaattgcctgtgtaactttggatgtatcattctatcattttgagcagtctttgcctgtacagtggggaaaataccccttaacatggatgggtattttgactattaatgctttatacttaggatcctgttggaatgcatatgatgacaaatggtagccatttgtaccaggatttcattcagattgtcagctgagggtgtgcgccaaaatgaaatttggagctttgtagaaatttgaataccaagagcccaattcagtactactgaatcagaagagttatctctgggtgggtgtgggactccagcacgtgcgtttttctaaagcttcccaggggattcagacgtatagctgttagaaccatgcgtttaatccaagccgtgctgaaatcctctctaaatgtctcttgctgagggattgttcaacttgaatagctctgttaacggggaactcacagagccacaggtccaagctgcttcctaaaggggcatccacctgagcctttgagccttaatccctagagaacaagttattgatttcttatcaattgggtgatatttggtattaatttttttttaaaatcttgcagtcccaaccaaagtcatcatgccttccattattcttggtcacgtccaagatggaagccaatctagttatcttttgtacttttatcccttttgtacttgtgcttctctcctaatccaatgacttgtcactgggttccctcccagacttctccactgagcactttaaccttccaccttcagtgtacatgaatctatacctccagcctctttagtgatgtcccctctacttcctgctgtaactgaactctgtcttaaattagaagatgtttcagatgtcaacaatgtgactaggcagtcttatgaaacattaaccatctctttggttggttgcttgtgtacacacaaatatattcattcttggaatgccttgggccattaaatacgtctaaaggtttgatgctgggaaaacatgatgagggccaaggggtcttgtgtctggtgaatatgcatgaaaagggaaccaaagctctgtgggcaaacatgggacatgagagatagacagggttggaaattagatgagatcctgctctgggaaacctccctcctggaaataactctggagtcctgcaacagaccaagcatccataatgggatgtaaaagagtgcagttgcattaaatccacacattctgtatcagaggctcatttaaaagaagccatctatttctaaggccaaggatggctgatggggatatggaaacaggttatatgattttctctagtttgaatgctgttatctcaataaaaggacttctgtttaaaaagcctggatgttaggagggcttaattttcttggctttctacggattggggagaaaatcacaaatcagaatgaatgcctcaagtttttttctttctttttttttctctgaccatggaagaacagattttttttttctttctgcgtttaggtataactgggactattggtgacacttgaaattattagagccatcttattttatagttattatactttcttgaataacattgtatccatgagtgctattgtgtgacatgaaacattagtatgctttacttcttcccttcaactcactgctctggttttattgaaataatttgaaaatttatttttattattattttacattgttcaacttttagttctagaatcctttactaatagttatgtcaagctctacagtcacatttaaacgattatggagacatccatacatcttgctgatttcattgttccttggtgttttctgtaaaacctgtctgccctgcacacttattcttacgatatttgttctgattcattttttcgatttttttttcccagaaaagataaacggatcgattttttaaaattctgaaatatctaaaaatgactttcttgggctcttaagtgaagtatagtttggctgggtctagagtggttatgtcataatcttttacctgtagatagttctttgtaaatatttaattgtcttttagtagtcagagttgtagagaaaaaaatttcgtatcaattttgtaattccgggtttgtctcctcctatgcaactgatttttttctttgaaagatgcatataagttgaatccttaggagataaatactttctccattaatttgctttaaaaagttcagagattttgaatatcttctatttaacagtcagttggcaataattgctacaattgcgttatcatctactctgggattgatgatctgaagatacatagtaaaatgtactagagaactgtaatatttagaaggaccctaagatatattatttcatagatcaatgaattctttataagtaaataattgcatagtttgactattctctatgtgtgcatgtttggaaattttattaaattcagacatacttatattggattatttgatggggttagtgttttctcttttcctgtttgagtggcctctatcactattaaatatttattttaaagatatgaattgtagggctggaagtcagggcttataaccagtgctgtcttggttcccattgcagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacaggtacagattctgttctgggctcctgctacccaggaacaaaacagccagtgggagccgagggcctaaaactatctgattgctgcttcactctacatactgtacccagctcggctatttacctggttgtgcacctggctttagatttgtcagctaaatcctgaagatttagaaggtggattggaaaaataagttggatagaaaatgttatgcatccatcttttgagacccaccttaaatcgctgtgattcctgtcccctctgcttgactgtctgagacatttttctccatgaaccattttctcagaggggcatgctcctaacttaacacctgttgaccgcttttcagagaaaaggtggtatgacgaaaaatagttttttaatgtttcttaattgtgttaacacacaaaaaacatacaatttaacatctaatatagttttatttctttttttgagatggagtcttgctctgtcaccctggctggagtgcactggcacgatctcagctcactgcaacctccacctcctgggttgcagtgaccaagtgattcgcctgcctcagcctcccgagtagctgggaatacaggtgcccaccaccatgcccagctaatttttgcatttttagtagagatggggtttcaccatgttgcccaggctggtctcgaactccaggtctcaagtgatctgcctgcctaggcctcctaaagtgctgggattacaggtgtgagccaccatgcctggcttaccatctaatatagtttggatgtttgtctcctccatatctcatgagaaatgtggtctccagtgttggaggtggggcctggtgggaagtgtttgggtcatgggggtagatcactcaggaatggctttgtgtcctccccttggtgatgagttcttgctcttagttcacatgagagctgattgttaaaaggaacctggcacctccttctctctttctggctccctctcttgctgtgtgacatgcctgctccctcttcaccttctgccacgattgtcaacttcccagggccctcacctgaagcagatgctggtgccatgcttcttgtacagcctgcagaaccatgagctggataaacctcttttctttataaattacctagtctcaggtattcctttatagcaacatgaaactgatgaatacaccatcttaactatttttaagtgtgcagttcagtagtgtttatgtataccaatcttgttgcacaaccaatctccagaactttttcatcttgcaaaactgaaactttatacccattaaacaacaactccccatttgcccctccccacagcccctggaacctcacccttctactttctgtctcttgtgaatttcactactgtaggtatctcatatggtacttgttcatttgagactggcttatttcactaagcataatgtctttaagatacatccatgttgtaacatgtgtcaacatttccattcttcatatagtccattatatgagtatcccatgttttgtttatccattcatttgttgatggacacttgggtgtgtgttccatcttttggctatgatgaataatgctgctatgaaatgtgtgtacaaatctctctttgagaccctgttttcaattcttttggatatatatccagaagtggaattgctggtgaaaaggagtcttgaggcctggtgcaatggctcatacctgtaatctctgtactttgggaggctgaggcaggtggatcacttgaggtcaggagttcaagaccagcctggccaacatgatgaaaccccatgtctactaaaaatacaaaaattagccgggtgcagtggctcacacctgtaatcccagcactttgagaggccaaggcaggaggattgcttgagcccaggagttcaagaccagcctgggtgacatagagagaccccatctctacaaaaaattaaaaatttgccaggtgtggcggtgcacacctgtagtccccagtactcaggtggctgatgcaggagaattgcttgaacccaggagacagtcgtaagccaagatcacatccctgtactccagcctgggggatagagcgagactctgtctcaattaaaaaaggagttttgagacttcacttcatattctagcaatgccatatattagctgtgtgtcattaggccaggcattctgagcctcggtttcctcatctataaaagagggaaataaagtctgtttttcttacctcagagagtgttgaaaaggaatcgaataagataatctgtggggcgcattttagaaagctgaaagcaccatgcacatgttagtctttttcctaaagttgttagcctcatgtgaagatcttctcatgaatcagaagcgtgtacttctacatgattcatttcacacctctgcctctgaggaacaaggtgagaaaaggcaatgattcttaccatttgtggtggttgatcagaaggtatgacaaatggttgtcacatagtccctgggaatatatttctggctgttgacttgcttggctctgaagacaggtctctgaagagtgaaatctccaggagctttgatctgggtctctggtttgactagcagcagaattgtggtcttgcccaccaacattttccatcggaaattctggccagagcaaacaagacatgtaggcccctggggattatttgtccatagagcagtggttcataacgatgttggggatgggaatttgaggaaatctgtccattcattcaatagatatctatttagcatacactatttgtcaggtactttgtcggcatgaccctcttggaatttacagtgcaacaggggaaacagaccttttccccaaaggtatgcacatacacatacacatataatgttttacaagtagcaaggtgttcctggacctctgaaatccttgagtaaagcattcttgggatagatggaaagctcacctctgctgttgaggccctgtatgtgccatgcaattcctatatttggttatctccatcgcgaattcaagaggatgtaggccagagactgcaatcagaaaaacaaagaagggtagagctggataagaacccagagatacaatgcagtcttctcttagagaggtctcattgacttgcccagcctgcacagaggagcaagggcaaacgtgtaactgacaccaaagactctaggggggtccagtcttaataattggagctaatgccacgctggactagactgatggtcactccaacctatcatggcatttgcaaaagcatctccaagagttatttggaggaggtgaggtagctgcctcctggaatgctgaattcaatgtttggggaagtattcccgacacagagcaactgctggagtcacttggtaagagctgggtatagcttctgagcctcagccatttgcttcattgctcaagctgctctgcctccaacattcagcagtcaatgggggtataagaattagtcaccgcatgaaaaaccagtggatctgcatggggcatagtaagctattaattagctgatgcttgtagagcactttgaagaacaaacatgttatgtaactgctaattataattaccatcctcagcctgctacctttcacaaagtctgtggctccagctgcagctgtttccatgggtttatgcaagctttgatttaagaaaagaaaaggcattctccctgagagctgtgatctttctgtgaggaggcctttatgccctcaatcaggattggcagctaaattcaatttccgcagataaaggggatgatttacatgctgattaattcatggtacagtgcagatgatctctgggtgggtaggtaggagaggcttctggtaatgtagtgagagctgctgattaccatggctcttgctcagctacccctcttcttttttcttttccctgtttttcacttgttacctatttcttcactcccctcatcccaactgtctctgtgtattttgttgttgttgttggagatggagtctcactctgtcacccaggttgaagtgcagtgatcacagctcaccacagcctccaactcctgggctcaagcgatccttctgcctcagcctcccaagcagctgggactacagacatgacccaccacgcatggctaaattttaaaaatgttttttgtagagacgggtgtctcactatgttgcccaggccggtctcaaactgctagcctcaagccatcctcctgcctctgtgtattttatatttccctgtcttcgtgttcacgtttggcttcccctctcatctttttctacttttctgcttctctctgaatgcctcctacctctgtcctgttttcactgttcatcttcctgtttagttccaaactgggtagaataatttatctttacctgggttgtttgtaaggaagccactagtctttgggattagtagcacaaatcgtatgtgcttttaatggggtgtgagctctatcaagctggtgggacttattttttcctgccccctccttccccgccaggccagtttggactggaaactccagacagctgggaattaggcaatcactttcgtgtctggaaaaaccccaggtggaagcttgatgttaatgagtcggtttacctcaagatcaaagagactgattcattcttgataagactttccctggcttccattctgcacaggccatttggcttttcatgtttagaatctgagttaatgattataaggctgacgctcactcactccacgctctcagaagggtaacatctctgctggaacagaggctgtttatcgctaggatcctttctgtgcctctaaactgctctgggcactgctctgatgcctccaggactcctgttggcctctgtcccttctgtttggctggtgaccctcttctccagcccactgggtgctcagttgcagccacacacatttcagatggaacagaaaggtcagccggaataaatggatacatttacataaatagccacatggccggatgtattggaatatgtgaatgaggtttggaccatcaagcattatagctactgctggctgagcatgaacgtacacacccagggctcagctagggaccttaatgctcgatttcatttcatcctcttaaaacccttttgaagtaagctttgttattttcatttcatagataagtaatctgagactcataaaggttaagtgacttttacatggtcactcaataattagcaaatggtagagccaggatttgaactgaggcctgtaagcccagaaagaccacattctttctcctacatcagtgtcttccaagcttgaattatttgtataccaccctgacacaatgtttgccataataagagtattatttacttagagtgtttccttaaacaacctaaccttaaatttataattcaaatttattaaggacaatatatgtgatctcatgagtttgatgaagtaggtgtatttttctgatatacacaaaaactgatacataacgaacagataaaaatgtattcctggctgggcgcggtggctcacgcctgtaatcccagcactttgggaggccgagaagggtggatcacctgaggtcaggagtttgagaccagcctggccaacatggtgaaaccccgtctctactaaagatacaaaaattagctgggtgtggtggcacgcgtctgtagtcccagctactcgggaggctgaggctggaggatcacttgaactcaggaggcagaggttgcagtcagctgagaacatgccactgcactccatcctgggctacagcgcaagactccgtctccaaaaaagaaaaaaagtattcgcgtgccaccaaaaatcatcccaaagtgtgcaatatattttacactaacgtactctaagccatgctactcctacttattttatgtgaatctaagacttcaaagaaagaaaggaaacacatgaaaacttttatagccaaacatacatttattcaagtaggcactgtgggaagccataccctgatttctgtggtgctgccattatcatcatgtgtttgccttggaatcctatttgataatgtcctttggaggtagtttatgagccgtattagaagatcagttacattccttttgaaatcagatgctgttttgactagaaatgatgctgagcttgcttgaccatctgtttgggtcacctggatttattctctatgaccttttgctgtttccaaaaataaagaaaaaggatataaaattggaaaccaagggagtacactagaccagcccctgtccttgcacagtgggacttctgaaagagtagtctgggctcactgtcttattccctcccctcctatgctcttctcagcctactggggggaaaccaggcatcgaacacccccacttcactgtagcatctcaccaaggtgactgatgactacctaactgccaatttcatgttccagtttcagctgtcattcttctcaacctttccacaacatttagcattgttgatcctttatccatccattcaaccagttcaaccaaataatacatagtttttagtatctatatttaaggcactgtgctagggcctgaggatagagagagaaacatggtctttgccatcgtaaagttacattcaggagaggtggtcattatataatgacttacgtatttagttacaagtgtgttaagtaccacatacagaaatactagatgctaacaaaataccaaaatacataacattatgtacatctatatctatatatacataacatatatatgtacctgtgtgtacacacacacacatagagtaaagcaaaacaaaggctcttactttatcactcactgagactttctctccccaaatccaatgagacttcagctggacactgtgggggcctccttcttttaagccagagaggcctctgtgttctacaactgggcaggctgagggcctgctcttcccacctctacccaaagtcaaaccacagatctaatcctgatgccgtgggcactccatgaggggagaaaagccatgtgagaggagagagggagatggagtttgcaccctctgccttgacctgctccaggcccttcttggctaggggatgaggaggctgtgggagactggtgggaaagaaggctgataattttcttaaaagaatttatttttattttttagggacagagtcttgttgtatcacccaggctggagtgcagtggcacgatctcagctcactgcaacctccgcctcccaagttcaagtgattctcgtgcctcggcctcttgagtagctgggattacaggtgtgcaccaccacacctggctaatttctctatttttagtagagacatgtttttgccatgttggccaggctggtcttgaactcctggcctcaagtaatccgtctgcctcggcctctcaaagtgctgagattacaggtgtcagccactgtgcctggccttggaaggctgagagacactctttcaagtccttcctttccttcctagacatcagtcactctaccagcctcctgcctctcttctgcattgcctttttcctctggttcccccctgggtttcagtgtttcccagtgttctgccattgggccattcactgtctctgtcctacctgcatatctcacctgcacccataccttcaactaacattcacagatctatgactttcaagagtactttttccctacatagtcagcaggtaacatcgtcacagcccagtgcctggcatggcaggatgcttggcatttgatagccattcagttagtagtgagcagggaatgaaagagccccgggacagctccaaagaggacttccagaaatgttttcagttatcagcactattggaatgagggcatatagtctccattaaaagggcagcattaatgtagatgttgaatatctgattcttttataaaggagtctttccaactaatttgtaggcacctggagggaaaagcaaccaaactttgttaaactgctccctgggatgaaatatctgacacccctataattggatctgggtcccatctgtgcagagagcatggcacaggctggaggcagatggcatctttgagatgccatttacagttgtcatagtgaatgagcaagaaggaaggacaagaaagaaaactcctttctaatctctgcttcgatgacaaaggaactgagagtaaaaaggaaattcgctttgctggcaactcagagagaagatgagggctgggctggtgccttttctttctggaccaggtggtgagttagcatcaaagggatgtgtaagtgagcagagatgccaagagctctggggctttgaagggcagcaaagagggtagaggccagaaatatctggggcttgttcaggctgataaaagactggtaccaacatcatctttatgctacccaagggggcgaactgaaggtcattgtgtctcttagggtacccatgctcataattggagtatttcttttctttttttttttcttttttttttttttttttttttttgcaatggagtctcattctgccgcccaggctgcagtgcagtggcacaatcttggctcactgcaacctctgcctcccaggttcaagcagttctcgtgcctcagtctcccaagtagctggaattataggtatgtaccaccacgcttggctaatttttttgtatttttagtagagatgcggtttcaccatgttgcccaggctggtctcaaactcctgacctcaagtgatatgcccatctcagccccgcaaagtgctaggattacaggcgtgagccaccgcacccacttggcccacaattggagtatttctttgatttcaaattgtgtgtgttctagggagaaatactgatatagagatccaggaatgctgcagacagccataggtggcctttctggtatctcggcaggagtttgcctatttttccctctctgcctccattgattttcacttgctaatagataacttgggcttacccaagaccaggtcatgtgggacacagaatctaggcattgctgctgaagggatgatttagtaaagatataaactcttctttgggcagagaggtcagtagatctgggtcaatccaaagctagcattggttctgagtacaggagaataggattggccctacaggtacctaaggtgcaggcttccttttgcacttggagactgcgaagagatttactagaagggagaaacaggagctgagttgtggagagtcattttctgacatggagaaatagctttctcactcttcttagatgggagcctttcactgggtttatatttattatgcagtagagaatcaaatcccaggcaccaggagtgggaaacaagggcagtaaaacagggaaagaaggagagtcagcgtatgatgcctgattgtactggtctccacagagggtgggcattaccacatctgtgtgacagtgtccttagacgctgaagaaactaagtctttgttggacagcccttcagaggaaagaaaggaggaaggatttctctaccagctcctgtccccacaggattttaactcccctgcacttccagatggcatgtgctggggtgtgggtgctgcagcagggaagtcccagaataggaggcaagacctggtcatgttgtcaaaacccatccagggatgggacaaggagcaggggaagctgagagaggctgaggagttcttaagaggtgtctgcttcaatgggaaagcttgagctggggctgtggaatatccctttttggtgacatgaggacaactttctctgggaataattatatgatagcttctgtctgcaggaattttgtttgtttgtttttgtttttgtttttgagatggagtctcactctgtcacccaggctggagtgcagtggcaggatcttggctcactgccacctctgcctcccaggttcaagtgattctcctgcctcagcctcccaagtagctgggactacaggcatgcaccaccatgcccagctaatttttgtatttttagtagagacggggttttgccatgttagccaggctggtcttgaactcctgacttcaggtgaccaacctgccttggcctcccaaagtgctgtgattacaggcgtgagctattgcaccaggcctgtttgtttttgatagtattgtaaatgaaattgttttcttaatttcatctttggactgctcattgctagtatatagaaatacaatagatttttgtacattgaccttgtatcccgcaacctcactgacctcctttctcagctgtaatacttgttttggtgtggattccttagagttttatatatagaagtatataagattgtatcatttgcaagtagagatagttttacttgtctgtaggaagtttattttattttattttattacttttgagatggagttttgctccgtcacccaggctggagtgcagtggtgcaatctcagctcactgcaacctctgcctcccaggttcaagtgattctcctgcctcagcctcccaggtagttgagattacaggcatgtgccaccgtgcaccgctaagttttgtatttttagtagagatggggtttcactatgttggccaggctggtctcaaacttctgagctcaggtaatccgccaaccttggcctcccaaagtgctgagattacaggtgtgagccactgcactcggctgggaatttgatttcaaagaaataaaaagctagatcccctttcgttcttcctgtctgcacaaccacttgcgggttgactgggaatgctgaaaactatgttacctcagggaaccaaggccttcatatggtttcccacattgctgaattcattagctggaatatatgcagaatatttaaaagaagcagaacaacccagaggaatcagtggcatcctgatagaccaggattaaatagcttcagttacaggagtcccagaagtacctaggaaccttgtggagaatttctttagtttgccccaacctgtttctgaggcgtggtcctgtgtggtgagacatgtcattttccccctggggatagcagtgacttgaaggagtttcccatcattctgctgggaagagaaaggtggaagtaggtcttacctgtgcagttgcagggaaggtctcactgaggacccagctctgggcctcattccattctaccagagtggaatgccagtggcatccagtggcctgtcaggtgaatcacaggttagaattctgacctatatccaagctggaatctttcctttccctctaagtcaggtaatgggccacgctcattcatgatgaagagaagttgggtgattggcttgggagagcttgcattgcctgactcagtgtctgcctctgaggatgaatggtgaccagcagagataccagctatgcagagagactgatctcctttagaattttgctaaagcccattgatgcattttgtgagttgactgcctttttctcttttagaaattctgacaaagattaatgatgtatcactgtttaatgatacctgtgtgagatggcaaataaactcaagaagaataaaccccaagatctcatatgtggtaagtaaagtgatctactttttcctgctaggacagacacgtcacccatgggaatatgagtcagagggacttgcttccgtgagagcttctcaatctaattgctgtttttttttctttttttcttttattttttttgtgagacagtctcactctgttgcccaggctggagtgcagtggtgggatcttggctcactgcaacctcagcctcccgggttcaagcgattctcctgcctcagcctcctgagtagctgggattagaggtgtgcactaccatgcttggctaattttttgtattttcagtagagatggggtttcaccacgttggccaggctggtcttgaacttctgacctcagataatccacctacctcggcctcccagagtgctgggattataggcatgagccaccgcgcctggcctcaatctaattgctttctgatcccattgtcatttaaaaagagtggatggaatttttgaagatatctggatgatttcgttattttgcattttgtgtttaacatatttgtcattcagcagggtgcatgtgtgggggatgcatttatatttggcatcctcacgattgcttgtttccaagcacttgtatttcactcccccagagcaagcccgggagcgtctgctgacttggtgacagagtgcagccaatggtcctcaggttgcaattgtctccatttgatcatttgtgtgcaggagagcacttcctagggagatttctcatttatgtctcctctaggggtttaatattcactgggctgatcagactttatcagcagaccaggtttaccttacgaatgctccctggctgagcagcacagtataaaatagaatagtaggagaatgggctccagcaccacaaatcctggattgttttgactggagtcagagtgggttctcttgtcttttcctctcaaagatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctggtaggtggaggtgaagtctcatttcctcctagaaaatgctaagcacagaatgtggggaagtatgctgcagaatcagctgggctggagagctcctatttgctgtctgagatttatactcagatgtagttgctccagccacagaactagagcaggtcaagagatccgtatcctcttggtaccaggctgaatgggctctggggtattttttctcagctgagccctccgggagaggtggaaagtaataaaaaggcatttaaaaggaatgccttttaaatgatgatcagtccactctcaaatatccaaggcaacagagggtagccatgtggcttatctttggtagtaaactcaaaagtcatttctggccaggtgtggtggctcacgcctataatcccagcactttgggaggctgaagtgggcagatcacttgaggtcaggagttccagaccagcctggccaacatggcaaaaccttatctctactgaaaatagaaaaacttagctgggtgtggtggcacacacctgtagtcccagcaactcgggaggctgaggcacaagaatcacttgaacccagggggcagaagttgcagtgagtgaaccgagattgcaccactgcactcctgcctgggcaacagggcaagactctgtctcaaaaaaaacccaaaaaaaccaaaaagccatttcttgctcttgcgtgtgaaagaggaggtgccagggaggctgacccagcagctttaaagagatcaagttgagagtggggaagtggaagcaggggcacccctagggtgcaggagggtaggtgttagctgaaaaaaggagtggaatgaaggagctttaagaagtagaaataaacctcattttacataattgtcatgtgggtttttaacaacattgtgacaattacagtaagttaaaaaaaaaaagctctggttatgggtatgaggactaattaaataccttgtagacaggtggggcacggtgactcatgtctgtaatccctgcactttgggaggctgaggaggattgcttgaggccaggagtttgaggtcaacctgagcaacacagtgaggccccatctctacaaaaaaaaaaaagaaagaaaatttagcttggtgtgatggtgcatgcctatagtcccagttactcgggtggctgaggcgagaggatcacttgttcaaggctgcagtgagctatgatcatgccactgcactccaacctgggtgacagggcaagaccctgtctcagaaaacaaacaaaaaacccggtagacaaaccttgacaagtaattgatgtcatttatttattttttgagatggagtcttgccctgtcgcccaggctggagtgcagtggtgcgatctcagctcactgcaatctttgcttcctaggttcaagcaattctcctgcctcagccttctgagtagctgggattacaggcatccacgaccgtgcctggctattttttgtatttttagtagagactgagtttcaccttattggccaggctggtcttaaactcctgacctcaagtgatctgcccatctcagcctcccaaagtgctgggattataggcgtgaaccaccacagctggccgatgtcatttattattttgggggagttgagaaagttcttaattagctgtttgctatcccactgaaactgtaccttaacccgagtagctgggaatagttcagcagaaatagttgaaaaagtctgccaatcttaacaatataaaaccaactatgagattatacaaattaggtctcttgacatttgtatataaataaaacaaaattaattctttgcaagtaaataatatgcaggcaaagatattataaaattaatatggtaactaatcagagaagtcttacaaaattattagtaaactactatagggaaatgtctttaaaagatcatcactcacctgccactgttcagtgaggatgacaggttgctgtttggcgtcagctgtttttactaatatccaattacctgttcaagttcctttcccttgggaaaaacatggtctttggagtcaggcagatccggttttgcatcttaactctgtattgaagagttggctgatcatggctgagttatttaatgtctctggactaaagggaattggattatatttgcaagttaatctagagagaattaggatttatgttgagccatcctaactgggagcaaggtatgtttccacatttactcagtgtctactcaggtcttctgtttatttatgcactgttataaagacttgtcatttttttcctctagatcctggacattctgttgtctgatttcattattggagttatgctattttccttaaaatgaattgggaagttttccattgtttttccctctggaatactttatatcatgtttgaattattcccttcttttaaagttgaaaactttctcaaaagattgttgaagtttcacccctttcaggagatgattctttaagaactttgtcaatttcttccatgattttgggtctgtttatgtttctgacattttcttgagtcaatttttatatttttctaaaaaatgtatatttggttgatatactacacatattggcagaatggcatatggaatatttgcttacatctcctctggggtcataggttatataatcccaggttattctgactcctaagtttggttctttctctttttagaggttgattggtttgggttgcgtgttttattactattttttttccccgagggatgaactcttgggttttaaaattgtttttctttttctaactcactaatttctcctcttgtttttatttttccttctccatgtttctctctctctttttttttttctttctttctttcttttttttctttttttttttttttttgagacacccagctctgtcacccaggttgcagtgcagtagtacaatcacagctcacagcaaccttgacctcctgggctcaggtgatcctcccacctcagcctcccaagtagctgggactacaggcgtgcaccactatgcctggcaaatttttgtattttttgtagagacagggttttgccatgttacccaggctggtcttgaacttctgggctcaattgatatgcctgcctctgcctccccaagtactgggattataggtgtgagtcacggtgcacagcccatatttctgttaaattggttatattgttctgtttctaaattcttgagtcacggtgcacagcccatatttctgttaaattggttatattgttctgtttctaaattcttgagttgaatgcataacaaaattcagcttattttcattcgtttctgtttgataataaaagtctttaatgtttctttctcccttgcagatttgagctttggcagaattctttaggcattgatacatgtttcaaggcatgatataattgctattctgattttctgtttgacagaataattatttatgagtgttttaatatgtgttctctttacccttactttcaaagcattatataattactattctgatttcccctttgaataattaattacaagcattgtatacagtggtagattttttctttgtaacatttatactgtgttgttgttttctagttttattacattttggtatgtttggaggatttattgacattttcttgggccttaccatttggccaagtttggtaatttcagtaggtgctagataataaggtagagtgtttgcctgtaaggggaataagatctgttattaagtcaactttattaataaggttattcaggacttctggtttttgtttatttttaacatggattgccattttctgttcctcttagaaattcttattggtttgtttcacacattttgatatgatttttatgttcatgactgatatctttattatagattctttcgctagtaacaaatggcttattttagcctgtttaatacctttgccttgaattatatgttgaaagtaatattgttttcttaatttatttgtgcttgcatttgcatgatatgcctttgtctactttttttccttcttgaaagctatctgaataatattactataaatgtactctaggagacagcatgtattgagagcttttctggaaaacttttatttttgattagataagttatccaacttacatcattgttatttgtgatatgattttcctttcatctgtctatttatttatttatttacttatttatgagcagaatctcgctgtgtcgcccaggctggagtgcagtggcgtgatcttggctcactgaaaccttggcctcccggttttaagcgattcttgtgccttagcctcccaagtagctgggactacaggtgtgagccaccacgtctggcctctttttttcttttttttctttcttttctttttttttttttttttttgagatatggtctagctctgttgcccaggctggagttcagtggtgcaaccatggctcactgcagccttgaccttccaggctcaagcaatcctcccacctcagctcccaagtagctgggaccacaggtgtgcagatcacttaattttttcattttgtaaagacaaggtctcactatattgcccaggctggtcttgaactcctggcctcaagggatcctcctgcgtcagcctctcaaagtgcttggattacaggtgtgagccactgctcctggactgttttttccctttttaatgctactttgctgtgtcttttgttttctttttgttacacagattttcttttccagtgagtcagatagtatagattttgttttcttttctacaagtgatcacatttaaaaaagacaaattctatttgagtgtgtatttcttttttcaccagtgttaagactgaaatattgttcacttttccctgaatgagataagttagcattccttttatttttaaaacttccttttatttcttcccctctctcttctcttaggttattggtttagtatagcattatattaccagtttcttatttttaacatgtattatctctccaaagagctcactcttatattgatttatagaaaccttggtagcgatgatttaaccttgggtacatgttttaatagtttcagtgcttactgacagtcttttcaaaccacgttctctattatttctctatctctatttctctctctgtgtggtgatttgcctgctcctcagggagggaatgggatactttctgagtccatgatgatctgagaatgtcttttgttgccttcacatgtgaatgagagctcaattgaagataaaattcttgggtcataaacttttgttcttggaattctagaagtatttcttattgacgttgggaactggaagctttgaaagaagagttagaaggtgtgactttcttttaaaaaaaaaatcctggccaggtgtggtggctcatgcctgtaatccctgcactttgggaggcttaggtgggcggatcacctgaggccagggtcaacatggctaaaccctgtctctactaaaagtacaaaaattagctgggggtggtggtgtgtgcctgtagttccagctacttgagagtcttaggcacgagaattgcttgaacatgggaggcagagcttgcagtgagccaagatcgcaccactgcactccagcctgcgcaacagagcgagactgtctcaaataaataaataaaatataaaaaattcgatgtaagcaatttgattttcagcttgtgtatcatgaaggcttctttagccatgaaatttaagacattaatcatttattaatgtacccggcaaatgtttattgaccacctattatgtgtctgatgttttttaggcattgggaattcgaaagtgacacagaagtctcttcatgaaacctccgtctgggtagtggacggatagaaatgttcatgttttgcactgagctttcctagtaccctgtgagttgttgttgttgtcgttttgcgactgagtcttattctgtcacccaggctggtgtgcagtggcgtgatattggctcattgcaaccttcgcctcctgtgttcaagagattcttgtgtctcagcctcctgagtggctgggattacaggcttgtgtcaccatgcccagctaatttttgtatttttagtagagatggggttttaccatgttggccaggctgatctcaaactcctgacctcaagtgatccacctgtcttggcctcccaaagtgctgggattacaggcgtgagccactatgcccggtcccctgtgagttttttggtctttagaatttggtttaactatatattaggaacattttcttttattacatctctgattattgctttttttttttaaagtttgttttttgctcttcaaatacccctgtgtggaattgcttgttcgtccacactggtttcccattttctcctttttatcgtccatgtctttttcctctgccttctttgaatatataacaagtttgttctctatgtgcacttacacaaatatgcatttttgcattgacatttcctatctttaccatttccaatgcactttaaattctgctgttgcactttcatttccttttctttgggtctcatctagttccctttttatttctgcttctctctaccagtttcctctctgctgtcacgttcttttattatctaatcctttatctcttgtttgaatctatttttaaaatttttattgaaccgtatgaaacagatgctgcctaattttaccattcttttgctcaatattttcttttttataaatatgctcattctttgcctgccgagcacaattttcctttccttccctctccttctttgtagaatcattttgcagtttttcccccccattctggattacttatccttggaagataaaagttctgtctaggtctgatatttccttcataataaaatggatggccttccctttgatcctccttttcattggataatgttagtatgtttatgtcagatctcagtatgaaggatttactgctggttgggtgacccagtgtcctttgggcagcagctgtgagaaagcccaccaccccgtgctttatttctgagcattttgctatgattggtgaagctgttggctttgggcctggcttctttatggcattacagcctaccaaggcaggaaagaggcaagccccttctgtcaacccaggctctctgccagatggtaccttcaggtcctgaggcctctacttcgaagtccttccccattactaatctacagtgggctaaagaaggactattattattattattactattattattattagcagtagcaatagtagtatatatactatttttttttaatatataccttgttgcctatcagattgcctggtgaggttaggggcgtggtggttcatgcctgtaatcccagcactttgggagactgaggcaggtggttggcttgagtctaggagtttgaaaccagcctggggacatggtgaaaccctatttctacaaaagaaacccccaaaattagctgggcttggtggtgcatgcccgtagtcctagctactcaggaggctgaggtgggaggattgcttgagcccgggaggtggaggttgcagtgtagtctgggtgacagagtgagaccctgtttaaaaaaagagagagaagaagaagaattgtcaggcgaactcttaaaaaaatacagacgttgaagcattacttcaaatctgctgatgtctgggtgattctgatgtgcagtttgggaaccactgggctaaatggctccagatggagcatgggtcattgatttgtcttgtgacctgtcttgatttttccatgggctctagttctcctccagttctttcttttgaaactttgtgactacattcctttgcttggaagccaggttgcatagtaggtcttagggtctttctttagccccggctcttccatactgtgctaagctgaaatgtcttcatgtttccgccttgtgtatggcaaccgacccttctttccaacccagatgcaaattttgacccatttttacttattctccatcacttctgtcaggcttgggcgtgggaagtgggagccagatgcctttgttcacattgccatcttcccctgaattcagatgataatgactatcttacgtgaaaatcacattgagatgtgaactgtgcagacagtacttctgcttctgttctgcctgtacagagacagaagctttatgtggtatttcttacatacatgcatttcttacatgcagacacttggtattcctcacaatcacatgcatacatgtgaccatttttatttctgatgtccttatgaaatctttaaaataaaagttgtgaagacaaaggagagcacatatgataggtcttcaaattctctctcataaccatctttctacactttccaattataggcaggaatattttccccagctggctgccttgtgctgaatatgtcagtgatattgaaaatgctgtggacaattctgatcttgactaaaataatttattgttctcattcttaggtagcagaaactcccacgggagaaatacacatataaaaggtagttataaaatagcttctctctggtagacatttacacctttctcattggtagaaaacatgcagtcttgtttgttgggaaatttgctttttcttgaaaatcactgatattattcctgactctctgttatttctttaattcattagtaataaatctatccttctaaactatattaagaaaatagaacattgtaagaatgaattagactgcaggaggtatgaaatgacttttttctgtacaatggttaaaacaagtctgctttctgattattttattgccttagtactcagctgagtagctcttgaaatactgtctgctgtgaaagcaaatttcctcttgcttggtcatctactttctggttattttctaggttggaaagcacttgctctgagagtttaaatctatagcctttgatttttatttgccgttttccttattctcagactttctggctactgctatgcttaccttcatgacattttcctatggacgatccaagcgataggattaactttctaaaaatatcacagctttctttattaatttatagcaatttttaaatatttcatttgattaagcagcctatgacataagaaaagcaagctgaattacttgattttacaaacaaggagactgaggttcagtgacttagctaaggtaattacaattgagaagctggagagccaggacttgaagctaagtctgctgatgccagttttaatattattcctgttaaacacccaattggctctcttaaggtgtcagagtttcacttgtactcagccatgatgcattttgctaagatggtgcaagctgtctataactctctctcttgtcttttagaagttgatctcttagaagatgatggaagtttcaatatttcaatatttaatgaaacttgtttgaaattgaacaggcgttctaggaaagttggatcagaacacatgtaccaagtaaggagatctcttatgctttccattaaagaattgtgtcatttaaaaatttgggcgatctccaagtaagtatccaaagtatttaaaaatgaatgaacttctagacagtttgtgattgttgtttctagagatggatgtaagatgtgagatgggtgtaaatgaggtactaacttgaagaaagatactatatttggtgacttgctatcattttctgtgcctggcatttcaagcttatattttattttaatgcattaaacaatacagcttattttgctatcagattcacatttgggcatggaatttatttttattttttatttttattttttgagactgagttttgctcttgttgcccaggctggagtgcagtggcatgatctcggctcactgcaatctctgcctccggggttcaagcgattctcttgcgtcagccttcctgagtagctgggattgcaggcatgagccaccacgcccagctaattttgtatttttagtagagatggggtttctccatgttggtcaggctggtctcaaactcccagcctcagatgatctgccctcctcagcctcccaaagtgctaggattacaggcgtgagccaccacgcccagctgggcatggaattttaaggaactctttggatggctattgaccctcatttaacttgattttttcttaaacatcatcagtaaaattgtaagtaaattcaggcaggaactgagatttattttgtgtcatttttagtgcctagcaagtcatctggtagagagcaaactcagtaagtattacattaaaaaaatttttttttcttttttgagaccgagtcttgctctgttacccaggttggagtgcagggaggcgatcttggctcactgcgacctccaccttccaaattcaagcgactctcgtgcctcagcctcccaagtagctgagattataggtgtgcaccactatgccctgctgatttttgtatttttattagagatgtcgtgtcaccatattggctaggctggtctcaaactcctgacctcaagtgatccacccgcctcagcttccctaggtgctgggattacaggtgtgagccaccgcgcccaggccaaaattaattaatttattctatttaccagaagtatatcacatattaggacttggaagtttccaattcaaactgatagaaatatataggtaaataggcaactacaatatggtataatgagtgctttgacaaaaagtaaattaataatggaataataaaagtaaataagtataaaaatagagattttatttgtgtgtgtgtgtgtgtgtgtgtgtgtgtgtgtccaggtacaatttttttgttttttttgagatggagtcttgctctgtcgtccaggctggagtacagtggcatgatcttggctcactgcagcctccctctcccaggttcaagcaattctcctgcctcagcctccctagtagctgggattccaggcatgccccaccatgcccagctaatttttgtatttttggtaaagatggggttttgccatgttggccaggctggtctcaaacacctgacctcaggtgatccagctgccttggcttcccaaagtgctgggattacaggtgtgagctacttgccaggccaggtacaatttttttaaccagaagcaaagactgttatactgagtcatagaaagtaagtaggaattggccaggcgtggtggctcacgcctgtaatcccagcactctgggaggccaaggcgggtggatcacgaggtcaggagatcgagaccatcctggctaacacggtgaaaccccatctctactaaaaatacaaaaaattagccaggcgtggtggcgggcacctgtagtcccagctacttgggaggctgaggcaggagaatggtgtaaacctgggaggtggagcttgcagtgagccaagatcgcaccactgtactccagcctgggcgacagagcaagactccgtctaaaaaaacaacaacaaaaaaattagataaaggttaatttgtgtgacatgtgaaacacttttaaattgactggaaaaaagtcaatatttaaaagcggtttgctaaagaaaatagacgtattgcctaaacacgcatgaacacattatgcctcactagtaagtggtccagaagaataggggactgccagaccgtggaggagcagctctgacgatagcatagtctaggttgtggccatggatatgggtggccaaagtggagtgaaggaagttcatagcattgagctcaaagaactctgaggccaacatttgatggtttatctgtaaggacctttaagttatccaagagaattcaaagagtttgagagagaagaatccttatgaaccacctgtcagggtcttggatgactgtcaaaattgataagagaagagttagtgattgatgggaataaggagggattgagggtggtatagacaatggtgctagcatcagtggcaacaccgagcatatgtctccaccagctaatgcaccctaactgatcaagggctgatcatattacttataggaccttcacgaaagttttttccctataattccctgctggagctggcagtgcgtagaggatggttaggtgacagtgtgtgatatgactccatggatcaaaagcccttttaccagaggtctaataggaagggtccagtgaagtaccatggcatttgctttgaatgcataatctggggtggtccccatatgtttttgttttttttttcttccatgggtagggttaaggaacccacctagtttaagtactctgttctatgaggcttgtccatggatttcttacaatgaaaagaaactaaaagaattttggttgggtgcaatggctcacacttgtaatcccagcactttgggaggctgaggtgggcttgaggccaagagtttgagaccagcctgggcaacaaagtaagatcctgtctttacaaattaattgtaaaaataattacccaggtgtggtggtgcatgcctgtagttccaactactcgggaggctgaggatcacttcagtccaggagtttgagattgctgtgaactaagattgtgccactgcactccagcctgggtgacagaacaagaccctgtctcagaaaagagacagagagagagagagagagagagagagaacgaagtattcagaagggaaggaggaaaaaaaataattttgcccattagctccaatgtaatctctttcacttgcgttataatcaagggattattttggaatagactaatattttcttcatctgagatgtagttatgcatattaagcttggtcctatacctgattgtgaggacaggtaaggtagctttgtcaagtccttcctcaggttagcttgctattgtcttaaaagtaattctaagtgggcaaggataaataaaaggaactttcttgttttaactccattttgctaatagtctaggcacctgttagtcaatggaaaatctaatgtaacactttcttttaatctcatgacagtttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcaggtgggtgtagacgtctttcttttttgtgcctcaggacaaattacctatgtgaattgagcagtgtgggcgggcataagagtgctagtttgggagtcaagagacaggggttccagttctaacaaactttgttagctgcgtctggggttcaggatgcctgaatcttaccacttatccccttccctgaagggtactggctcatagagggcacagaccaaggatagactgatttattcagagctccctgggagtcctaagttgagaattccataaagcattttatctctcaccccaaatttaagacaactgaaccctaagggtattcattatcggcaagtagaacgaacttccaggagaccagaaacgtgggtcccacagtgtcaggcactggcaggcaatacagcctcaggactaggccacgcataagcaaattaacttgacatagagaacagaggcctgattaaggtcaggctccttagaaattcttcccttgcagtcttttgaggaagccacataggtgccagctgtattaactccacagctccccctagtgggatggctgtggtgcagccatcactactatttcttttgttctttaatcctgtgggtttatcagacaaatttacgggcaaccagaagaggctacccctttgaaggaaagcagcagaagagggtaggtcctgctgctacctccctgaagccgctctgtgatattcacctctgctctttgtgggtcagggtgggcagtttggcctttgcatttagaagactctgggccgggtgcggtggctcacgactgtaatcccagcactttgggaggccgaggctggcagatcacctgaggtcaggagttcgagactagcctggctaacatgatgaaaccctgattctaccaaaaatacaaaaaattagctgggcatggtggtgtgtgcctgtaatcccagctactcgggaggctgaggcaagagaatcactgaacccgggaggcagaggttgcagtgagccgagattgcgccattgcactctagcttgggcaacaagagccaaactccatctcaaaaaaaaaaaaaaaaaaaagactctgaaatgtgttagacactcatgagagccacgtagcacctgaggctgaaaattaattttttttttttgagatggagtctcgctctgtcacccaggctggagggccaggtgccatcttggctcactgtaacctccacctcctgggctcaagtgatcctcctgcctcagcctcttgagtagctgggactacaggcgcataccaccatgcccagctaatttttgtatttttagtagatacagggtttcaccatgttggccaggctgttctcgaactcctgacctcaagtgaggtcttccaattcagcctcccaaagtgctgggattacaagtgtgagccaccgtgtctggcttcagtttttatcctattttttttatcagattgagcctggcaccttgtcctgtctgtatcagcagagtttgcacaaggagcacctcatgacatcataaacctaccccccaacacattttcagctgcatagtaatgctcgcaaattgaatatgaattccctccaattattaaattcttagagaaataaaaatctataaataaaatctagctgggtgcagtagctcacgtctaattccagcactatgggaggccaaggcgggtggattgcttgagctcaggagtttgagaccagcctgggcaacatagtgaaactctgtctctataaacaatacaaaaattagctgggtgtggtggcataagcctgtggtcccagctacttgggaggctgaggtgggagaatctcttgagcctaggaggttgaggctgcagggagccgagattgcgccactgcacttcagcctgggcaacagagcaagatctcctcagataaagaaataagaataaataaatccacctctccttgtaaaataaactaaaatgtaaaggcgtgaagtccccagttttttctatcctacatcttttctgctgagtcttggccagagtgtcctgctgagtggagtgtgtgttctagctgttgaaacctaggaatcttgttttgtaatagatgctactcctttggtgtataggagactggcaaatgctgaggttttgaggcaggcacatacttggcatattctaggaatgtcatggaaaccagtatggctggagcagagagctggggacagtggtgagagatgaggtctaaactctagcatgagtataataaatgagaggcccatggtgtcaggttcagaaagaagcctgttgttaccttctcctttgcctccctaaattactagtagtaagtataatgtagcatgccatagttcagcctctgtaggttaccaagcagtctggagtctaccacgtgtcaatttaaacttaaattgggaaatgtcttctcgtcagggtagttggattcattttgacactgtactctccttgaaaattttagacatttgcagtggtggctctaggtctttcttgatgcccgttccaaagattaaaacctttccattttcgttgctcccttgagccctatttctacccaagcttcaccattgctgaagatctttatctgtttagtgaaagagtctcccttctttctgggcaggacaccccacatttatcttaggaaactcttcaagtgaaatgcatcatcttgcatgcttccttccctgtctccatttctgactcttttctctgaatttctctaaacccagaaagatcccccaaattgttttagttctggactccacaggctcctattattgaatgtctgcctgtgagtcctacttcctggttaggagattttcccttttgtctcccatggggaattaccctcagctgatctgtgagctgctgttgggtttccagaacctgaactttcactggtctgatgaggtccaggaaaccccctgggctagtggcatttcgcccaagccctaccttcttggaattgaatttccaagacttaaatggtcggtgcttctttgatggaaactgaaacacttcttgctcccgcttccttttctgtatcagagagataagcctgcaatgttcaaggtccctctgagaacgttcttacttagcaggtcctgctcagctctaagcctttacccttccatttaagttgtttctgttccgtctttattgccaggtaggactcataccttttgctaggtcttagtacttttccttctctatatttgctttttgttttcagacttagatttttgttctcctcacatattactttggaatctgcctccgaggtctctgtagagaaagaatgatgtcacagagctctcgacctgccataaacatccagtgttaaaataccttcttcccactttcattttcactaggaggcatttctttctattcagttcggcctaaacccaggcctgggctttatcaattttcattctccctggaccttgtttaatacagctctatttcccgggcagatgtccttatagccggtgcaatacctgttgccccatcttacaaaaacaatgccaccttgaaactcacttagtgatgcttgaagaattctacactgatcattcactgatgattctctttttaaacatgttcacatttctttaactatagagtatcacagttccagttattaaggaagaaacgaagagttctcattaatgcctattctcgctcccctatttaaaacttttccttgtcatatttttctaactgggccaatatgatttcaaattttcttcttagtgttatttccttcactttgtttcattcctcctaatcttatcgtttctccctaatcttatcctgtctgcaagaccaaaacctgttttgtaaactgacttcattctattttcagagatggggaaaatctcatttctaggaacagagttctaggtgtacactttttgctatttctttttagcatttgagtttgtaataattccactggactttttttctactttagcccccaaagagtttcttatctagaatccccagtctgagtttctgtgaaacagatcatccagggccatttaaaagcccttggtgtgggggtgaactcagcctgtggagaaaccgtggatccagtctttctacagttctctccttagccctggatgaaattccaaacaatataaagagaaatggaattttggcaagctaatctaatgttgtctactaatatctagctccccaaaatgctctttaaaacctcccaccattgctccctttgtgcatcttaaactttagcaagtgtaatgattacctggagagcttatgaaaacactggttcctgggccccatcccagaggttctgattcagtaggcctttggggaggggagcaaattttcatttctagcaagctttcaggccttattgatattgtcagtccacattttgagtcgcattgctctaaccacataaaccttagctacttccgggcaatgtcaaagctcttgcaggcagagacataataagaaaagaaagactgaaataaaaaaaaagtggtagctaaaataattccatctgctcctgcctaaaaagcctatgtcttagagctttgtctgatttgcaaagttttcctggtaatcagatatctacctacctcatctgttcctgaattccagctgcagagaccaggagctctcatcttccatcatggtgccttgctccgctgtggcagctcttatctttatactcaaggccccagtcagtatatctgtcttttgcagggagatactgaatcttacctctcctttccatctgagattaacaggacaaacagatagataaatgacaaatagaggatcaactttattgatctgggcaagtttccaggaactctctccaaaactgaatttcaggtaaaagctatattgaaggatgaggtttagctattgtggccaagtggaacttcctacttgctggaattccccctggaaatatgggcagttgggtctgtaagggacccttgcctggcttacccacccagtctcaggccgaaaagcagaggaaagggcggtgacagacactgggtgcttacctcttggagaccggagatacccagagtgctccttgtacctgtgcacaggcgggtcccagagagcaagtctgccttttgtttgggtggcaacctgtaatatatgaacttattacttggaaatgtgactcaaggaatggcagtctcctaccaattagattacatatttactgttccttccttgaggattaacatatagggaatagggagaagccaaaattgccttttcccttatggaattggaaagacaggtaaatagcaacctttaatacactcaagcaaggtcactgatctctgtaattatcttgaacaggaaaggtccattatagttctaggagtctatgttaggaaagcaatttaaattacttttaggttccttcaaattcatttgttttgaaggaaaaatttgtccaaatttcttggttaatttaccatcactattttatttattgatcaaattttgtgttctcatggacatagatagtttattcatatactgagagcatgacttctttgattattatttgtgttgcctttcttctgttttatggtttctttcaattttgtttacgatgtttttgacatataaaagttttagattgctatacagtcaaatctattgatcttttccattgtgattcattacattgttattaaatgtagaattttttaaaacaaaagagtatttatattctgtcttatttctaggaaagactttaagtgacctgcatgggtatataaaataaacgataataggttagacgtctaggctaaagaagaaagaaaacaaaaacagagacataaaaaatataggaataaggttaagaataattcatgcccttataacctatttacttgttcattagtgcctctaaaatttaggtttgagttttcccatccagccagaaagggaaccattgcattgtccataatgttacaacgaagcagtgtttttcagaagcacaattctttttcaacattaagaatcagttagaaatttctgattccagggggtctcataaataggacagtgtctgagcagcattttatgaggattttataaggctatttttttgtattgcccctgaacacagaaaagcacaattcagtgtagagtggcagaaaagatgcattagaaatgcctgctgtttgctgatctggcttgattcaggggtaggattaggttatttagattatttggaggtatgactggagtccatttctttcaagcattgttttctaaatattgtttccctcaactgagatttgatgaatgtttggtgtcactgagctagcaactgttttctcttataagtacccagggagcaattgttctgtgccaccaattgaataacaaggacttgtgcttgaattgaacgctggcctcctctgctggaaggttgagcctggggagctgagccaagggaattgtttgaatctgctctgccaatgaatgggtgattgaactctcaaaattcctctccttgtaatatagtcacaggtgtttagcctgaaaaatttcacagttgttctgaccagataccaaatttgtctaaagaaaaatttcaataaaataacagtaaagctcccagctttgaaccatattatatcttgttgccctctttaagataaactgctccccaaatgtaaatcaaggataactaagatgataccactatttatagagcagttatacaatagtaactttgctttcaggatagttgatttatagccattctttatgacaatatttagcttgcaaagccaactgtctatataggctacttctaattagagatttaaataccgctattatttatgtacaaaagaatgtttttattcagttctttttagcagaagattgcatgcatttagatattcccaaaataatgttggtaagttttaaaaaatcctacaaggagaaggaacagagcactcttcccagggagtaaagccctggtagaaaaccattactcttaaggtggctttctgctgcaggttttgaacagcatgcataatttgagatctatgtggactttataaaacttcccccataatggattcctgttcacagaattaaagtccaaacaaaagataattaagaccataaatcatttaatgttgtttctgatatttttccacagaatgataaatattataacagtattctgtggttgaagagttatgcctgaagtctaccttcttttcttacaaaccattagcctgagaaacccatacttgtagttggtcaagccagaaattggcatatattttacatggaatatacaatcatctgaatgtgccaagtatggagagagtagatgtttgttcttttaacagataagatagtgaccttgtagatccagctcagtgggaccatatccattacctttactcataaagatgaataagttgcttagaattggagccttcagctaaatgggttctaagtggctctgaaggcaatagattcatctcattctttttagtaccttcattttctaatcatgcgtatagacacagactccaaaactgttctctcctaggctagaatcagagaaagggtcacatactttttagtctaaaatattccttagtgccatgcaaaggaaagctaactacaagatattttaacaacttttatttacttataatttttaaatttgatataatttcaaatttttctctttcttgcacttctaccccttcctgtaatatatcccacttggtcattgtgtattgtcgtatgtggcgttagattctgttcactaatattttctttagtatttttgcaccaatatttataagtaatgttggtctatacttttctctattttttttgacactctttatcaggtttaagcattggtattttcctttcttcataaaaataatttgtaaagtttccttcattatttatgccctgggacaattcacatagcatttggactatctgattttggatgatttggtagaatccatcaaattctatgaaatgatctgggtatggggcttttctatggggttattccttgatgacattctcaatttttttctatggaaattggtcggtttaagctttttctgtctaatggagtcaattttggcaaaccagattttgcaaggaattacctatttcgtctaagttttaaaatttatttgtacactgatctgcaaagtagtttcgtttaactttttgaattttcttctgtctcagtgatcatttctccctttatctttattttctgccccttttctagattaaattagctaagtggtttgtttattttattagtttttctaagattttggtttattaattggatctactattttttttctgtctcacaatatcagggattaacaaactatgacctgcagaacaaatctggcctgtcacctgttttcataaatagttttactggaacaaaggcagagttgaatagttgtgacagaactgtcagcctggaaagcctaaaatatttacttatctggccctttatagataaaacttcttgattctcgctctatatcattatttctgctttcttttcttttcttttctttttttttttttttgagatggaatcttgctctgtcacccaggctggagtgcagtggcgcgatctcagctcgctgcaacttccgcctcccgggttcgagcgattctcctgcttcagcctcccgagtagatgggactacaggcatgtaccaccacgcccagctaatttttgtatttttagtagagacagggtttcaccatgttggtcaggctgttcctgacctcaggtgatccaccctccttggcctcccaaagtgctgggattacaggtgtgagccaccgcacctggccagtttctgctttcataactattatatcctttcttatactttcttttgctttacaaaggtggttgtactatatcttcattgtgacttgtggcttttagcattaaaagtggtcctttgtcatatttaatgctttttgatttgaattctactttgtcttatatagagattgcagtgcttactttcttatagtttcaactccatcctattattttatgttacaactgctatatgtattgtgttatattttctgcatttctttctctgtgtgatggattttctttgctttatttattaatttttaaaggaaggtttacatttttctagtggttacctttatacctttaaaaaacgccctctcttctgttttctcatttaacttttcaccatctggtttgtcaggttttttgtttgtttgtttatttgtttgtttttaagacaggatctcaccctgttgcccagactggagtgcagtggattgatcatagctcactgtagccacaacttcccagactcaagtgatccttttgtctcagcctcctgagtagctgggactagaggcataagccactgtgctcagctaattttaaaactttttgtagagacaaggtctctctttgttgcccatgctggtctcaaactcctgacctcaagtgatcctcccacctttggcctcccaaagtgctgggattacaggcgggaaccaccacactcagctggtttgtcagtttttgtttgtttgtttgtttgtttgttttttgagatgtggtctcactcccaggctgaagtacagtggcatgatcatagctcacaacagccttgaactcctgggctcaagtgatcctccgacctcagcctcccaaatagctggggctacagccaccatgcttggctaattttgttattttcattttctattttagtggagacaggttctccctatattgcccaggctagtcctgaactcctggccttaagtgatcctcctaccttggcctcccaaggtgctggagttaacaggtctgagccactgcacctggcctggtttgacagtttttaatggcatactttaattcatttattgcctttatgacattcaactattgaatcaactagtttattctattttcctttttctgcatcccttttcctctcagtttttcagttgcattatttctactttatgaaaacatatagcatttatatatcactcttccgcctcgccccatctttatttttgtcttagagctacaattgaatacagcaaatgcttatcaccaatccttttactgaagtttcctcagtttatctcttggatgaagctcattttctagtagattccttaagagcacagtattccttgagttcttggatatttagaattgtatctgtatagccttgatatttgaaaggtagcttggctagatataaaaatcttaattcacactttcttggtttgagtgtcttaaaaagattcagttcttttcttgccttgctttctatgtagcttttgagaagtctgatgcagcctgattcttttgcccttggatgttatgtttatttctttgagtgaagaccctgaggatttcttcctttatctttaaaatctaatagttttacttggatacattttggggttgattgttgtgggtcagatttcacaggtacccagtgtatccctttagtatttctactcaggtctctttattcttgtaaagttatcttgaattgtagttttaaacactaattctgtttcatgcttgtttatcttcttcagataatttaattatacatgtgttggatctttgcctatattccacttcattcactttatttttgacccttttaacttctttttgatctcatttttattattttcagttgttttcctatatttcttcaatgccttttattcaatctacccttctttaggcaccatgaaatttagtctttattatttctaatgtgattttgtattttcattattttttcctgaacttagtcacctgtttcatttcctccctattttttgtgtccatttatgttttaagttttaaatttcctaggcctggctcagtggctcatacctgtaatcccagcactttgggaggccgaggtgagcggatcacttgaggtcaagagttaagaccagcctggccaacatggtgaaaccccgtctctactaaagatacaaaaattagccaggcttggtggtgcacacctgtaattccagctactcaggaggctgaggcagaagagtcacttgaacccagcagggttcagtgagcagaggctgcagtgagcagagatcgtgccactgcactccagcctgggcagcagaaagagacttcatctcaaaaaagaaaaaaagaagttttaaaatttctgactcaaggagttttcttcatatccccaaatgcttgaggatacttatttcagtttattaatgtataggactccccctccaccccagtttgtgggtttaaaaaaatgtagagctttttacaagctgcattgtttttattttatatgtatattatatatgtatattttatatatgtatatatatataaaatacaaactgcttttgtctgttaattcccaggacagaattgctggtttaggatggttaacaagatttctaggttaagagtgccctcttctgtcactgagtgaaatgcagtttctttaaaggttttttttgtttgtttgtttgtttgttttgataagactgggcatgaatcatgtattcttctcattttaggttctcttttgccttgtaggatcttgcatttccctctcgcttctgttgcccaccactgcttagtctccaaaggacacccattccttcccttttatccttttctttcccagaagcaatgccgttttcttaccactacctgacaactcatggacttttaatcctttccttgtagtcagtgctctgtctatacaccagatctctctctctctctctctctctctttctttctttctttctttctttttttctctctctctctctttctttctttctttttttcatagttagagtggagtttctcttgctgggagtgaacctagcttactctgggccaccttgcttccctcttttctatttcacacatcccttctatcacccctcactcttcacaaggacttgtgggagattgagagataattttgctggaatttcatatttatttttctatttaacagatttttttttttttttttttgaggcaaggtctcgctctgtcacccagcctggcaggacacatctcactgcagctttgacctcctgggctcaagcaatctttccacctcagcttttcgagtagctggtactacaggctcccgccaccatgctcagctaacttttttattttttgtagagatggtggtgagaggggcgggtcttgctatgttgccaaggctggtctgaaactcctgggctcaagcaatccttccacctcggcctctcaaagtattgggattacaggtgtgagctactgtacccggccttaacagtaatttaaagtttgtaatgttttctattttccttttatgatgacagcttctgttttatgttgttttattttattttatttttgagacagggtctcactctgtcacccaggctggaatgcagtggtgcaatctcggcttactgcatatgttgttttatttgatcttcttgctgatctgaagaatattttggaggatgcgtagtgagttatatttaaggggccaccattatctttgatgattggaactctgatcggtaatatattacgtgctaacttttccacctccgtgtctttgttcatgccatttcttctacctggagcccactcccttttcttgagttcatagatttctttcttccatgatttccacttcccacctttcaagctgataagtatctttctttctgaattcccgtaacctattttaacaggaagtataggtagtagtttggcacagttcctctggagtcagatgatctaaattcaaatcccagatctgccacttactatctctgtaacttcggacaagttatttcacctctatgtgtcccagttgccttaactgtgaacatgggaataacaatatccatatcgtgggcttgttgtgaagaccaaatggattaaagcacatggagaaacagcacaatacctgacacaagatgaatgtctatcaaatgttaactattacttacatttactttctgacatttattatatactcccttgtttttaaaactgtacttacataggccataacttctctcctaggtgaaatgcatgttatgggcagaaagcatgtcttactcagagtacttatattccactgggtcaatgcaataccatttgcttagctttccccttattgctgattgcatttgaacaatcatagctgctgtgattgtttaaatcactgccctagacactgagagtgcaaagattaagaagatgtctctctcttcaaggagctatcagttcaatgggggtgatagacaaagatcaataatacaatatatgaagcatatttgaggtatttgcagggtaccacaggagcagagaggaaatagtgattgattttgccaagagtcgcttgcccatacaaatgaagcagaaacaaagtttcgttaagagcttaattttctcttttttgaggcattcttgcagttctggtttttcaacttcaggattctagatcacattggcccagcgggtggagaaaagagagagaacacagagtaaccactaaaaatgcattagagaaggaagatttgtatgagagaccaccgcacgtatctttcatagcaaaggatctgagagcactaggaagggacttgggatgagctctactggggatccttttctcctcattgaatgcatcatgggttcaacctgcctgtggctgaaactgtaaagccacttgaatggagggaagggaacctagagtgagaatgtcactccctgacccgggtggaactgaatgaactgagccagtgagacatttcctgtgagcagaaggagctgcagactcaccactactgttaggttacttgagcatatgtgtgtgtgtaattttaaaaaatgaaataattatatatatattattcttcattttgcttttttatattattctttgacttttggccttacaatatcctgtagacatacttccataccaattcatgtattgtcatctcattctctttgagggaagcacagtattctatcacataaaggtatactaatttattaacttattatctatagaaggttatttgggtattttttttccctttcaagtttttgtcattacagacaatgctactgttaatatgcttgtatatattatgttttattgattctcagaggcatatttttttcacattttggtatctatgaaatcctacaattgttatacagtcagtcaggtggctgccaagaacataattgtcattgtccatctatgcatcatattggtcatagttgctcatagtgctgtcacttctatttagttacggacactagtggtgccatttatttcttgagatcaattgcctactaaaactttttccaaaaagctacattatgatttgacattgagacatagtgttataatatgtaaagcgcaatgggaacagaacggcaaagtataagatcaactttcagcatcagaatgggtgtcagtggatggcgagaaagttctggaaacaaaaagagcacattttgaagaaatactgcctcaccaaactctggatagatagcacataggatgttattatgtggaaaaatatagacaccaacaactcttaattgagaagtgattgagaagtgtttgttatattctgaccgtgaagaaattttaggaatgtctcaattaattttgcttatatttttgtcttataatatacaattaaaatttaatatctatgttggtctgtaaaagctttttcaatcagtataaattagttccgtgagataagaaaataattgtggtggctgggggcggtggctcacacctgtaattccagcactttgggaggccaaggtgggcggatcacttgaggtcaggagttcgagaccagcctgcccaacatggtgaaaccctgtttctactacaaatacaacaattagccaggtgtggtggtgcatgcctgtagtcccagctacttgggaggctgaggcaggagaattgcttgaactcaggaggcagaggttgcactgagctgagattgtgccactgcactccagcctgggaaacagagagagactacatctcaaaaaaaaaaattctttaaaatcttcgtgtaacttttggacatttctagttaggtttatttctaggtatttgaagtttgcttgtgatatcccatctcatgaatatggatctttttatttttctattatattctgctacttgttgtattagttttctgttgctgctatgacaagttactgcaaacttagtggcagaaaataacatgagggctgggtacagtggcttacatttataatccagcactttgggatgctgaggtaggaggattgcttggaggctgaggtgggagcccaggagttcaagcccagcctgggcaacatagaaaccctgtctctacaaaaaaattaaaataaataaaaaataagccggacgtggtggtgtgtgcccgtggtcccagctacttgagagactgaggcagggggatcacttgagctcaggaggtcaaggctgcagtgagccatgatcaggtcactgtactccaacctgggtgacagaacaggaccctgtctcaaaaaaacaaaacaaaacaaaaactaaaagcaacatgaatttagtgtcttatagttctggaggtcggaagtgtgaaatcagtttcactaagctgtaatcaaggtgtcagtaggcctgtgtttcttcaggggcggggggtatctaggggagaatctatttccacgccctttccagtttctagatcctgcctatactccttggcttgtggctccatccgccatatttaaagctcatcagtttaacctctgcttccgttcttaaatcttctaactcttatgttcttgttgctctcttataaggatgtttgtaatcacattgagctcatctggacaattcaggataatctcactgtcttagtcacctctacaaagtgtttctgccatgtaaggtaacatacaggttccagggactaggatgtagacatgctggtggcgggtgggggtcattatttaacctaccatacttgttcttgaagatagatagaaaatgatcagtttttgtatgttgcctttctgttattttcaaacagtttcatgtttgattagttgagtctcttagatttactggcagttgcatcatttgttgctctttctggcatttatagctcatttttttttcttgcctttttctgcattgtctagaatctcttgaataaggctcagtaatagctacaagaccagacatccttgtattgttcttaactttactagaaattgcttaattgctttaccactgagtgtggtggtttcttataaaccctattaaactaaggcgtttctgtcaaatgaagtcctagctcactaagatttcaagttaacaaagtatattaaatgtattaacagttccatttataaaagtaaccacatggtttctctcttttaacctattaatagcttttccaataatgatactctctgtattctgggaataaatctttggtcgtagtgtattgttctttgaatgtactactgacttctttgtgctaatattttattttggatttttgtatttatatcaacaagcaaatttggcataggatgtttagtgattggctgtgccatccttgtacaggtcgggcattgtggattatttagtcatattaaatgatttggggacccttccacctttttgtatagtctagaactgtttaaatactattggagttatttgtattttgaaagtttcagaagtgtaactttggaccactactactaatctccaaacctgtctctacccagctgtgggtctgcattaacctggaatcatctgtactcctcctgttccttaccacctgttcatcttttcctcctgttccctacctgctccgtgttgcaacatttgaggtacagcttgtgacttgtacaggttttctttgtgccaagctgcccaatccatagagaggagtcgtgtctaccaacttggcttcatttgtaggaacctgtcaggccagggagttacaaaatacagccttacctttcatgagaccttccttttttcacgtaatttgggagttgtctttatcactcgttaatcatcacagtgttcctgtgaaacttcttagcaagtctgctctattatttccactttagggacagagatcattattgaaggaagtaacctctgatgtcagggttttgaataaatagtctttcttgactacttggatgggtgtacctccacattaaactgtatcagatctgaactgtcttttagattgattactatgaaactgagcagaggacaagaaatatttctttgctcacaagagataaggaagcccaaaccaagagaatcccgccacctcctattcttttcctcatgaaaaacctgattgcttcaaagcacttttttcagttcctcaaggagcaattctctgctgaaatgttgctcttagctcagaatttcgaaccgacacttatttgtataaatgagggtatacaaggtccaggacaaatagttgtaattttagcttagtaagccaaggaagcttgcagtaaatagactcaaataatttttttcctttttcttttcttttttttttttttcttgagacagagtctcactctgtcacccaggctggagtgcagtggcacaatctctgctgactgcaacccccgcctcccaggttcaagcgattctcctgcttcagcctcccaagtagctgggactacaggcacacaccaccacgcccagctagtttttgtatttttagtagagatggggtttcgctatgttggccaggctggtctcgaactcgtggcctcaagtgatctgcctgccttggcctcccaaagtgctggggttacaggcgtgagccactgtgcccggcccactcaaataattcttaagaggggtcctccgattaggtatctttggatctgaaatctttcatcaagactgagtttacctagatataaaagtggtattactttgagactgctaccactaatttctaaattaaaatactgttgaactcatgctaacacttatccttggaaaaatggctcaattaaaaggtagcattttttctatagagtgtaaattgatttctcatttcttttccactacagtaaaacagaccatcagtaacatttcaggatttaatgaaacctgcttgagatggagaagcatcaagacagctgatatggaggagatgtatttagtaagtgactgaaagttactgtatttatagatggttgtcttatgtgggaggcttaaaaatacccacaaacctaaaaatctacatctataactatcattatcagtagacgatttactgtgacaattgcatcaagaagcaagaagatggccacttctgtgtatttaaagacagtggctgggcacagtggctcacatttgtaatcccagtactttgagaggctgaggcgggcggatcacttgaggccaggagttaagaccagcctggtcaacatggtgaaactctgtctctgctaaaaatataaaaattagccgagcgtagtggcgcatagctgtaatcccagctattcaggaggctgaggcaggagaatagcttgaacccaagaggtggaggtttctgttaaccaagatcgcgccactgaaccccagcctgggtgacagagcaaaactttgtctcgaaaaaaaaaaaaaaaggagggggaagactgggatgaacttctactggaagaaattaagtaagaacaaaagggtgtctcttggccgaagtgtcagggtggttaaggaaagggtagggtcaccagaagctggcaggaagaggagaaaaactgttctcaggttctagcagaccagctacgagtattctaattcaggtcctgcttagtttggattcctaatattctttctaggaaaatgttcttgtccttgctcctgcagttttgccaatagactttcttgttgtgtatgtgcactgtatgtgtgagaataaggagaaagctgccagtattgggaccttagccttttgtgtgtttttatttaaaaatatatttattatacaaataatattttaagtacaatatttatagtattgcaactctaatatttgcttactgctgcatttcaccttttgaagaaacattagagtccagagagagagagagaggaagaaagctcatgaaaacgggaaggggctgggcgcggtggctcacgcctgtgatctcagcactttgggattcgaggtggcagatcactagagctcaggagtttgagaccagcctgggcaacatggcgaaaccctgtctctacaaaaaatacaaaaattagctggatgtggtggcatgcatctgtggtcccagttacttgggaggctgaggagggaggatcacttgagcctgggaggttgaggctgcagtgagccgaggtcatgccactgcactccagcatgggtgacagagtgaggcccccatctcaaaaaaaaaaaaaaaaaaagagaaagaaaaaggaaaaggggaggtttcaaggcatctaaagccttttaggccaaccattcacccagtgagcttttttatgtttcagttccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacaggtaaatcttgaataacagcatttggattaacaaagttaccacagaattgttcataggtcctgataaagaggaacactgttgctttttatcattatataatgaactttaacagggagaggaggaaggacatggaattggagaggtgccttaaggcgcctctgtgactgttatgtttcattcttttttctttttttgaggcagggtcttgctctgtcgcccaggctggagtgcagaggcacgatcatggctcactgcagccttgacctgggcttaaatgatcctcctgcctcagcctcttgagtagctgggattatagttgtataggccaccatgcctggctaatttctgtattttttgtagagacggggtttcactatgttgcctaggctggtctcgaactcctgggctcaagcaatccacctgcctcggcctcccaaagtgctgggattacaggtgtaagccactgcgcccagcctgttatgttttatttttaaaaagatacctaataaccacaggggaggtctgtggggagggggagggggaagatacctgaaacaaaatgtcagcattgatgaaatgtgggtagtgtgtccatccatggtgttggttgtatagcttctggatatttaaagcatttaaaatactttatacttaaacaaaaaatgcttgtggctctttctttctcaggaatatttagttggcatcctgttgcaagtactttaagagtagattactagctaggcacagtggctcaaacctgtaatcccagcactttgggaagctgaggagggttgatcatgtgaggatcatttcgagatcagcctggctgacgtggtgaaaccccacctctactaagaatacaaaaattagctgggtgtggtgtcaggtgcctgtaatcccagctactcgggaggctgaggcaggagaattgcttgaacccaggaggtggaggttgtgttgatctgagatcgcactccagcctaggcaacaagagcaaaactccatctcaaaaaaaaaaaaaaaaaaaaaaaaaaaaaagtagattactatcaggggacaatgattgtagtcctccggctatagggccccagtaaattcactttccactcattttctcctccctcttcacatctgtgacccccacttcacacatgctctgagcaaatactaagcatattagcttcttgattcttatttcactgagaaattagaagtagtcaggtgaggacttcccacgctcagccctgccgttcctccttgcatcctgttctgcctcccttcctgtccctgctcgtgtgtaaggctgccatcccctcaacttgtgccttagatcccatcccttcttccctgatcagcacttcccctcaatacagaattatccccagcattgcctagcatgttgcaacatcctccttgtgaacgaaaagaaagaaaaaatgagcagaccttctttgagcccatatttgtcttcagctactttgccttctctctgcccctttctataaaaactccttgaaagaaatggctgttctgtaggctccacagccctacctcctgttctcactttcactcatcccacgtgggaaacatacgtcttcattgctttactgaaaggctcttcgtttgatctccgtcttgccaaatccaatggccagttttgttcttatctgatttcttcgatagcgttgacactccctccctcttgaaaccccctctcccttagttttggttccttctgccttgctgtcccctctcagtcttctttgctagctccatctacttttatgacccctcttcagcctccttttcttcattatctaccctttctgcttaggtgatctcaaccagtcttatggctataactattacctatatgcagaggatttccaaagatcaatttctagtcccagcctctcctttgagcaccagactcctatatccacccaacttctacacatgtcctattgaacatctaatacgcaaatcaaacggaacttgtgatttctcacctctgccctcgcccccaaatcggtttccacccaggcttctctgtttctatctgttactttctgtctgttattggaatttctgttcacccaattgttcagaccaaaaacaagtcctaattggttctatcccatccccaaatttctaatctgtcaacaagccctgttggcttgctgtctgaaatatattctgaattccaccacttctccccacctgtgccttttccacaactaccctaatccaagacagccacctcttgcttggattcctgctgtagttttcaaactggttttctcttgcctatatacctcccaccctggaccttagtcttagtcttcaccataactttcaaaagatcactcagcactcagagtgatcttttaaaaatgcatttgggaacatgtcagcaccagctcaaaactctccagtgagtttccattaaagttagaatggaatccaagttcctcatcataggacatgtcatctggcccctgcctacttctaattcatctccccctgctctcctcctttcccattaagcatcagctgtctccctggccttcttgcagttccttcaatgggtcaaagtttttccagcctccagacttttccatctgcagttcacacttcctgggacactgtcaacatatggcttctccatagttgttcaggtgcctgctcaactgccatcaccagcctccacgctagtactctgtatctacttaccctgcttcaatttcttcatagagcttcatattaataaaaaatattaattattagtttttagagatagggtctcactctgtcacccaggctggagtgcagtggtgcaatcataactcactgcagccttgagcccctgggctgtagcaatccttctgcctcagcctgctgagtagctgggactataggcgctcaccaccatgcctggctaattacaaaagggatttttttgtttttattttttgtagagatgagggtctccctatgttgcctaggctggtcttgaacttctggcctcaagtgatcctcccatctcacctcccaaagtgctgagattataggcatgagtctctgtgcccagcctagagcttgttttctaaaaacttattttttttttattttctttctctcccactaaaataggagcttcctgaagacagtgatttttgtctgtatgttttacattcaaccctcagtgggtaagaatggtactgatagatagcataacagcccaaaattttaaaataacagccagtgggtggtattggtgttgaggagatgtctggttaggcaatgaattctggctaccagaaagaattccccacattttgggctggagagacaagtggtgttcagtctgggcatttctttctgtggtgacttattaaaatgaatagcgactccatctccatttcctactctgtggtctttctcatatttggatgctgtgcttttctggtttgaaggaccgttgcatatttttttgagtaaaggggagggggtttcatcttgatgagacacttactccttgtttggtaggctgaatagagctttagtggctcaagttccctctctctgtgctcatggccaccaggggacattgttgagctgtttaatgttcattgagatgcctattttccaactctacccactttaaaggactcgtaattttaaagaagcataaaaaaatcaagttgctttgatcttatgaaagagttaaaaaaaaaaaaaaaccaacccctttcttttataaaaggaggaaaaaagagaagcttatgtgttgatgtgcagagatactcgtggtttcctaagaagtgtgtggccttatttcggtaaaatcatgaacttttgaattttggcagatgtgttaggctaaggatttgggtctggacaatgtagctgctcatttcccagaaggaaagagagtggaatttcccttctgagtgtcttacgttaaatcttactgatgggaacaggatgaaaacaagtgctttaaatacatcgctgacctcagaggacagtgaaggttctaggaatgttgagggacagaggcaagtgtttcggtgaatgcaggaaagcaggggctggcgagggggtgggtgagatggagctgtggcctcacggtgtttctgactcttggctgataggctgcagacggcacattgaactgaattcttcaggatagccccacggcacgcatcccctttaggacagggtgaggaacaaactttcatccttgatgcaggccccaaagagtcagaagagcatccacatgttgagtgtgctattttctttttctttttttttgttttgagacagaatttcgctctgtcacccaggctggagtgcagtggcgtgatctgagctcactgcaacctccacctcctgagttcaagtgattcttatgtctcagcctcccaagtagctgggattacaggtgtgtgccaccacgcttggctaattttatatgtttagtagagatggggtttcaccatgttggccaggctgatcttgaactcctggccttaagtgatccgcccacttcggcctcccaaagtgctgggatcacaggtgtgagccactgcactggcctccttcccttcctttccctttccctttctttttttgagacagtcttgctctgttgcccaggcttgctctgttgcttacgcagtggtgtgatctcgactcactgcaacctctgcctcccaggttcaagcgattctcatgccccgacctcccaagtagcgggaattacaggcacacatcaccagccccgtctaattttaaaaatatatttttagtagagatgaggttttgccatgttgtccaggctggtctcaaactcctgacctcaagtgatctgcctgcccttagcctctcaaagtgctgggattacaggcatgagccactgtccagctgagtatgctattttcttgctaagtctaaaagctttgtaggcaacattttcttatatagagagagaaagaggaaaccagagagaggaggatgggggtgggtgggggcggggtggggaagagagagaaagagagagagagagagtgagcgtgagaaagccaatacatacgtaaatgtggagataaaccagaccacttgtcttacacaacatggtgatcatttgagatggaatgtttattatggaaccaagcatgctggaggagcaaagggaagaaaagatgaaaaggaaattatttattcccatgtcttcagtaccaaggctggcaacttcttcaagaaatttcccatctctcattgtattcataacaagaaaaaggaaagtactttttcagacggttaggaaaacaacagaaaacacaggagtgtcccaggcatttatcagattgtcactttatcagagaggtccagccaggactgccctgatcctccctgcccctgcctctgacaccgccctccacaatgggatgtcctcagggaagactgtgcaggactaggtctcttggtttcttttaccgaggcttctctttcatggttggttacccacaaaccatccaaggatgctgtacccctgtgtcctcagtgagaaacccatctcccctggctggttccaaggtaccacacttatccctgggggcccccctggctccaagggggctgaagctgtaccacaggtcagcagagggactggccttcatgccagctgttttcctttccaagtcttccgtggacacaggctcttttgatatctggagccctaacattaggtcacgctaggagaggcatgtttgcccttccatgcttccacagtccacgtatttctctcattcccagaaatctcccaactgctttctagcttcaaaacaaaccccaagcccccaagtaaatggctgtgtggggatgggtgtctcccagaccctcttgctaccagcatctgaatctcagccaaagttagcttttataaaacgtgcatgagaaggtattcttagatcagaagcctggaaactagggtttctgtgtgtgttgggagagggggaggggcttgctgagctgtaacaatttaatttagcaaatatttatttatttacttgtatttgttaaaaatgagatgggttggccaggcacggtggctcatgcctgtaatcccatcccagcacttttggaagctgaggtgggtgagttcgagaccagcctggccaacatggtgaaacccagtctctactaaaaatacaaaaattagctgggtgtggtgtgggtgcttgtaatcccacctacctgggaggctgaggcaggagaatctcctgaacccgggaggcagagttgcagtgagccgagattgtgccactgcagtccagcctagacaacagagtgagactccgtctcaaaaaaaaaaacaaaaaaaaaaaaaaagagaaagaaagaaataaaaaagaataaaaataaataaataataaaaggagatgtcttgagaagtcactagcaaatatttttcgattggttatgtacaaagacctgtgctgcctactgaggatgtacatgtgaaaagaaattggtttcttctccttgggaggtgaagtctcataactttattgatggagaagatatatctagctgatgacttgtagtggaagacactattttttctgttgccttcaattttaatttaccatgccttggatgggatgatatatctggagaggtgcctgaggattagaaaagaaccatcatgctgtgtttatttttctacctactttttattatagaaaatccagaaaagtagcattgtactgggtttttgggcggtggagttgtgttttaattcaattgtttgtgtttacttgaagtttgcagtacaaagttggagacgttgcttagttttgatgcagataaaattttcttccatttttggttctttttgttcattttgatgggttttacatagagacattttaacacatttgtacttatactaccctttttctttggttgatttaatagtttaccttcattagtgatattaatattttgataaatattacaaattcctactccaaggctatttactcttttgttttcttttcaattttttttgagactgagtttcattatgttgccctggctggagtgctgtggcacaatcatagcttactgcagcctcaaactcctgggctcaagcagtcctcctgcctcagcctcccaagtagctgagactacaggtgcatgtcaccacaccctgctaattttttctttttgtaaagatgaggtcttactatgttgcccaggctggtctcaaactcctgagcccaagcaatcatttttgcctaggcctcccaaaaagccaggattataggtgggagccactgcacctgacctacttttttgcacttaaaatttagtttcaggctgggcacagtggcacattcctataattccagcgctctaggaggctgaggagagaggactgcttgagtccaggagttcaaagctgcagtgaactatgatcatgccagtgcaccccagcctgggcgacacagtgagaccacttttctacaacaaacaaacaaacaaaaccaaaacaaaaccacttaggttcatttggaatttattttgatgtctgatatgaggctaaatttacattgtaatttttctccccagctgtaagccagttccctatcacctttggaactactgaccatccatgccacctggtgcatttctttgggtctctttccagactgtctagctttttttcactgtttgtctgtcctgtgcgtgtactttactatttcaattgctgtaattttatgatacatttaatatttttttttgcagagcaaattctccttcattacttttccccacatttccctccatgtgaggatttcttttgccatttgcttctagcagaggagggatattcctgacatccgaggatggtaatgaaggtctctgttctggttcctctcccatctcacacacccaaggtgaaagagctatattttccagcacaggcaggacccatttcttgccttgggtctaaatcagtttaaatcagtaacgaggttgatggaaaggagagcaggtctacccaggacatcagtttgggagacaaggaagagcaccttggaaaattcagctgaaagtcaagtttgttccacctcgaaatgtggctgagaaccagcctgacgaggcttaggcttgtacattggagagaaaaagtagactgtttaaaatataaggcagcggctgggcgtggtggctcatgcctgtaatgccagcactttgggaggccgaggcaggtggaatcacctggggtcaggagttcgggaccagcctggccaacatggagaaaccccgtctctactaaaaatacaaaaatcagccgtgtgtggtggtgcatgcctgtaatcccagctactcgggaggctgtggcaggagaattgcttgagcccgggaggcggaggctgcagtgagctgagatcacaccattgcactccagcctgggcgacaagagcgaaactccatctcaaaaagcaaaagcaaaaacaaaaacaaaaacaaataaaataaaatatagggcagggagaccttaggcaaacagagcagaaaatggtctcaaagtcacatgttgattgaaccagatgactgtggtgccttgaaaactgtgactctagattgggaaagagtgacatcacctggaccaagcagggggatggccttcctgctcggtctgcagttgcctcttctgagctcagtgagtactttgttctgcttctcctgtgtggttttaaaatgttagccacgagattagaggaactagaattattactcttggagtaaagagctggtgggggcggggcggggtggggtggggcggagttctcacacagaaaagagtgaccagttaatctccaccttggctgagaagaggagacacgtaataaaaaaagttaattttactgtgacaacaaaacgtcacaagtgaaagggcatttcggtgatagcaaagggcctgagggcagttcgatctcaaaggggaaggggtacgttcccaggggacatgtgtgggcttttcctctctcctccatcactgccacaggaatccagctgttgtcttctcagctgtatcctaccgaatctctctctggactgctcttgaaaatagcatagaccttcatttcaacaaatgagtgatgtgaggcctagactctaagcagaggcttttccaggtgacctcctggggcacctggcaatgccgcaggtttaggaaaaacatgatctatattgcagtgtctaagagactctgggagaaattctagacctaacactgtttcataaaggccacagagttctcttactcttccacctggtcttagagcctgggtttctcggtggtccgcccttggcccccatctctcctcacatactttgatactggctccctggtggccacgttcactcctccctgtgagctgcctctgtatctccaccatggggtttgctcctaggctccagacctatgtttctaactgcctgctggaggattccttatacacttcaacctgaacagacctagaagtgagctgcttctcgtcttcccccagacttggtaaatgacatcactgctgacttggttgccagattcctgccgtctctcccctgagcaaggtttccgtttgttccctcttctccattctcagtgctctcacttgcagcagacctcgagcacttccgacctggattattggacaacctgtatttttgccctttttctattcatcctttgatcagctctctaagttgtatttttgaagtgcagaacggctaaaaatattttttttttttttttttgagacagggtctagctgttgcccaggctggagtgcagtggtgcaatcttggctcactgcaacctctgcctcccgggctcaagcaatcctcccaccttggcctcatgagtagctgggatcacaggtgtacaccactgtgcctgactaatttaaaacattttttgtagagacaaggtttcaccatgttgcccaagctggtcttgaactcttggcctcaaacaacctgcttgcctcaagtgctgggattacaggcatgagccagtgcacccagcctgctaaaaatctttcaatggcttcttattacttctggaacctcagatctctcagatctgacccacacctacccctctaacttgaccacctacttctactctgccagacctcaacctttcagccaggaactccatgtagttctatccctccctgccaccacctcatgcctctgcagatgtctatttccgtgtttgataggctcagctccctgccttcagttagatgttcctcctcacatccacagtgctctgtatataactccatcacagctctgggcactacctttacaaaactgtctccatgattacactccaagctcccagaaagcagaaagcatgtcttctgtgcttgtctcccccagcctagcacagagcctgcggcagaggtggctaatgggtgtttgttgaatgcagatatatgaataatatatatagtagtgctttaacaactgtaaaggtccaggcaggtctaagtttttatttattataatttgagattgagggtttctaccccaaagctattttctaatctggtaaatacagtcttgagaatctattttggcctcagagtccttcagttcacagtggcagggtttagggctagggtggggggattgggggggaggcattcatacatatgtttttaatagctctttctctttccttccatcatgcccttcctcccttgccctactgagctgatgcagtgatagactttgaaggaggggtggtttagtccagggtctaaaggggattcttaaggcagttcttcctgctgtcctcactgtctccaccacccaaggggtttagcatttgcctggaattcacagcaattcttcttgcacaaatgcataaggaccacttccctaccgtgttcacttggcctagcaccagagttcctgccagtacacagctgagggttctgcctttccacagaataccaaggcgctggatgcattctatagtcagggctcttttggttgcaagtgacagaaacccaactccaaccagcttaagcatgtggaatctgtgggatcacagaactgggaaggcccaggatggatcttgtttggagacagcaagcttcagtcacacgtggtgtcaccacaggcccgttgctcttccagccatgaggccctctttctgccaaattcttccagccagacctgggaggatggacattgtactattggcctacctggtacttacagctacaatctaagaagaagaataaaaccctccaatcttctaggcctggtgtggtggctcacgcctgtaatcccagcactttgggaggcagaggtgggcggatcacctgaggtgaggagtgttgagaccagcctggccaacatggtgaaaccccatctctactaaaaatacaaaaattagctgtgcatggtggtgtatgccttgtagtcccagctactcgggaggctgaggtagaagaagagcttgaacctgggaggcagagattgcagtgagccaagatcatgccactgtactccagcctgggtgacagagtgagactccatctcaaaaaaacagataaacaacaaaaaataaaacctccaatctcctaaacagattgctctttttgagccatcttctgactggggaatggcaatccataatcactgggccctgggccagtggggatttggagtactgggaatgctggccccataagaaccatatgggaaggagaagggccgctctccacagaaaaagggatgctgagcacttacatataaagtatgtaacatatgaaaagacaacacgtacggactcggagaatctcaggcacaaggtgtcccatctttgggagtttcgcgattacagggttgcagctttccatggtctcttccaggtttgttttctttcaagccccgttcattcagcagaatgccactccagacctgacttaggaacactgcctatttcgcctggcttctgttgccactctctgtgctgtaaggaaccctctttctatattacaagtcacagttccctgaatgacatttcctgtgtactcaagctgggaaggagctaaacctgtccctatggtctccctcctggggtcatttctgagttttttcttttctattcatcccttccctttgaacttgctaattaagagatccttggtgtttgacaccccaggacccccaagctctgttccttacggtctcaggcacagaggtctctcattcctcagggatttgtaattccaggtttctacttctaggtcatggtttaatctcaggtaaagtgaacgcaagcattgtcatggcctggcaatgtagcgaaggagactttggagtcaaattactgagttccacacttggctcggccggccgtcttctagtggtgtgactcggcctgcctgagccttgatttcctcactgataagatagagatgattgtcacgcagagctgctgtgaggatttgttgaaacagcagaggcaaagttcctagcatagaattggcaactagtagctcaagtgatatcatacaggtgccaacaggcgctgacggctgctgtgttccaggcactgttttattctctttacttgtgttgactcattaactattattgttaatcattatgaattggctcattaattccctcaacaggcctaacaggtagaggttgtttctacccctatttaacagatgaggctgctggaggtataagtgatagaaccaggatagcaacccaagtcctgtgttcctacccactacatcgtattatttctgcagtttaactgtagtctagcttctctgatgtgagccacactgggtagacctctaactctgcagtaattgtggcaagtggatcattttattggagctgatgtgtttgtaaaatctttggggattcagtgtttttatttttactttttgagacagagtctcactttttcgcccaggctggagtgcagtggcacaatctcggctcactgcaacctctgcctcccagcttcaagcaattcacctgcctcagactcctgagtagctgggattacagaggtgtgccaccatgcctggctaatttttgtatttttttactagagatgggatttcaccatgttgcccaggctagtctcaaactcctgacctcaagtgatccgcccacctctgcctcccaaagtgctgggattacaggcatgagccactgtccctggccggtgtttttaaagtagagtttgttagttcactcaaaggggatgaaaatttgccagatcaattggtagaaccaaatgtttaagataccccaaggtgaatgagaggggtgtgtaagcagagcgtgagttcacattctgactctacgacttgctaatcgtgtggcctttggacaagtaacaatctgtcatgtatcaatttcctcatctataaaatgagtttttctgagataataactgtacttgttccacctctgagattagggaaattgaagaagatacataagcgttagaaagggatcaaagtaatcagttttattgctggtaaaactggtttgggtctgaggcttctttttttttttttttttctgagacagagtctcactctgtcacccaggctggagtgcagtggcatgatcttggctcactgcaacctctgcctgcccggttcaagcgattctcctgcctctgcctcctgagtagctgggattacaggtgcccgccaccacgcctggctaatttttgcatctttagtagagacagagtctcaccatgttggccaggctggtctcaaactcctggcctccggtgatccgcctgccttggccttccaaagtgctgggattacaggcgtgagccaccgcacccccgcacccggccaaaatgaagcttcttgaacttcctcccacgcctacactttgtgccccacctatggggaagtggaagctataatgcagtggtccccagccttgttggtgccagggactggtttcatcagagacagttttccaacggactggggtgggtagggggatggtttcgggataaaattgttccacctcagatcatcaggcattagattctcataaggagtgcacaatctagatcccttgtatgcacagttcacaatagggttcatgctcttatgagaatctaatgctgccactgatctgacaggaggtggagctcaggcaggaatgcttgtccacctgctgctcacctcctgctgtgtggcctggttcctaacaggccacagactggtactggcccaccacctggggttgggaaccccggctatagggcaaatgtagaccaggcttcaggcaggtgactcaggtttgcctagagatggacagtaggactgggaggtgggaaatcacctgtcctgcattcaggcagcccccacccgccccccccccaaaaaaagaaagaaaaataaaaaaataaggatggggctacatgggaactagctgtttcacaaatcacagggatggatagaaggccaggtggaagctcttttcctaatactttggagagggaagaagttcctacattgcatgggtaggaaccccaagagaggaagcaaatgattgcttctataaacatcatccacttggtagccctgttgagaagattaagtaagatggggcatatgtagaacatctctagtgtgaatggttagtgcccagtatgtcttacttagcgtgttacccacaaggcagaatggcagttagcacatttataccatgactgtaactaccagtgagcaagaacgctggtgtcagccagtcagtgtagtttcctccggatggaaaacctatttgggaaatcttgttgctgggggcgggaaaataaggacagagagctctgtgattataaaggatattgaaggctgatgtggtggtcttccctaccaagtaggaatctacccaccaagcaaactgtaatactcaccacatctatcctctgccagtgccatgatatactcatcacttctttttattgtggcaaaatacacatcacataaaatgtgccattttaacatcttgaagcacacagtttattggcatgttgtgcaaccctcaccactgtgtatttccaaaattttttcatcaccccaaggagaacctctgtgaccattaagcaatatgttcccattccctacatgccccctccacccccagcaacttcttctgtctctatgaatttgcctatgttagatttttcatctaagtggaatgatagagaatctgtccttttgtgcctggtgtatttcacttagcatgttcttccacattgtggcatgtacagaataggctcctcgcttctgaaattaaaactttctttttgatagccctcacgaggacctcttttgtcctgctgtttacttgttccaatcataccccttttcttcttttcaacatgttttcagagcctcccctcccggaagtagaattttttacggtgcacagaggacctctaccacgcctcagactgaggaaagccaaggagaaaaatggaccaatcaggtcagtagctgtcctttctccacggttgcccagtgatccccatggagtgttttggaaactttgattttggtgaggagaagacttctgtgttggtggctgcacttgggtggttagaacaatgcagttggggcctcttttgtttccttgggtacagactggcctttaatcccaaccagcatcctttctaatggtgagagagacttcttttttttaaaatttaaattttattttttatttttttgagatggagtgtcactcccatcatacaggccggagtacagtgttgcgatctcagctcactgcaacctccacctgctgggtgcaagtgattctccttccactgcctcctgagtagctgggattataggtgtgcaccaccacacctggctaatttttgtatttttagttgagacgaggttttgccatgttggtcaggctggtcttgaactcctgacctcaggtgatccaccagcctcaacctcccaaagtgctaggattacaggcttgaaccaccacacccggccacatagagagacttctaaaggaccctatatacaagcatttgggcagtttagctcaagaaattacatccattcctttggtccctgggtaaacgtcggttgcatgttaggacatgtcaggattgtcctttgcactcatgtctcatagtacatcctttatggatggtgggtcaggggcatcgtttcatttcccaaaggcagaatatgttgccctttatgtaaggttgatcttggggggtgtgcagtggtttctgaaaagatcatttaggtaaatctttttgtcttttcatgtattgagttacaggcaagacactgtataattaatgactgcttctgggattccagatggcattaggatggaattaatttacctcagttggaggactacagtgtgttcagttaagtgttttatttgcaaaggtcatggcaggattaggaaagtagcatcagtcccttttttagagaggaagattgaggttggcgtggagagatgaacagcttgctcacagtaccagctcaaggagatgaaaatgtacatggcctcaccaacattgcctttgtctctgctgacccttcggtaaaatcaaggttaaaaaaaaaaaagtgagatattataaaattacaaaaaagaaagtctggcgatattatctgtatatccatttataataaaacttagggttttcctgcttttatattcatttaagttcagtaaatgtgcaaagatctttccagggatggacattgtataaattgttctgattcttgacaagttaccagaaggcattgtaattctgtcattataaagagaacagaagttgtgatgtcacttcctgagagcatttgcaagaacaaatgtgatatttatgtcaaataatgacataatgcaaaagaaaagccaaatgacagcttacccttgtggctatatgccggccagcgcctccaaaacaggaagtggagaactgtgagtcattcgagggagtgtggtggtgaaaaagaggagaaaagtccttccagaacagtcatattccaaacagccacagctgcttctttaacatcacatggctaattaccagcaggcagggtggttttcctaagcctgactacctggtttgagctggggggcagcagctttgccagtgtgtgagacaggcctgagtctgctttgtgcaccatttagggacagtgtcttggggtacataatggagcaaggtccctgggaccaagtctctgctgaggttgctgatgttaggcagaggatggagcctgttgctgggttcccttaatgctcgtgtctcccacattgccagattataggaatcacctgggagctttaccagcgatacagattcccagaatctactcctagagatttcgattcagtaggtcggtatgaggtcggggaatttgtataataatcaagcaacacaggtgattacggtcaggctaattggggagctgattcatactctgtcgatgatgcctctagtgagcaatgtacggaaccaaatgggcacaggtgagcctcgaccttgctcttgaccaccaccacctgcatggaaagatgagagggatttaaagatgtacttatggaccgcatggaggtgctgcaacatttactttcttacctgtggctatgatgtagggatgtcttcaagtctcccggcaagtttgttgttacaggtgttccccataggcagtggatgcttaataaatgtttactggtggtgacaacttattgccctgtgggttttactttatctcttttgtagaaagcccttggctgaaagtgagccaagactttatgaaaatcaggaccctgggccaggcacagtggcttacgcctgtaatcccagcccattgggaggcagaggtgggcacacagggcagtgatacgtgcaacaacttcccccagctaaagaggtcaggagttcaagaccagcctggccaacatggtggaacaccatctctactaaaaatacaaaaaaaattaaccgggcatagtggcgagtgcctgtagtcttggctactcaggaggctgaagcagaagaatcgcttgaacctgggaggtaaaggttgcagtgagctgagatcacaccactgcactccagcctgggcagcagagcaagactcccttcttaaaaaagaaaagaaaagaaagaaaatcagggccctgaggatacctaggatgtttgggaacctggtggggggagactttccatatccaacacccactgtggaggagggctccctcttcttaacctagtgattcatgggctcttaggaagcaggagatagggcgtttgacatgtgaagcaggaagttcaaatttactggtaaaatagaattacatggcctaatgagttttggaaattaccctaattatatttcacgctgatgtatgcttttcctcttttccgaaatttcaactcaagaatcattcattgctggtggcggaggggcggggcagggcgggggttggggagctatcatttccaaagaactgtgcaaggatttgcaagaatacaagtcagtcgttcagatccctgctatcaagcctgacagagacagcagatgctcaacatggtactagaggcaggagctaagtaccagatagatgggaatagaagggaagtgtgattcattctcagtgcatttttattctcacacgtcctttcactgccaggctttctatttgatgggacaaataatgaaacacataacaaaaacaatacccatttgttagtgtgtttttctgtccacaattggggaacagtttttacagtgcatacatgacatattactgttctggctgtttcagggtgttgtcagactagattaactcatggtgactctgcactcttggcgtctcatttatttcacatgaactttggtatcagcccatgaactgtaggggatgtaaatcacatgagttctgtttcaggtcaccgcatgactgtctgcagccttttttccggacttagtacattcactgtggtaggcactcggtctccatgtgactgctaaccctttccacagttgggctttatttgcccacgtgaaaatcactgatcaggtcaattttatgacacacacacagggcagtgatacttgcaacaacttctcccagcgaaagaggatgtacttggcatctctctgcagccagaacttggagaggtcccttgccctgtgtcgtctggcattaaccctttaggttcaaactggaattccatgatggttggagccatcagactgtaaatcccacatgggcccggactttttcttgcctagtgtcgtgtctccagtgcctagaaagaggcttatttcagctgggcgcagtggctcacgcctgtaatcccagcactctgggaggccgaggcgggtggatcatgaggtcaagagatcgagacaagcctggccaacatggtgaaaccccatctctactaaaaatacaaaagttagttgggcgtggtggcatgcacctgtagtcccagctacttgggaggctgaggcaggagaattgcttgaacctgggagatggaggttgcagtgagccgagattgcaccactgtactccagcctagtgacagagcaagactccatctcaaaaaaaacaaaaaacaaaaaaacaaagaaagaggtttgtctcatagcaggtgctcaataaatatgaatgaatgaatgaactccccatgcaagggtctgatggacacttctccttttttcttccagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataaggtatctttctttccaagctcttgtgaactctgtattttcttcttcgtatgacatttaaatgtttgaacatttattttccaagtatatgagagggtcactgcatgtaacaatcacaaaatgtttgtgaatactttgcctttatgaagaagggacaggtgaaacccttacagatgatatggattctgaaccacctggggaccttgctgaatcaacatttggactgacctggttttgtttttactcttaagctttacagatgccctcattctattgcactgctgaagtctaagttggaaagaaacatctagattctctgttaacttccttgtgcccctgccaggctgctgcttctctcattctcctgggaagccgaagattaagcacagcactcggctgttttttgcttacatcccttccgcagctatggcataggtcccactttcccttctacagtccttagaaagctcttccagcagtggttctttcctgagacgtggaactcaatattcattagataattaggaaacatcatggagctgcattaatcagtcagggatggaagatctggaagaaccattgtgatggttgacctaggagaaccctaagcttgttgtaaattcatatgggccagtaatgaaaactagaaggattatattaatactaatacaagcagctcttgactgatgaatttgagataaaagtatgttatcatcttgagtgtaaggtttatcacatatttaaaactgagacactctattaaattctgtgtgggatgcaaatgtaatgtgtcatgaacatgcttgctatgaaaccaatagttacttgtaagaatgttcaagtatcaaagatgtctagcagcgctttgtgacaataatggaggaataaagaaaggaaagttaaagcccagaaatatattgccctgaacttaccaaaaaggtatttacagcttagacaaggccttttcattagaaaattacttggggtttctgacttggagtttttagccatagacaaaacactggcagtacaacatgagtgcaatttagagatggttcagagatctactgtcctagattaagactttggttggggagggtatattagtcaacttgggctgctatagtgaaatatggtagactgggtagcttaggcaacagacatttatttctcacagtctgtgctgggaagcccaagatcaaggtgccagctgattcagttccccagtgaggactctcttcctggcttgtggacagctgccttcttacagtgtcctcacgtggtggggatggagtggggaggggagagctctgattgctcttcctctatttattaggacacttatcccatcgtgagggctccaggcttataatctcttctgaatctatttctctcccaaagatcctgcctccaaataccatcacattgtaggttagggcttcgacatttgaatttggggcaggggttgggtggtgagcaaggggcatagacatttaattcataacagagggaatgaagttggaggttaggacaagaattccggtttattagccaggcatggtggtatgtacccatagtcctagctacttgggaggctgaggcaggagatttcttgagcctgggaggcagatgttgcactgagctgagatcatgccactgcactccagcctgggcaacagagtgagaccctgtctcacacacacacacacacacacacacaaagaattctggttcataggaaactttcctgtgatgtcattgatactctctttcatgtagctgaacagaagaatatgtggttattctttaggatgttaaaggagatgaaagggctttgaaaacatttatatttggatctacatatttaaattgcgatgactttcccatgggtttcaactgtatttgtgtgacaattacaataaaatcagtagtgatttaattttaatttttaattgtgataaaacatatacaatataaaatttactgtcttaaccattttaaagtgtagttcagtggcattaagttcattcacattgttgtgcaaccagcgtccaaaactctttttatcttgcagaacaaactttatacccattaaatgactccccattccttccttccacagcccttggcaaccaacattctactttctgtcttttttttttttgaggcagagtcttgctctgttgcccaggctggagtgcagtggcacgatcatagctcactgcagcctcaacccccggggctcaaacaatactggtgcttcagctgcctgagttaacttggaccacaggtgtgcaccatcatgactggctaatttttaatttttatttcttgtagagatagagtctctccatgttgcccaggctggttccaaactcccaggctcaagtgatcctcccaccttgacctcccaaagtgttgggattacaggcatgagccatcacgcccagccctactttccatctttatgaatttgactactctaggtacctcatataagtaggatcattcagtattttctttttgtgactggcttatttcatttagcctaaagtcttctaggttcacccatgttgtggcatgtgtcagaatttccttcctttttaagactgaataatattccattatatgagtataccacgtttgcttattcatttattcatggatgaataatgggatattttccaccttttggctattacgaataatgctgctgtgaacattggtatgcaaatatctgtttcagcccctgctttcagttcttttgtgtatatacctgaagtggaattgcttgatcaaatgataattctatgtttaattttttgaggaactaccatactgttttccatagtgctataccattttccattcccaccagcagtgcgtagggcttccaatttgtccatgtccctgctaacacttactgttttctgttttcttttcttataataggcatcctattataaggtagggtgtgaggtgacatcttttgttttggaagtgggggatggggtctcactttgtttaccaggctgaagtgcagtggcccaatcacaggtcactgcagccttgacctccctggggtcagatgatcctctcacctcagccacctgagtagctgggactacaggtgcatgccatcacacccgactaatttttccatttttcatagagacaggattttgccatgtttcccaggatggtcttgaactcttgggctcaagcgatccacctgccttggcttcccaaagtgctgggattataggcatgagccaccactcccagcatgagatggcatcttattgtggttttggtttgcatttccctaatgacaagtgatgctgaccatgttttcatgggctaatcggccatttgtgtgtcttctttagagaaatgtctatttaagtcctttgctcatttttgaattgggttgtttttgtttttgttaaattttaagagttctccatacattctggatattactgtaatcccttgtgaaatacgtgatttgcaaatattttcgcccattctgtgggttgcacttttactatacatagtgtccttagatgcataaaagcttgaaattttgatgatgatcagtctgtctattttttcttttgttgcctgtgtcttgtcatatccaagaagtcattgagaaatccggtttcaggaagctttttgttgtcttctaagagttttataatttgaggtcttatatttaggtttttgatccattttgagttaattttttatatgatattaggtaagggtccatattcattcttttatatgtagatatccagttttcctagtaccatttgttgaaaaaactttttttttttttgagacagtgtttcagtttgtcacccaggctggagtgcagtggtgcaatcatggctcactgcagcctcgacctcctgggctcaggtgatcctcctgcctcagcctctcaagtagctgggactacagctgtgcaccaccatgcctggctaatatttaaaaattatttgtagagatggggtctccctgtgttgcccaggctggtctcaaactcctgggcttaagcgcttctcctatctcagcctcccaaagtactgggattacaggtgtgagccagtgtgcccagcctgaaaaaactgtcttttccctattgaatggtcttggcactcttgttaactattatttgacatatatgcaagggtttatttctaggttctctatgctgttccattggcctatatgtctgtctttatgtcactaccacactgttttgtttactgtagttttgtagtaaattttgaaatcagggagtgtgagtcttccaatgccccattttgtttttccctttgtgtatctgtcccagtaaatagcattgccatgcctcccattgctaagacagaaacctgtaaatagttcttgtctcttccttctttcttaccttcttatccagatcatcagcaaatcatgtcaattctaccaacttaattctgtttaaaatcattctttcctctcctttgtctgcactgctcagactttgtcatctcttgcctgaacatcacttttctaccacatctttctgtctcttattctacccgtctccttgcttcataccactgccagcatgagttttataaaatgcaagtatgatccaggcatttcagtttaataagctcccttcttcacctggcccctgccagtttctctcctttgatatactccattcccccaaatggccttgctatttgaagtcccttccattctccagtgtcttgaaatatgttctttactggttattcttgcacattaccttccatttctaatatctgcacttagcatcaaagcaaatgttagtcacattcaaacgcttatggctattttaagcttttctcagatttttttttttttttttttttttttgagacgaagtctcattctgttgcccaggctggagtgcaatggtgtggtcttggctcactgcacctccgcctcctgggttcaagtgattctcctgcctcagccttccaagtagctgggagtacaggcgcccaccaccacacctagctaatttttatattttcagtagggatggggtttcaccatgttggccaggctggtctcgaacccctgacctcaggtgatctgctcatctcagcctcccaaagtgctgggattacaggtgtgagccactgtgcccagcagcttttctcagaatttttaagcttaaattaaaaaaaaaattaataaaatccaaaccagaatgcccaaggctgtcatttgaaagagactctcctaatgacattggaaggatcctcctctaaccctcaccgtgcagcttcctctggggaatattttcaagtcttatatagagcaagtccccagcatttgtaacaggtaaataagcatatcataatgacaggggggaagagatattcattccactgaatctatagatttcttctactatggatgagctttcatatatgttcctgttgctttcttcccggtt

SEQ ID NO: 917 - DNA, 1636 bp, Homo sapiens
tcagaatcacagttgccagagaaacatcagcgggctttagctggggcagagcttagcaagtgttggggtatcagcagttagtcactgtttgcctggaaccacaggatgtgaatcctagttcctggattccaaggaatcctgcatccaggtgtttattgtgctttgcagagtcaacatcaagctcaggagctggttgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaaaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcaggtcagtagctgt

SEQ ID NO: 918 - protein, 527 aa, Homo sapiens
  VARIANT (1)...(527): Xaa = Any Amino Acid
QVLGYQQLVTVCLEPQDVNPSSWIPRNPASRCLLCFAESTSSSGAGCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPIRSVAX

SEQ ID NO: 919 - DNA, 49965 bp, Mus musculus
  misc_feature (1)...(49965): n = A,T,C or G
ctctgtgctcttatgttgttagctgttttcagttaacacactgtagattgctttctatgtaactgggataatcattgcagtggatgtagtctagtgaatgtagtctaaatgtgaatctagtgatcagttgatcaataccctcattgaactttcaaatttccttccttccccttaagtttctttcattgttactccttctctgttttttttttgtttgtttgtttgttttgagacagattctagtagcgcaaactcagtgcaattctcctgcctcacagcctttaaaatgtttagagtgtagacatgatccccatgtacctggcatctcttttcttattaaacatgtaattcttacaaatttctttctttccttgctcagtgatggaaatgaagttcttctgttcatgctacattcccaggaggaaatgctgctcttagtaaacatgcatagagcagccagacactggctgagtgagtgaatggcctggttatttctgtagaaccgggtgggaactggaattttagtacagggcaggaattggtgatgaggtttggtgtctgggtcattgatctcatcagcaaaaggctcagagaagccttccaggtcccctgcagctagaaggcctggaagccacatgtgccatggaagtcggagcatagaaggaaggtgacttgatggcctcttactgtgttgagaaaagaaaaattgtttcttcctttgctttcccctcccaactcaaccagtcttgttttagaggaaaccaaagtttggccattgtaatctgccctgctaattcttatacaaacaggaaatagagcagagttcagcagatgaaatcctggctcttccctcaccagctctgtccccttaggttgcatcacttctctgagccctggtgtcaactcctaacacagagatgacagcagcagcagcagtaataatcgtcatcccctgcagagggtaaactgttggtagatgttagctaatactatagattacacaagctttgtttgtatgggataaatccagtaagctgccaaaccagtcagtttcctgactcgtggatttgtgttgagttcactttggcacattcaatctatgagtctacaagccacagctgtaactggaggactagctccagttgtacgtgttatacctgagcctgggtgctttgttatacatgccagtgaacagaaatgatgttaaatctttaaactgtactttagttagatcctggccatctgagaaagtgataggttaacaccctgatgaaacccaacgctaccatctcatctttagtttataagattttgcaaaaagcttaaccttgccttcttgatcaggtgaccaccacattctgagattcgtggtgcctgccattcacacttcccctcatctttctggctatctgggcttaggtaattcttggactactggcaagagtctggcagtgtctgctggtatcagcgctgcatctccacaggtgtttgaggcctggaaagttaacccagaaccaacagaccattaatagtgtgtaagtgcagagccctccccacagagccctcagagtggaatacaaggtcccctgttctccacctcctgtcatgtggtacacagtctcagcggaaggactcctttaatcccatttcagtatttcaaaggtatttgtaaggcacagacagtgcctgtgtactccccggcaccatggtggcacctgtattccctctccctgcctttgagcagtggctgaccctgcatactctcagttggaagctgtttctacactgagggtggtggaaatcatctgcaaagcgccgattgagcagtttagaatttcaggacctagggcttcccagttaaaattctggccttctagttttcagactggggcatgcaagtcctttccattatggttgataacccaaggttaatatgaaaggggtgtgggggttgaaatggcaagatccaggaaaaagaaatgaaagggcttgccactgggtataaggtaacagagcagataagaaagacagagctttgagccagtactgcttggctggctgcagtgccccggaagatatacacaaaactctattggtttttttttttttttttttatacattctttttctggtagtttaatagactaaattataaacaagaacaggctttttttgttttgttttaaataaatctatttctttccaaaatatgttttgttctgcattttctaaaaaggtgactacccaagactaacctgtagacaaggagttaaacatgaggtaaccaagagaaactacatcttggtcaactatgataaggataaatttatccacagacagtaaaagaaaagggcttatggtaaagtactagctggttatgtaaatttgagaacaaatcgtctaattagcagttagcagacctcatgaagtcagatggtagcagtgctggctggggctagcactgaccagtgggcagtgccaacagcaagtcagatgcacagaagactgcaacacgacatgcccacttctctagttgagccaagtgtgagcctgcatgagtgtctccctgcttggaccagtggggctgtgggaacatgctgacttcccagagaattaaccagactaataaaaatggccccagtctcatcccagattctgccataagtcatattaagagcccacagacaagcagttcacccccctcccatacatcagcaagtagaacctctctggctgccccgtccagttcttttgcttgtcttccagagctcagtgatcattcttttttcacccctctctgtaataaaaaaacactttaagcccatccttttggttgttcatgaatttcatcctgggtgttcatgagaaaaggacccagcatggaaatcttgtgtgattgtgaccatacagcacccaagctcctgagttaagctttccactcagggatcatcaccacccccaattgttgccttcacccactcctgttctgtttcatagctacctgctgggagcttcagcacctggtagtttactcagggacactcgcgggcttcctgatggattgctattttcagttcatacttccaggtaatgagggtattgtgttttgacttaatagaagtgctgaagccactcgcaggcctagctcctggcacatttcctcatagtcctcctgtagtccttgggaggatggtttccaagggctggtgggcaaggccagcgagggagaatggagactggtattcacggcctgtggaatgcagtttggattcctctttcaaaaaggaaagcagtgagagcagctgtcttatcttctcattttgacctctttcccaggcaaggaccatacactgtttactcgtgaaagccagcgctgtgcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcagtgagaagagggccagtgagtaagggggcagtgagaaggggggcagtgagaagggggggcagtgagaaggggggcagtgagaaggagaggcagtgagaaggggggcagtgagaaggagaggcagtgagaaggggggcagtgagaaggagaggcagtgagaagggggggcagtgagaagggggggcagtgagaaggggggcagtgagaaggagaggcagtgagaaggagaggcagtgagaagggggggcagtgagaagggggggcagtgagaaggggcaggagtgacagagacgctgttgtgattggggagaggaaggttcttcagaagggaagagagtgacatatgtctatacacgtttgcaaatctgttgacagaaacagcttcgaacctcattgcttttctaaacacttcattttcattccctcctcccttttcttcccctttctcttccccttccccttccttttccccttccctccttcctttgactggatctcatgaagctcagggtgctgtattattctttaaaaagaaaagaaacctgaccacttgccatgtatggcaccaacttgcccttgggagaagagtcaggagtacaagatctgtcagatacacagtgagcttgaggccaaccaggaattcgtaagatcctgtcccccaaaataaagcaaaaaaaggaaacacacacacactaaaaacttgagtgttaagtagatgtttctgttccctccccatatctaggtccagtctcctggtagttgatgttagtagttttgtatcttcgcatgtggctgtataaacctctgcatagatagcctgtgtcagcacattaccctgggctgccacattcaagatcaccacccatatggcttaaacaaaactctaatgcctcatttccagaggtgaaaagccccagagtaagattttggcaagttgtcttctaaatgacccctgtagagtcttcttacatggcagtccctgtgactctgacaagcccctgtgttcagggctgttccaatgatcctgttcaaaaccctaccctctaaagaccaaataaagtcacacttttgggtaccagagactagtacttcaacatgtgaattttgaaggagacacaggctcagtaatattaaccttctcatttcaaaacagtatcctattgtgtagaaagcccacgattactttaacattaggcctaatgcaaatggattgtaggctttctcgatgtttgtaactaagtcttgggatgctcataggtgtgattctgccaggatgaacttggaagaattgtaagtaatgccctctgaagagtataaaaattatatggaggggagttcatgaagcctcaaccctataaggtatacaaagagctacaggcaactaaggaatgtcaaagcaggaaaagtgttccccggggaagagcacaccattggttatctaataccagtggtcagccctgaaaacacacacacaaataacactttacagtaagagcagggcacctattcatctttaggactatatatgtgtatgcttatatgcatgtaaaaacagtaatgaaaacagaagccatgaatttgaaagagtaaggaggcatatatgggaaggtttggagggaggacagcgaagtgtgaaatgatgtaattatgttctcaaaaataaaattgaaaaaagtaaagtgaaaattataccccttaattcttggtgatacgacgctggtaggagattgagttcagcgtgtggcttgtgatggtggcccagggcctggggttgcttgtgcttttgtttgagggttttccacccacatgacttcatcatacattactcactgaacatctatttactgaggcaagggtggacagcgccgctttgttcatttttaatttttatcttaaacaaaaggctttttaaaagagtaattttgagctcatagcaaaactgaatagaaaaacagaaactttttccatatgctctgttcccacagaagtgtaccctccccagtgatgactggctttctcccatggtgaccagcctcctcctgcggtcatcattatctaatgtgatgatcagcgtcctcccaggatcagctttcctaatgacatcagtgtcttgccatgtcaccatgctctctcttggacagcatccctcagcacagagaccagtttatacctcatgagtctgtatgtccccttggtttcccaaagtccctagtttacgttacagctcagtcttggtgctctaaaccctgtgtttgttttataagcctgacttgtttggcaaaaggcttatgccctgtagagccaggaataggacagtggcttttctctccaagcttgtgacagcctggagtttgtccagcaggaattttctaaggtgaagaactggaggaggttctgccagggtaataacactctggaggcaggggctggatgaatctattatatcctaagttgtgttctccctacagtgtggccagtcagtgcaggtggagtaagaatttcttggaatgctagcgttccttttatagactctgttggcagtgtccacatagtacatttgtcagcatttagcttaaggcaatgcatgccttcccttgtttattggtatagtttgctttgaagggtgactcttgatatagtagagaaaggctattgttgaattgcaatatttttataatctttatacaatatgtacacgcatataaatgtacatatgtctgggttttggcagtactgtttttagacctgtggcactgcacatgctaggtagattctctacactggaccaaagcactgcaagtaaatagtgctgcttgacaaactcggtgcatacattgatacatgacttaaacatgaattaaaccacctgcttcgttttagtgttctccataatcgtatcctttctgtgaccatttagacaaatttaaatatctgtatgcattccttttcccatctgtggagatagtaagcctaaccatcgactctgccgtggtacagttccatccttagctagaagctttctagctcattctgaatgcctgagatgttggcctgtaaagggatgagacatcctgcctgggttttgaaagtgattggctattcctgtgctttgggccagtgacaggcagcacagcatgaggggagcatctgacagaagagccagggcctcccaggcctttctgtgacctgatcttgctctagctttgcacttaggtcagacatcttcaacatttgggtcatgaccccctttatgggccaagtgaccctttcataggggttacctgagaccatcagaaaacacagcaggttatggttcatagcagtgacaaaattaaagttatgaagtagcaacaaaaataattttgtggttggggggtcaccacagcatgaggaagtgtgttaaggggtcacagcgttaggaaggttagcgaccactgtcttaggttggatgtggccgggccagtcttttgccacatttgagcagtgcttaagattcaaactttagtgaactgcttctaaaggaattttctttcctaatagggtattttgtcacatctgaacttggtatgcagcgaatatggttatctgaaacaacgtggcttaaagaaaagctaggaaagaggagagagagccagggaatcaagctagttttgggggtggggtggagggaagagagaattaaaaaagaggaagatctgtacacatatggaaagagtcaataaaatcagagatgtcagtggggaccaagaggcctgagggtatggagttggtagtgctttgcctgtacaaggccttgggttcaatcctagaacgttatggtggtgcatgtctgcattcccagcctttgggaggaggagcttgaggccaaaacaaaacaccagccaacaggatgtctgtatgtaaagggaacagcagctatgctggtaaagaccacgtgtagcaccgctctttgcacgctctgtctgttggctcagcctacggagaatttgttaaaagcggtggcctgtttagccttttgagtaagatggcttgaaaagttgagtgctagatgctaagaagacgttagcaggaatttgaagccatgttgccatcctgaagggcagagactccaacaccagtgctttcatgaagtaaggaaggaagcttgtgatatgaccagacttcggagatctatgacattgttataatttgctgtattttcaacacaccctgctacctagtctcactgtacatgatgtttataatatagtcttgtaactcgtgcttgtttggaagctttgcaaagttcccaaacttccagatcattttcaagaaattgaactattagggcttaggttcaatataaaacagtgttggcactcacagattcagatgtagtttgcagtttatggcaattcctttcagagaagctctgttgtgtaaaatctcctttacaccagctgcagctgagggggcttccaaacgaccacagcaacagataagggacatgtagcgtctgttcccactgttactttataagtggggataccgagtcttaatttctaggtggcagagtctaactcacagtccacaaaggctgatttctctcctgagctgctatccacttactagcctgctgccttatgttttatcgaagatctagttttcccaaataatgggggcagagagaatgttgaattggttcagtatgtgctgtacaagcaagagaaattgatatgatttctgggacccacataaaaaactgggtgtggcagcctacccctgtagttccagtcgccatgggcttcctggccagctcatctgggtgagtggatgaggtccacattcagaggaagactctgtcttgaaaaacaaagtggaaaagtgtcaggagcggcatccagtgcagacccctggcctccacccacatgcatgtgcagtacacatggccatgtgacccagtgacctagtttccccaagtgaaagacgtatatactctagtggtacatcaagagtctctgccctgagcctatactgcactcaatagcctagaaagactgctgtaaggggcactagactgagaaataaacagtgcctgcataagagcttactgatgcccttcttcaaggatagccttacttgtgtaaggagtacttagtagaactcccagcgtgtccctaggtgttcgttggacatttgtattgctgggtccaggttcttgtttttcatgttcttcttctttaatggaatattttttctaggttttagctgttgcttttgctcttagctgatcccagaaacctttgtttgctcttaagtgtaatgactgtgtacttctgagaaagtccctttcctgtttatttctggccgtctcccaagctattagtgctcatcatttgagacagcatctgactagttctaacaagctctgccatgcaccagactcttctcatgtcccgtggtctgatgatcaatagaacagtcaccttgtagcctgggaaggccaccagccaaaatgtttgtaaagggtcaatgtttgtaaagtagtagatttgtatatgatatcaactggatctcttataatttagttcaaatttgacactacccaggtttgataccatctcacaagactgtcccaacttccaagactgatcataatctgaacctcccatagtcaatctgattgggtataagcctgagctcttagactttccacctagggttcagcaatgggcatatcttcttcgtgtacttactgacattgaaattctgaattccactgatgagggtttttgtaaagatgccagcgtatatcataactgattcagtcatcagccattggccacttaaccaccattctccctctgtgaggaaagagcggggacctgaaattcccaatcttcagtgtcatgtggctgacttctggcaggcagattccactctacagtgactggggagggggctcaccaagagtcatggcattaagtatagactcaggagtggtttaaagggggttatgaataccaggacactccttgcccacccatcaaatcccagtggttttagaggctcgtattccatgttttcttgctgtgtcacagtagcacactctgaagggatgtttgtgtctttcctagttggcctgctgttgcggatctgctggctgctccctctgctgtggctgctgccctaagttccgacagtctcggaccacccgcttcatgtatttattctacttcatcctggtcatcgccctctgctgtgtgatgatgacaccctctgtgatgaagcaggtgaaggaccacgtaagtctgtgggttttgataagttgtatgtgaaacttgatgtagaggactgagttcaacatcactgtgattgggggcttgtttcttgtctgctgctgtgataaaacattctaacaaggcaacttatacaaggaagagtttatttcatcttatggttccagagggataagagcccatcacggcggcttggcatgacagcacgtagttggcatgacagcacgaagttgaaagctcacaacctgaaccataacacaaagcagagagaacagaatggaagtgggcaaggccttttatttagcctgcctccccacccctgtgttgtactttctccatcagggccactccatctacatctcctcagctccacctacatctcaaacagcaccaccagccagctggggacagagtattcaaatgtctgaggctagggggggcgggggggcatttctcattcaaaccaccacacttggtctctgaattgtctcaaagcttgtccactgctttcagaccaaacaggcaagccattcaacagctggatctttaatccactaattagtgtttggcctgatgtatagaatgtctatggatgtgatgtatgtccatgatggttgcacacaagtctgtctgactgcccatgaagactgaaaggacatcaggtgttctacctattacgctctgtcttgtctctttgagacctggtctcatgctaaccttagagctgggttggttattggaggccagcgagcctcagtgatactcttacccatcgtgctgaggttatggaagcacgcatgggtatgctcaacattttacataggtggtagggattcaaaatcaaattttcacacttaggcagcaaggcagagccactcggtttagccactgggccatctttccagcccctagtagttttatccttagtagtaggatatccatagttagatgctgttggtagatgtcagaggattatgtttggtctttctttgtttatatctgtttctgataaaaacacagcctctgcatgtagaactttgcacatctttttatcttaaggatgactgccagtatttcaagtcacggctggttatacacacttaattcagcctttatggaaaggatggtgcagtttagacagtgccacagataccaggaagtagtgtgcgatgattttaacctttctagacagatcacttgtccattgttgtctctgggtggaaggaagagtcccagtcctttcttgggcagtgtgttttgagggatccctggagtgtgatgttcatggagatggatgtggggtctttcctgtccccacatagcaggcctctctgagccatattagaggatagtgtgttgaagtctcaagaaagcccaataaacaacacaattctttctgtcctaggttttgagaaaagagactataaaatgtcatcaagtagaggccagatatcatggttattatttaacaagtcacatgaaacctttcagtttgtatttgcagtgaggtcagcttcctcctcagctcctgaaccaatcagtgcattcacctctgctccattggcgtggttcatgatagatttcctcttctagggcacagttggccaggaagagaggacagcagtgtgttgaggcggctcttgtctcaggggaaatggtagatgaaagcatagctgtccaagtccatttgcctttaaagtaccgctgagccctcatactcctgggcaggcaatgaggtggcagagcagccaggcctagagtggtcctgtatcccttctgcagtgattatagtctccattggagcaactcctaagcaaacagtcccagtcctggtccgtgctgtggccatttcaaacacacccattttctttccccttctctttatggtcagagcgggaccggggccccgcatgtactaggcagtccctgaactattgacctacatcccagctgaaacaaccattttcttacaggctcttggtctattatcctgtttatcctttagttagaataggcccactgagcttcctgttgggtaatacatttctgattgtacttgtatgcttttgattacagaataaacgactgtaaagcctctgattaaggcaccacagtgggggatatgtatgtttagatgaaaagcgaagtttgtcacttggaaaaaaaagatgggaaattccctgaggcctataccaaggtaaaaagaataggttccatgtgggaagatactgtagatgtttggagcagagaccaaggccttgggtgcctggaggggtctgtgctaagacttgctctgtgcttattgatatatttaccacctggtcccctcctggcatcgtggcttaacttaatgtgtttagggaaagatgtgtgaactcacaggactggaaatatgactcagcagttaggaacaaacagtgtgcttgcagaggaccaagtgcgggtcccagtacccacttcatatagctcaaagcctcctgtagctctagccccagggggtctggcaccctcctctggcctctgtgcgtgctcttcccctattttattaaaaaataatatatcattaaacagtatatataattaaaaatgaaaactttttaaattaaaaaaaatagctagactgctagaaggattggtttgaactcttcctggacagaatgtagaagtctgttgaagcccttttacattcatccatttagatgacctcacatgggctagtgggtcctgcaccactgagccgcacctcagccctccgttcactacttttatttttctagtaatgtagtactctctttttaaattcataagcagcctgtggtgacagtcctctgtctcagcttgatgacccactgtggtcctgtggtgacagtcctctgtctcagctatctggtaggagctctgctcttaacttttcagtacgagtacaatgaaagccttagatccaagagacgaaagtctatgcctatgttattagtaacatctcttactgcaattgcaattgtgtaggtaatctggaagccacagctatgtgttttaggcatacattttgtaataactcacacactggattcctatttaagtatcctgctcctgccccatgcaacagccctaacaattccttcctgtatctctgctgcctgactcctggcagaatcttcaaaaggaagatgctgactggagttgcccaggaaggcttcatggaggcagtggtgtgtgtacatagtaagtattttaagagctggtttttataggataatgccaggtgccagattttagttggagcattttccctgtatcttcatccttcgttaccactggtctcgtgtatgcagaaggtggtggtgttatcccactctacaggtgaggaagcaacgagtcacctaaccagtttatgctggtcttatagccaactactggaggtagacttgggatttgaacagggcagattatgtgctcagctcctgggctgtgtagctggaaaggcagagaaagagcaaggatagggcatgtacagagggacagggaaagaaaagacagtgtctcacatgatcagatcccactggatttcctgttataagataaaggagcatccatcatagagtcccaagcagaggtgtgatcgtggagcagggggagactgaaggaagtgagatcactggggtgagtcgggatcagagatcagatggagagggaggggaagggaaggtgtaaccctggcgcctcgcagagtggtttgtcaatgtttcatgcatgcctctgaatgtacctatttaaaaatggcttggccaggcttcttgcatagagagtgaggtcactctgagtgaaacaaatcgttttcccttcacaggggatagctatgtggccacaaagtcagcttattttgtggtgctacaatcaggctgacctcatgctcaggcggtgtttgagggtgggccctgaaaggtctccttgtagtgcataggctggcctttggctggctcttgcctgctctttgttggcctgtgggaatgctagaggtgacagtagcagaggagaaaaagaaccacaagcttgtggcctggatggggtgttattgccacccactctgcattcttgcctcttagctaggcccctgtcggggtcacgtggcctgtggtgtgagggccactttctggtttcagaatgtgatatctcagtgagaaggaccagtgaggcaacttggtcctgcttttcatgaggggagccctcctgagaccggagaagggcctcctgtatgttgagtcacagcgagtggtttttgtcttcttggagcgagccttttttttcccatgccagaatgtaggagccgtttaggctggctgctcttggcagtcaccatagcatccaagcaagtacagaatgtgggagcaccagtggacattagaatgctgaacaccagtggacattagaatgttgaacaccagtggacattagaatgttgaacacaagaggcaaagcaagtgaaggagtaagggctccaggtctgcactgaaaaaccaagatctgtctgcctggtttgaagataaaaggtgacagttgagtgtcccagaagctggtcatttgggagagagggcaaaaaatctctggctctctctctctctctctctctctctctctctctctctctctctctctctctctctttcgagacagggtttctctgtgtagccctggctgtcctggaactcactctgatttctggcctcgagctcagaaatccgcctgcctctgcctcccaagtgctgggattaaagacatgcgccaccaccaccaggcaaaataaaggctcttgtgtgctgaggaacaaagatctcctggccttttccgctgagagctcactgcccactgtgggaagaacctttggtgctggaacctttcatgccttaggttcatcttctcctgccttccacttggcacctccattgccctgatggatgcagatgtcagacatggtgcatttaaaaatgtcaaaaccccaacatatcctaaacagtgctgtgaactcatttgtctgatatctggtgtgtggagcatgatgtaatatggttgctttacatttaagttgtaaagaagttctccttttgttgtgaagagagtctggtacaatctctgctgtctttttgtcgctcctacagtcatgtttagaaggtgttatgtctggctgtaccttctgatctctgcacacattttattttgcacattatttcccagaggtgagtcaggatagttttgagtggcagtgacttggcaactgacgactttgactaggttttccctagctgacaagggcttttgcacttgttttcaacatatggagcacctgcaaggaacacaggacaagactgaatgggatctgggtgtgaggaacgtctgcctcatgggattgtacaacagcatctcccaccttttcttcctggcctggatgaaggtagccaggttgactatgtctctctcctggctccggactcatggccacagccagattcagatggctcagatgaggatagacaaactcttggaactatacagttggcttttatttgctgccttgaggggaactggcatgcagtaatgagaccctaaccctgggctgtgcttgtatctaggcattagcaattcttggaatagctttgtgtttctgatggagttgtatgtgtcatgatagacacctgggctcttttaggtgaccattcaggctgcgggggagcagggaggtcagttagcaagcgggttagagtgagcttttcaaataaacttgcatggccttgggctgagaaacaagacacccttcttgcttacagctagtttgtccgttatcaactagcctgagtatgtccatcaaggaacttgagaaatcactttgttatctatctactttgcatagcatttggctctactctgcttctgtctcttactcatagggcagggctgggacaccttagagtctctgaggtcctccttctccaggaaccatttgtcacctgctcttttcttttgctctgtcttttcactctgggcattgagtgtacactttctgcagtttttgcatttttcttaagaggcaaaggtactttgagtctgatagctgtgcatttggagtctttgaatgtggttagtgggatggattaaaaggatttctctgtgtggccagaaaactcactctttgaaaacacagggatgagctagacatacgaagttggtatttcccagtcattttcacattgggcaagaagaaatttatgtcttcattaacatactgtggcactgacagatgataaagaaaatgtttaaagtaaactaagggtcctaaggctacctgctataatgcagaaatatcaacttctcaattccctttaactttaagcttgcaatcctggctgtgacctcctgctaccctggtctgttttgggacattgccatacctgccattgctggtagagttctgatctcggcctcctgtttctcagagcccatcagctatgcggctagaacctgtgtcttgctattaaaactacttccctaaactacttgcctccatctgtctacaaccccaatcctagagagcagcaaggccacccttcttctggtgaagctctgcacagcacctgcatggatcacgagtcaccctcagccacaggctcctccatctctgtcagcccttcccttttctttctctcattacagacttgtcatcttccagaagcattctcccccttctcgctggtccttagtaaatccagagccaccctggcttcttgttgctccttcatttttcttgtccttccttgtagaggcttcctatttagggcaatattgcatggtagttgagagtttgagcttcaaatctggacagctgaattttgaatcctggctcagttacttagcaaagttttttactctttctaccttgatcttctgtttaaagggaaaaaaaagataatagtaaatcaagatgttgcttaagtgtttgggtgccctagactgcatggggtcctgggtttgaccctgattaccaacccatctcatttctccataaatatatatcatagtcatccagtccacaggcatgtgaaaacccactgatctaatccaggaagcatgcttagaacaatacctggtacattggtttcccagtagcatgtaaatatgttgacatctccagcatccaagaagtcagcaatctgagtcatatcttgtacagctttattgagatccgattcatataacttacaattgagttatgcaactggcactttaatacatagccttagaacattttgtcactcctaaagcaactatatttattcacacatgcttcctatttcttcccaagttcctccagccctacagagccactattctattttctttctatatggatttgcttattttagatgtttccatataaacgaagttacacaatactagaatttgaatgtgtctccgaagaaacttagtttccaagttcatttcctacttggatacaggactttagggggcataactagggttagatgaggttataaagtgcagacccctatggtgacagaagttctctctgaaaagaggaagaaagacctgagctggcacagttgctgaagcttgccttgtgatgtcctgtactgtagaatgatgcagcgctaaggtcccctctgataccagctttgtgctcttacgtttcccagtgtctaggaccatgagctgaacaaaaatctgttttttcttttaaaaattatgatgtattaggtattttattatagtaacaacaaaacatactatgtatttttttctacatgacctctttcacttagcatgttttaaaaggtcaagcacactgtagcatatgtcagcactttcttcctttgtatggctggatagtagtctacttatgaatactccatattttattagttcattcctcagttgatggacaatttatgctatttttaccttttggcacacaatgtcacctttttgtatgtgtatataattattttctgggtatatacctaacagtagaatttgttctacaatctaggcattctggaccatatgaaaacaccttgtgtaatctttttttttcttttttttattattattacgtattttcctcaattatatttccaatgctatccaaaaaagtccccccacaccccccctcagtcccctacccacccattcccatttttttggccctggcgttcccctgtactggggcatataaagtttgcctgaccaatgggcctctctttgcagtgatggccgatacatatgcagctagagacaagagctctggggtactggttagttcataatgttgttccaccgatagggttgcagatctctttagctccttggatactttctctagctcctccattgggggccctgtgatccatccaatagttgactgtgagcatccacttttgtgtttgctaggccccggaaccttgtgtaatcttttgaggaattccagtactgtttccaaaatagttgcatcattaacatcctcaccactgtgtgaaactttcattaagtgatgtataaatgttcaagtttcttctacccttgccaactcatattatttccatctccccatctttgtgggtctgtgatctctctacctgtgccttaaaggctaccctgagccgggcttggtggctcacgcctttaatcccagcactcgggaggcagagacaggcggatttctgagttcgaggcctgcctggtctacagagtgagttccaggacagccagggctacacagagaaaccctgtctcgaaaaaaaaaatgtctctacacagtaagggacttttttggaatcacttacagtctgcagtccaactaacccaacaatgggaggctgtgaatgaaaatgctacaaatctagtagtagttgttcgattccacgaggctgggtatcccagctggtcttctggataagctgaagtcttgaagacataggttccagcagatgtgctggcaagtatgtgccaccgccttccttcttccaatgtcctatgtaggcctccagcagaaggtatggcctagactaaaggtgtgtactagcacacctagacagttcttgaaacttgctctgtcccaggctggccttgaactcaggtctgcttgtctcagtctcctgggattaaaggcatgtaccaccttgcctgggcctaagcttttcacagccacgatgccgcaggatccggatcaaaagcatctgtcttccagcctcaagatctggatcacaggtgtgctcttcatttctggattgtagttcattccagatgtagtcaaattgacaactgggaatagctgtcatgggtaccttcacttagaacattgccagagtcttcctcctccttcccatttttatatccagtactgataacagactttccacagacaggacattgaggtactgagtttgtgctgtgcgttctattcagtcatgaatgagttagctaggctaggctcctgccagcagcctttcttatctagacaattgatcccatgggtgagctgagggcactgttgctacttctctttctcccacatcaatcctgttccagattcttggagtcactcattggcttgtctgtcagccaccgaagctactgtgcttgggtgtttgtttgtttgtttgttttgttttgtcgagacagggtttctctgtatagccctggctgtcctggaactcactctgtagaccaggctggcctcgaactcagaaaaacacctgcctctgcctcccaagttctgggatcaaaggcatgtgccacctcctcccggctttgcttgggctttgaaagtcttgctaagtgcagcatctagttgcctagttagttctgatgactttttacactcctttggtggttcttggagtggagtggttcatgaaatgcttccatacaatgtttaggactctagatgggcagataagctactttttctcctattttcagagggctatgatgacataattgtcagccttgtgcatagttcaccttcctggcctagtcacggggatcctgagaactaaggtctgaggctaaagtgtttaattaaagaaataagcaaagccaggatgcagctcccatctgtgattggtgacagtaaacagctgggcctattaagtgttacactgagaaacagtgttgtcttttacaggttataatttgagtcagttggtagaagaataaaggagactggaagagcagaaaagccctaagtggtcattttaactctccagtcatctgacagatgacatagctcatgaagtgaagtggtttgcccaaggcttaaaacactagttacaacccagggtaccctggttgcttgaccagtgtttacctgttcatatcactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtctagggaactgccttcttgtaatagtgacatccatttagtaagcagagccttccttgactcctgaatgttctctgggcacagtagcaggaaggaatgattccttctggaaaggtcaccttcccacctgcctccttcccatccttcagccaaaagctgggctcaaagaaggaaaacagaatagccacaaacgatttatttggttttgcctggaaagtgaaacctactcttgggttatgttttgtgtatcttcaaaagacagacaacatcattggtgaaaaatatatcactttgatgcaaaacaccacagtttgtggtgcagagcagcagggattcatgctaaagggcaaaagtctggctctctgactgagtttggtctctgttggttgagtgttcaaagtgctgggcccagaggttgttttagttgaattctagacccaggcaaaactccccattctcagcagctacctgttttcttattctggagaaattttaagtttattattttaacccagctgagtgaaacaactttcaaaagttcttttgaacaacagctgagttccgtgtcagtatgctttgtgggtcagtagtgtggagccccagttcctgtggatcactaggagctgcagaggtctcctgggctgggagttccacttcttattttccctggtcccatccctcctcagcatggcttggtggggacaatgttatttttcatccgaggtcttctaggccggaaacaaacaatccctgcaagtcccagccttggctcctctctgctgctcctgccctccatatagtgaatgaggctgggagattgttttgtacttgagcagtgctttgagcgatgatgagaggctttggctagactctgaatcaagggctaagattgactcttgtctagaaaccacgagcttgtcaggagctgtacagtaggtaatgttcactgtccttgtctgtcagatcccttgcacagaacccttcggaaggtcccggatgtgagctggctctttttaaagattgtcctgcctatggtagggagaaagtgatgaggtgagaatgtgaattattctcagtcctttcactttgaccatcaaaagcatccgttaaatgactggcccccaaacactcccagataaatggaatagtcgggtgcttacagttagaatgaatgctattacctgccataaaaatggagccagaggagcagacaccacagcacagaaggagctaagatgaactaggctcagagtcacgggaggaagctcatggatgctgggaacacagtaccatccaaaccccatggggccttatttctgtggttttcattatctaaggtcaatggaaatccaaaaatattacgtggaaaattccagaaataaataattcaaagctttaaattatgcagcactctcctactctatcctgcttaggacatgaattatccctttgtcccaccaactgtcactcagtggacgttttggtcatcagatctgctattgtggtatcagtacttttactcaagcaatcctttgtttgtttgcatatttgttggttgatactggggattgaacccagggccttgtatgtgctgggcagttactctcccaataagctgtaactaacctcacctcttctctcctcttcttcctcttttcttccaccttcttctcctcctcctcttctttccacccctctcttttaagatagggtctctctaagtgtcctaggttgtcctcaaacctgtaattcttttgctttagcatccagatgtttagatttttaggaatgtgccatcaaactcagctcaagtgacccttttacatgcctcccaagggtaagagtattgatgttggctgttttattacagtgcactgctgctattgttttattttatcataggaattgtgcagctattactcagattgattgcccatagttctaggcacccattgttttggagaaaggatctcatacagctcattctggcttccagctcagtacatggctagggatgaccttgaactcatttctgtctcaacctcgtcaatgctggtattacaggtgtgtactgtatatctgcaaataaagtgagatcggtgtggtttaattttgatggtccttttacaaagtataagggatattgtttggccacactacaatctcagtacattctttttggattgtggggttttgtaacagggcctgtgtccagaatagcagcagaatgtgctatatagctcaggatgtgctagaactagtagtaccttctatcctagccattgtagtgctgggcactttgatgataggtgtgcactgccagctgctgagtacattctctgctccattttcttttgttttgattcattggagagaggaagagaaagagacagagagacagggacagagtatatttgagataagatcttttaagatcttattttgtagtgtagactagccttgtctgaacttcctttgtagttcaggctagcttttaattcaagtggtctgtctgtcttttaccctctagagtacttcaatacagacaagcaccatgatgcccaattgctgatcccattatttaaaaactgcttaaaatctgctgctttcattgatttatccatttggtaccattaagcataggtaccaaaaactcaggtgttctaggataacaacataaggcactgaacctcaggtaggggaaaccaatagtttggtagctggcttttgtggcgcatgtagagaggctgacaggctgaggcaggaagatcttagttttgaggcaagagtgtgtatggaaggaaaccctgataatagactggttggcctactcttgtgaactccatctggggatgtctggatagatagctgaggtgagggagagactccccacaggaccttaacctgttccccgtggctacggaaatcataatgggcgcagttcagtgggacagttttctacagtcaacacactagtctaaaattaatgtatcgacatgctggctctcatcagtgtgggttttatttttggttgttacaggctgtgcttctaggacagatgggacagatgtaacagatgtgagtggctctgttaatgctgcttaaggcttttgagcattggacatccctcccccaccacttcctctctccatcaaaatagaaagacgattcttctttgtacacgaaaaatggcagaaagttctacagtttgtttcacttaaaaccagcttctgtgtgaagcacatctggtgagggaggtgccaggagctgtactggcataaccaggtgtgcccctcagctcccactcctttggcttctgatgggtagagtgacttgtcacagttgccacttggccttcaaagtataaacacatactttatcagctaactgctctgtattaaccttaagactgggcagactttctccataaatgtctgctagtgaaaactgcaggctctgggcttccactgtagtgtaagagtggcccaaacaatgccaacaaatgaatatagcttcattccacaagaaagttatttacataaccaggagactggctagatctgaactatgggctgtcgttttcctggctgctgttttaggcctgactgactccatgcaggccacatacgtacctcgtctctaagagacaaacttcagtggcctaaactttatgctcaggcaaccagagctctagcttacctttcaggtaagggctgcatgaaccccatgcctagctaggcaagcacaatttagtatctgttattctatatgggattataagcaagtggaactaatttatggggaaatgagttatttgtatgaatcacttcagtcatgttagggatgaaggagtgtgaggaatgtaaaaatgagcatgtgtggatcctaatacggggtaagaagtgaggagtgctggagccacagtggccgctgcgcatggttctcaggagtgggattcacaagcaagggattcaggctttcagaatcacgagttgtttaagtatgttggtgtcccatcttacagaagacagttcattcttgtgccctatcattgtttaaatatacatgatacacatgcgtggcgtgtacgtgtatgtgtgtgtgtacacatatgtatatatatacatatgtacacatacacacatcactatggttatctgcacagcatttcactagacagttaattactcattagcaccgatttaaactgattaattagccagtgacttacagcactgggatcaaatccaaggcccatgtatgctaggcaagtagtctactggttgagcaacattccagctttataatatggatcttaaacctattttatttgatgcttctatccacatgacctgaataatacttgcccagagtaggtgggaatgagtggctaactaaaccctgtgtgtcacacacgtgtggcgtgtggtgtggcataggggataaagcgtgtgcgtacaagctctaacttgactgagctttccatatttccccagaaaccaccatgcatgcagctgcaccctttaagaggaccttcgctgacttggttagcgcagagagatttgtcaccaggggttgtagctctccttggctgcgtttctctgggcttagactgaccttcctctgctctttccctccccctcctcccaggagagtcagtcgattcgagtgggcgtgggttgcttcctttgccatgtgtgtgctggctctggactcctcagccctttcttggctggcctgaaacttactgtgcagaccaagctggtcttggacatgaggcatccccaccccctcagcccatctctgcctcccagctactagaattacaagcatgtgccagcatgcccagtatctttagtctagctgtctttctggagtgagtacccttgtggagctatccacctacacctccttttgatacaggcgcctccaggacaggctgtcattaaatgaattactgttctgttgccgtgattcactcctgtggttacctgtcaacttcaaaaccgggaatcctcgtcccaggtccgtctctgcaccttccatattcacaaatgatgtcacatccagcaggacagcgtctctcatggtcggttctcactgctcttcactgagatccacttctgtttctccttcagaatcagagactcatgagctctaccttcatctttacctaaacctctgtcgctggagatgaagttcactggctccactctgtgtctggaagagaccttcttccagtcctgtgttgtgtcctgtgagttctctggtttggactgaaggcttatgtatttagccctcagttagagctgatttctagctgtgaggacttgtgtgaactacattgtcagtctgcctgtgtgctttcgatctctgaaggctttctctgggggacatgacgctcctggtttgacaagtggtagggtcagtaaaactagaccatgggtttctaattcaccccttccttttctgaacctttaataaggacagaatatatacttttctcatatattttttaaaaaggtcaaggtacctagcccaaagaggggcaaaccataattggtgttgctggttttttttttaagccttttttattagatattttcttcatttacatttcaaatgctatccccaaagcccccaccctgctccccaacccacccactcccgcttcctggccctggcgttcccctgtactgaggcatatgatcttcgaaataccaagggcctctcctcctattgatggccgactaggccatcttctgctacatatgcaactagagacacaagctctgggggtactggttagttcatattgttgttcctcctatagggttgcagacccctttagctccttgggtactttctctagcttgctcacagtcatcttttggatgtaacacagggcccctaatgaaggtgttgctggttttaagtgctcctgggttccccaaaggctgcaggatgctaaggtactgaggaaagaaccctggcctcacagtctgtgcagaagggtggaggctggctcagtattcttgtctcacagctgctgtgccctgatcagtaacaggctaatactgtgctgtcagaattacttcatggagaaaagtctaagagagcctgaaatgaagacttaaagtcgagaggtgcacccctcccccgttccagcattctttccaagtgagggatgacgaaaaagaattcttagatcttgctcttctagtttctatgagctaatttatcactcatgccgagatgcccagagctttctcagcagtaggattccatctgaagctctagaaatttgatagaagcaaatgtaagactaattagctttgctaatattacattttcatctctgaagtcatacagctatgtgactcccatcttcccttccatttctgtgaggaccactcccacaaatttttttttcccctaagtttggatcatctagaacccgagtcagtgagaccaaaagacttttctgtagccgtgttttatgtgcctgtgtgtttgcatatggcatatatgtatgtacatgttcacacgtgtatgcctgttgtatgtaggtgcttgtgtgtgtgtgtatgtatgtatgtatgtgtgtgtgtgtgtgtgtgtgtacaaatacatgggaggccaggttgatgttactgtcctcatttggctcccagcttgttttggataggatctctcatggaaccttcagcttattgattcagccagacagcctgcccagcacatgttgggattcccctatcccagccccccagtgctgggactaaagcatgtaccttagagtctggctttttacatgggtgcgggggggatccaaacttgactactcaagttactatggtgagactttagcaaatgagctgtctcctcggctcctcttgccttcggtttttaatatcaatttacccaagtttgaagatgccgggggcattgctagcttctgctgctgctgctgctgctgctgctgcttctggtttctttcacttgaggttggaacttccgcacatgccgtggaagtggactttcctttaggaagtgtctatctaagtctgagagttctgtttatgctttgggaacttttgtttccttttattaagttctgcagatcaaatccctggccttgcacatgcatggtaagtatattgctactgagctatgtccctggcccttttatgttttgagacagggtcttaccctgttgcttagcctggccttaagcttgttatgtgtcccagactggcttctaacctgtgatacacgtgtgtcagccttttaagtactaggactagaatcaagggccaccgtgccttcctggaactcagttccttagggactaggacccgtgcaccactcatctggttggcatggttctatagtaaatgctttgacacagtggcatggagtccagtatgcccaccttaccttgtttagatgaaatatacccttcagtggtccttgcagtgtgtctgactccctctccagcaagctccttctgtatttatacagtgcctaagcttatgtaatgactaccgtggacaaggcactgtaggtagcccttcacaaggattatctggaggaatttcctgggtaatttatgagattacttcattttaaagatagggaaactgagaaaggggtaggggtcgggggaagcttgcccagatgagcagtggagtccggactataaatccctctacgctatttattcttacttgacagtttgtgttttgagtttgatttctctgtgggatgggaaaaaagcctttgctcccagggacccgcacagaacaatacagactcagtgtgtgatgtccttggatgcccagagcagacttacgaggtaacaccctcaagtatggaatctgtgtgtgatgtatgttttctttccccaaaactggaatagaacttggaacagcaaatatttaatcagagaaaattcctcttgttaaaaccttgttagcctgtggcgctcggagactgttacctaaaaatacccagcacttactgaaagtaagtgttgctaagtcacccacagagcataaaagaggcttagttaatattggcagtgggagtatttgcccttagtttggatcacattttcaatgccacatacccaccctgtgatgctcctgggtgcctgtggccacagaagggcctgacttgagtaaacaagggaggggtttactgggagtggccacagagaaggctgtacctgccagcgttcggagggagggagaatgtaaggaaggaaaaaggtaggagggaggggaggaggatgagcggtgggctggtataggtggggaatgggccagtgtgcatgtaatatggtgtgtatgggggttagtgaggtggtgtacacaaagtgggaaaaggcaggtttgtaatccaacacttaggaggctgaggcaggtggatcactgttagaccaaggttactctgggttagaccaaggttaccctggggtacaggggagatcttgaaataaaaaaggaagggaggaaaagaggaaacaaagacagataacaattggtattattgacaagtaagtcatggggtggaaacactgggtctgaggttacgaggatttgttgctctcgtagagactagggttctgtccctgacactcacagggcagctggcagttccatgatttctgatgcctcttctgcactcttgacactgcacacatgtggaatgcagacatacatgtggtcagaacacccccacacataaaatacatctttttttttaaaaaaagaaactgtgtaaataaaatagtatagtaagtgatgttgttgaatttcttttttataaatatagattttgcttgtcaatagtactgttcatatcaatgtgactccgctaggggcgagagctctgaaacagccttcttgtttgtgggcccattcatattcataaactttttttgatactcatctacatacctgaaagacacaacttacaggaggaattaatcattttggctcatggtttctgaggattcatagttgagtatctcagcatttctgagcctgttgtgggagtgtgttctcagcctggcaaggaaatagagaaaaaacatacaggagaggccaggccaagatacagtcgaggagaggacgtgaaagattttaagtcagaggcgataactccaaggaaacaggttttccagatacagcggagctgatgcacagcggactcacaaactctgagagcttgcaaactctgagagcatgcgcaagacctgcgccatcttaattcagacaaggccccagcatggggacagggaagtggggacaaagcctcaccttttgccaagaagccgataaaattcatagcttctgggagagggaacgtcagttttcttccatggagaaacactgctcagtctaccaccttctgcagcaggctcagtgctcagagcagtagccacacaagtcgtactcagtggatttgtttgcagagaagagatgatgtatagttgagtgggaagagaagggggcaaggacctgggaggaaatggaggaatgggaagaatacaattaaaatgtacgaacttctcaaaagtaaataaacaaaaacacagtccagagctatgccccactcgcctccctactccacctgtgctctgtctccttctcagaactccctgctaataacattgtattaagaatccattgcatcagagtcctcatgagctggagctcaccctcatgcacgcatgcacgcatgaagggagatgcttcactaccaccctagtcatttctcaacctaatcagcagtcaggagtccccatcacaccatggctttcccatatgaagatttgaacccagatggatgctcactcatatttcaacccagcttaaaacaacaacaaaacttagactccattagaaagcactcacatggcctggctcatttcctccatgtgggcacttcctgtgtctttgtgtccacttttcattgctactccaaagtggtgactaggtgttctcactgggatggctcagagccacaatctcaagtgcctcagttacgtttgtgaaggaaatcaaactgtgctgtctctgcctcatgctctgacctttgctggttgtatctcctgtctactcaaacagcagtgtgttcaagaaggactcgttctctctggtgctcacagactctttggttctctctccctctctcccttcccccaccatcttccctttcctaccctacttctcctacctacctctctctggagagactgagaagctgaaacaatgtatcttctgagtgtcgggactgtcgttatctatcaccttacctagttttttatttgatgctttggattgagcccagggcttcatgcacactagataagtatgtaactctaccaattgagctaagtccacagccctaaatctttaaaagaacatcgtgtatatagaatgtgtatagtactacatgtgtatatgtgtgtatatatgtgttgtatacatgtgtatatatacactcttatttgtgaatgaataaaaaatacccccaccaactaagttgatgactcttcagtagagaagagtaacttttggtgtggttatgtaggcagtttctcactttttatgttatatattgtaatattgcaatagaaattgatattgaaagtccctggaataaataaagatagaacagtacatttatccctataaatcttttaaagagtataaagaaaactaagaaaatgtctttatcctttaaagattagaagagggcattggatccactggaaatggaattacagatccctgtgagccatcatttgggtgctgggagttggaccatggtcctgaaagagcaaccgttgagcagccagtgagctgtctgtccagctagaaactctagcggataggttgttcttattcagtcttggtgctgatttgcacatggctgtttttaccatgcatttgactaagactgaacactcacaggcagctcctctcagcctagttctaacaggcaacttttgcatcttctctctcagattcccttttttgaagagttctgtaaaaagactcaagccggtggtgacgcctgtgagaacctggtagggtattctgcggtgtacagagtctgctttggaatggcttgtttctttgctctgttttgcctgctgaccttaaaagtcaacaacagcaaaagttgccgggcctacattcacaacgggtaagtctcttgttcttccaagggtgtccctagggtctgctcgtcctcactgactgacgttctgctagttgacatttgacactgatgtggggaggatgggctgtgtgtcactggtagcctaagagcggcagtgcctggtgccataataagaaattcagtatacacagggagtttattgtttctactagggtcttcccctgagtcatttccatcctaccgtgaagaagagttttatacaatcagaggccattccaagtgtgcctccttatgggaaaagccactctgtggcactccatcacttccccttgatgtgggaagaacactaccaacaacagaaacatgagctagcaggcggccttacaaggaccttttgtcgcctttgagtatcatttgaatgtctgcctttctttctcttcccagcttttggttctttaaattgctgctgttaggggccatgtgctcaggagcgttcttcattccggatcaggagacctttctgaaaggtacacatggggtattttgggctacccagttactttgttttgacacatttcataaaactcttcaaaaacatggtctagtgtctttgctattttgaactactgattcttttatgagttgaagactgtccaggtgttgggggtttagcttagctgtagtgcgcttgcttagcaagcacgccctggcttggccccagcagttgtatgggagctttgtaaagcagctttacctgtgtgcactccctcccccctttcctcctcctctgcttacaaggagcccgtgagaaggctctgttcctctgctacctaagcaattggaatgataagcttactggcttggagagtaaaggaggtctttaatatttacttgaaaacagatctggcacatcagatccgccactcctctgccgtggaagagtgtcattctctctgagtacaaagcagacctggcagcatgaaactgttgttagctgtgagaactggacaagggacatcctccagtctgtgtccaaactcactgtatgtgaagttagacaccatttgagttgcagttcttactggtgtgtaatacagagccattagtcatatccaaagcagggctccttccaagggaaagaatgggatgcccttttctgagaacaggtaagaatggagatgggatttaaattaaagcgggtcagaatactccattcaacccaaatagattgacttttctagtggagatgagggtcgcaggtaccaaccacacttcattacatctttagggctctatcagtttttcatatactttaaaaaaactggtttaaaaagtctaagtcttccttttatctataacactgttaactagtttttatttattacgaagatacttcatgtatattttagcatatcggagctattatatctatagagagaggtgacctaagagtcctcaggtcagctctagctctatcttattataaacagcctgcgacccacacggtggggttcatccaacagtttagggcagagccaaaaaagccttgaggccttgacgcttaatttccatactggatagccaaggctcattgccagtaagatttaaactgttgatttttctagcagtatttctttttgcttgtgaatcaggccactgtggattgtgtaaacccctgcatctattgagacagctgttagttcagcttgaggttcagcttggatgctccagggccagactctgatgccccagtcctagttgtgccctttcattctagagtgtagttcatggtggaagtcaagacagcaggagtttgaagcagctggtcacatgcctagggaaaaaaaagcaatgaacatctgtttgctgctcacatcactctctctagtttatagtctagactcctctgtccaaggaatggtcctaacaagtaagatgagtcgtccaatctcagtgaacataatcaagataattccctataagcatgcctagaggcccatttctctagtgattctagattctgtcagagacagtagctgtcaaaccagctcacacagacttgcaggtttatctcatgtttatcaagtgcgtatgaggttagcatctaccttgtatggttgtatgggcatgaagtgtattagaggaatgacgagcacaaataaaaagtattgttctttggagttgaatgcacatggtgctcacctctctccctttgggtggtgttcttttgcagtctggcgctatgtgggagctgggggcagcttcctcttcatttgtatccagctcctcctgattgtgcagtttgcacataagtggaacaagaactggtatgtgctgttgtggaaagctctcactcactgacttgaagaaactgtctaccactgacaaaggattacactcccactccgtgtgggtctttccattttctcctctctggtactattttctgtcctctctgccctcctgtcctgctttgccttatgtgcctggctgtgcgcactgtgtggctggctggccatgtggaccatgtgtggctagctggctatatggacggagtatgtctggctggctgtgtggaccctgtgtgactgacttgactgtgggatgagtatgtctgtaccttggacggtgtccaggttccactcctacaaggttagaaagcaaaacaagcacaggcagcacaatgctttggaacaggagatcttctgtgaagagtctgggattgagatagttctcttcttggaaaaaaaaatggtttgtctctactttctaaaacatacaggatccctttattgggaaaacttgcatcctgctgtaagggagctgtcttgcctgtaaaatggtagccttttagtgccttggaaacagcattcgcatccaggccaagagggaagtgcctgtcagtaacaaccatccagcccctctgctgaggccatgttgacactgaggtgctgagcaaagtgcttcattgctctggtttgtttgcttgtctgtctgtctgtctggtggtgttggtgatttatttgggtctcttggataccaggtaagtgtttgccactgagctgactttatttttcaaatagtcctcttttatacccagtaaagctattacttttatgtctgtctgtctgtctgtctctgcagttcaggctggttgtaaattaatgatcttccctcttctgcctccagaatactagaattctaggcatatataaactgtggctgccattttatagatttttctaggtatcattttattctatattttggcaaaaaacaaacaactcacaataatgctgtatgagtatgcattttcttttatgttgagtaagataaaacacattgtccaaactttttcaatactttttatttttaatatattcttcagcttgaacattgttctgccctttttttcttaaagataataatgagatgacatggtagctgtggggatgcatcagtggaaacagtgtagtgacagccatgttattactttgtgaatattagattaagtacagctgagtaggaccagattttaaatgttggggctggagagatggctcagtggttcctagtgcatggtgttcttatagaagacccaagattggttcccagcacccatatcagactaacaccttcagcgccagcagataattggattctctcttgtagaggtgttgcgtgtgtgcgtgcgtgcgtgtacacacacacacacacacacacatacactagctcaaataaatctttaaaactgtttacatgctttggtgttttacctctgcaattacaggatttcaggttgacgtgtgtccttgtaagagatagtgcttgctctctacattttgagtcacctttaaaacgatgctgtcatctcttctataggtcaagttttgaggtggtagagttttcttaaagatcagctaagggttgtaagcacatgccactgtgcacagctttttaggtcccactcagcctctcatggtactaaggcaagcactttcccaactgagctacctcctgagcccagcacagcttttctttccccgactttaaagatttattaaattatgtgtatgggagtacttacatgtgtacttactaaccccttttttgattctcctatctgtgcagaatgggtctctagttgcaggtgggcaaggagtcggcgaatgacaaacagaagcaacacagagagtgtgtagaatctgagtgtaatttttcaaatcgaacatcaaactttttatactgaagagtaacaagaaaccaggcgagacacatctgctgagttactgtgacacaatacaaaaggaatgtatacatcaaaagatggcagggaccaggtcttatttaccactaagatgggagccaggtgtaatgctagtctattgttaagcccaccaccaggggttcttagtaaatgcttgatttatgctgtttctttgggcctagggaagaaacctgtctcaggggaattccctaactctttcatggtaaatccatctatttgctatgccattgtgtatattcccttgtttgggtgagactggctactgtcctaagtaatcactctgcagaccagccctgagctattccagctccattctttgtaatgcctaattagttttgctgtctctactagaagtaaatttgaatgttactgaataggtaacattcttactgaattccaagcttgtcaattcaaggattttctaggacgttggaacactggtggaggcttacctatgtcagaattcaatctttaaaagcacttataataaaacaatactgaaagagatcacatggatccatacaccagactaacatggggatagggtatgagtatacgggttatgagaatgccaaggttccaggaggttgagtttccttgaaactctttgcctcctgagtgcttccaggcctctcagtttgttaagcaggcttcactggagtgggcgtagcacatgtcagtgcaggtacctctgacattggattcccaggagtgggagttacaggcatgtgtgagcctcctcatgtacgtgcttgggactgaactcaggtcctctgcaagagcagtaaatgctcttaaccactgagccatctctccatcccctttccctgattctactcactgtatttctcccttagtatttcttcagtttggagaggtggtcctgatgcaggctctttttttttagcacaaagagaaacatactggggctgaccaggcttctgcgagtagagctgtttgcttctcctacaagagaaggtgatctcagagggactgctggcagaacatggaaagacggagaaagctcacagccaactctactgagtgatcatctttacctcatacctcagtgcagccactgtgtttcccagggctgctagcatcagagtggagaagtgctgggctaaagctgatggttgtcctttttagttgatgaacatgcttgggccaggagaggagactcatgtttagaaataattctaagccagtgaacctgcagaatttttggaactttctagctgagctaagagtgtaatcattgttgaaagtgtcttaggctctgtggttccagggtctctgctggggctaatcccagtatctgaaggatagaatgctccagagaatggggccttcactgacctgtttttctctcccttccacctcacctacttctttctcggagaaacaggactgcaggcaccgtctgtaataagctgtggtacgcctccctgtccctggtgacactcatcatgtattccgttgctgttggaggcttggctttgatggcagtgttttacacacagtgggacgactgcatggacaacaagattctcctgggagtgcacggtggcctatgcgtgctaatctctctggtagccatctcgccctgcgtccagaatcgtaagcatggtttttttctttttgtttttcctttgtgaattttaacaaacccagtaggtttctttagaagcccaagtcattctttaacttcctgtggatgggactcagcctcctcttcatactccatgcccatttggaggtaataactagatttacttgttatccaaaaaaatcggaacttaagtcaataatagatagacagtgcacacagggaacctttaagtgggaaatgtgcttagtctctgttaagcaagagatgtataaattcagcttattgtgtccttgtggaatttggatggcaaggctcagagcagctgtatttgggattgtcttaggtgactggcaacctgactaagacaggaagcgggaaatcctatcctggttgcttccagtctcatgaccagagtgtacttactgaagtcagcagaactgtctgatcttggccttgctttggccgttgttgagagccacaaatgcagattcagtgggggttgaaagcaccttagaaagtggagctgtgaactgttactaataacctatctatgacatcttaagcaagtatgctgaagacatgctgtcttcagaggtgtaaaagtgtccccagtctggtgttgattgaaggatcttactccatgggtgattgatctacacgggccattccaagttctggataggaaaaggaaatatgggcaaaaatggaaagccccttcgaatctctttccaaagtagtggatttgaaaagctgggcacacctgtgcattcctgtaagcacagtacgtgggaaatggaagctggaagatcggaggtttaaaggcagccttgactgcataggtttgaggccagcctgggctatgtgagactcctcccctttaagggataaggcagcagcaagtactaaatcattttagcaggactaagatattttccatactaagtttttaaccacattacagaaattgatatgattattctcctagttcctgcaattgatcagtttgttcctaaaacaaactattggtaagctgaccagaatcttttttgggttaatcttaccttctgaaacagccacaacattttgcttaatgacattagttctgagggtgtcttgttcccattgcagagagcaccattatgatagcctgttacagtacttctactgataattattattgaataatggtaaataagaaggaatttaactagaaggaagggtgaatcctttcctgtcagcaagtgttgaaaattttagcaaagagagatcccttatccctagattccatagttgctccagatgatcccagtactgagttatcacttaaatattgtactttaagtccctcccagtgaatgtctgtcccatagcttcccttgttagcctaaaccaggttttgtacttagtgtggccaagaatggtttcatttttggtgggatttgttttgttttgtttttacctcttgacagctcaatgcttgtgcttcatggattgtctaaagaccttgtacaacccacaatgaatggtctgtgaaatttgtctattgcaccaaactaaatgatgatggctattttctttttctgatcttgtgatttatgaactaatgttataaatttcatagggagagagactgacagaaggctcagctagcgtaggcgcttgctgctaagtctgataacctgaatttagtcccttagacagagagaactgactcctgcaaattattctctgacatccacacatgctatggctcttgtgcacctgcatgcacccatacatgcatgcatgcatgcatgcaattgaaaaaccactcaggggtctaggcagtatgttgaatatgttacaggttttggagagttgtttatggagaagttggacagattttggcatctttaaaatagcatgaatagggcatattcgctacccaatattacatttttttttcctgagacaaacacttcattaggttcccctttctttagtaaaggtgagtgtctaagtttaaggagcatcatccgttggctgagggttgcagggagggtggtggtggtagggttctatttagggtataatgtcttactgccaggacttcaagcctgtcttctgtctgtctctttctaggacagccacactctgggctgctgcagtcagggctcataagctgttatgtcacctacctcaccttctcagcactgaccagcaagcctgaaaaaaaaggtaagcagctctgttcaagagtgtgtgctcacagtgcacatgtctgttccctagacctgaactcttactgagctatggagggttagagaattcaaagaaccagggttttctatgctttgtcattaagtaaagcctttaacagcaaaaatgaaattttctcctcttaaaacatttttttaattttgtgtgtttgtgcacatgcttatgtgagtgcaggtgccccaggattcagaaaagggtgcctgatcctctggggcgtaattgcaggctactgtgagcagcctggtgtgggtacaagagcagcaaggctccttaagctctgagccctcttcccagcccccggcgtgtattgagttttctggcttgcagagaagagtgaccagagaggagcttcagcagttgtctttaggcctccgctgcattctgtcattctgctctggcaagaaccactttattttagtgttttatcggcttcgtttggttttgaatttttgtttgtttgttatgtttcctacatcaggggtttattctctgacactgagagaggtgggaggagcgaaggtgagggaaacagaagacagtttgaacctggatctgtcactgcctgacaggcaatcccagtgcttgccctagatgacatttatttaacagcgacagcaggatgtagagaaaggaaccagactgcctgagctctgttctctgtgtggttttcatgctgtgaaatgttcatggtgtatgcatcagtcagaacagtagttggcacatggcaggtgcttgtggggtgtggcctgttattagtgtgaaattgttacagtgatccttttgaaggtttttttgaggcagggttatatagtccttgctgatctagaactccctatttagaccaggctaaactcaaaagcacagaaatccacttatctctgttcccccccacacaagtgctgggactgaaggcatgtgccaccacaccaggaaaattttaatctataaaagaagtattacattctagagtcccaaattttcatatttatattttatctttttcccttttgtgatacataaggtgtacatatatatttatatatgcatacaggtatatgaatgtgaatgttcaggaatctttgatccgtacatcaagtaaatatctcaattaaatagaaaataaaagttactaaatttaaaaaacaaatgcaataattatttaggtataggtactttttattggtctgtcttgttttgagagaaggtcttactataaacaagttggcctggaacttactatgtagcccaggctgtgcttgaacttgcagtttttctaacttggccgcctaagagctgggattattggtgcacgccaccatgttcagctggggtctcatcttcatcgttgtagtgggaagtagtagatggaggttttatagtaagtatggcttatcccaagtttaattatacacataaaatctcaatcatgacccagcttaccccaggtcttaaaattttcttttataattgcttatatattcatctctggttttaagttaatggaagttttgttcacagtatattttttaatagcatgtattgctttaaaaaacagtaaaacatttatttttaattttaagtagtaaatataaattttatattttattcatatcttacaaaaatcattccactggcctaaaaaagaaagttttttgaagccacagctaacaaggttctattaactctttcaaagtgaactcccagtgatattctagtttagcttcaaacagaatgtgtgtttgtagaacaattaatatatttccatgttttgggttcaaattggcaataagatgtagttagatactcacaattgaagcatcatgtatttttaaaaaaagcaaattgctagtgagagagatattatagagacatttctttgaaattttagactacctcagatggttcccaggtcacgggtcaagggaagccatgtttcttatgtctgcagtaacctgtcttctctggctcaggaacccattaccctgtctctacgtgggcttcccaccaggggactgtgctctacccctctctgcagaggctttggatccagtttaaaaaaaaatcatcataattaaaaacagtgggtttaatgtaggagaagcaagggtgactaagtcctgagtcgtccgtcacacccttgaaggcttaactagaatggggatggggctggcccttattcctcatgtgtgctgatgtgggagagcagtgtcttggaactagcaaaactgcagtctgtgcagcatcagactatagagtagaagttcccagggtgaagggctcagtgttgggaggagtcatgccagcacacttgaatcttcccagacagatgctgtaaggtacagtagatctttgtctaacgtgactgtgtttgcttcgtgttatttacaagtcctggatgaacatgggaagaatgttaccatatgtgcgcctgactttggtcaagacctgcatagagatgaaaacatggtgacttggctgggcacccttcttctaattgtgtgcatctcatattcatggtaagtcctaggagttactgatgctcagcttacaggttttagaatgaaaggaacagagttatttacgtttcagtccctgtccgtaggagaaaactagccagaggcgcagtgttgctgcacagcctcctatgagaaactcctgtgctcattactccactacaggggcaaactgaatacatgcatgttttgttaaaaggcagttttgaagacgagttgctatggcatcgttgaagagtaagggagcatatagtgagaatgatgaaaatgtaccacatgccagagggttctggcaaaactctaatccaaggggatagcgtttgttttgttatcggtggagagaaaacctgggtgttctgtgtatggtccagttacgccaggaaatgttccttctccgttgtgctgaaacctgcaaagctaggaagtaggtaggcaacattgcccaggtctgtgggatatgtgtaacggaagcccgttgtttcaccggcctgtgccagaggagactccactttaaaagcacttcaaagatccctggagggaaaagtcggtgatgggtggttctgggaagatattttccggtactgaagcttcatttggacaggagccttttcagagctgttttacttcagtgtgttgtatgttttgtttctctgtgtaagaaattcaacttgtcatgggcatgctatgattttcctcttgctgaaactaaacaatcatggtggtgacagactgtgtaaacacagagtggaagagcactgacaggctctctaacagtcctgctgagaggaagggccagccagtaagggcctccacactgcaaagggcttactcagaaccatgacctagccaggaaatgcttgctcctgtgctgtgtggctaaagtactggttctctaacgaggatcctcagtctgcctgtgccacctgacagtctttcccttaggtcagaagggaccttggtggttgtcccttctgacacttaattcttcacttgtctacttagtacctgctatactgaaacagagacagttgaggggagatgtctgaatcagtaaagggcttgccgtgtaagttcaaagacctaaagtcggatctccatgcccatgataagagctgagttttgtcacccacaccactaaccctagtgctggggatgtccacaggtgcagtacaacttgatgaccagccagtctagccagtaagcttcaggttcagtgagggaccctgtctcaggagagtaaggcagaaagagattgaggaagatacccagtatgtgctggcctctccatgctcacacatgtatgtgtgcacgtacacacaggcatatacacaattaaaaagaaaaagaaacagtgaggggcattcaagtccatggccatttccagtgatccccagcctcatgcagccactttcccctgctagctagttgattgtcagcttgaaacaagccagggtaatctgaaaaaacaaacaaacaaacaaaaaacagaatttggagaaaaatgacaccattggattggcctgtgatccagccttagttgcattttcttgattaatgattgatgtatgaggacccagtgcacttgtggccggtgccatccctgggcaggtagttgaagtagaaggcaggctgagcaagccatgaggagccagccggtaagcagtgctcttccatggcaagtggtgctcctgcatggcaagcagtgctcctccatggcaagtggtgctcctgcatggtctcagctccagttcttgtcacaagaaatctgtccaaggaatctgacaccctcttctggactctaggacactgcacacacatgctaaacagacatgcatgcaagcaaaactctcatgaacataaagttaaaaaaataaaaatctcaagaatattggtcaatcaagagcgaagtaggttataaagatcattcctttaaaaacattcaaatacacttgtgtttataaaaattcccaggaggggggattggcgaggtggcttagtggttagagcacttgatgctttgcagaggatcctgggtcagttcccaactcccacatgacagctcacagccatttgtatataactccagtcctactgctttctctgtggccacaagacatacacgtggtacacagatataatacataaacactcatacacataaaataaatcttttaaaaagaagcaaacaagcccagaaacccccaggaggagacagccagagttgtggtagtagtggcattagagagaagtgacagggtttagatttgctgcggccatcagtgggaaagagcagaatcctactgggtacacagcgtacattgacagtagtgggagtgtctcacagtgtggactatttacccattcagattttttcctgcttcttagagttgcaaagactcacttttacagctaggcatatgggtgcatgcctgtaatcccagctaatatgggaggctgaggcaggaggattacaagtgtgatgctagcctcagcaatttaaaaaaactctagttttatttaagtcacttttaggactgggagtgtggctcagtggcagagtgatgcacacaggtgtatgcacacacacacacacaataagaggaactcaagtcaaaggccatttccagtgagcccataaagtcaccatgacttagcacagcctttgtgaggatctgggtttaaaatacccaacccacccaagaaagaaatcacttttaattttgtgcttagcttagtggaaatgaatttgcctatcattctgtatgtataaaccctaggtctaatccatggtgttataaaaacaaaacaacaaaaaccaagcataaaacagaaagatcacattttcaagagatagtctgagaattgcagcatcacagtggagattgttagtttgatattccccaaagacattaattttcaaagctgacagctgctatttagaaatctgtctaaatgccaacagcagacgttttctgaatgctggtaattaaactgcagaagtgtaatggccagtggaatgctgggacaaagcagcagcctgcacagagtataacctgctgctcgtttatgcttctgtagcacataggcttgaacgcactctcaggagttggctgagcatcacgtgggggtctggagattgatgcttactgtaatcaccccttgcagcaccaggaggagtcagcttggagaatgttataaacaaacggtttggcatctttgaagaaaggacctgctgctaagggaaggccccagtaacatgaaggggttttcagctatttccagagtttacataaaaggagcatgggaggctggggaatgttctcaagtgaggccacactgtctgcgtagaagctgttatttgaatgattgtaggaatgcttaatttcttggtggaaactgtactgactagaacaccagattataggagaataaattaccagtgttccatgtaaaacccaggattgtctgcggtgacattttgtaatgtcattttgtaataaaaagcttggctcccgtggctcctctcagttccctggaggatccttgtctcccaaatacttcctcgggtgccatgactgccctgggtcctcaggcgcttcctgagagtacacttcctctgtgctgaattctctctctggcctcgctttctggcaatgctctctctagaacccctgtgatggaacatcccaggaccccaagagagctcacctgccaaagttccctaagagttggctctattgatccagctgaaacctgtgacaaagtccagctcccaaaggcctctaactccttccttggactcgaggttggagcactattttatttccagctgaacctgtcagactggacaggaccctggaggccttgtgaagaatggagtatgttcctacaactctgtacctcagcttcaggaacctcgggctgagccacctttgttagccatgtggagagatgacatttacatagtgactggtttattatcattagaacaaaacacctgatcaaaaagtcttaagggagaagaaatttatttcggctcatgatttcccagagagtcccagattgctttctattactgtgataaagaccatggctataccgactagactcaggtagtcatttggaaagagggagcctaaattaagagactgccctcatcagactagactgtggataagccagtggtgcgttttctgtatagatgatgacatgagaacttattgtgggcagggttacccctgggcagtggtcctagggactataagagcaagccctgaagaacaaggtaatgaggagtgccctctacacacgctcttgcctcacactcttgtttgagtgtctcctgcccgacttccctcagagataacagtgatctgaaagctgaaataagcctttctcctccaagttgcttttgaagtgtgtttatcacagcgatggaaatgtcaactaagacagtgaccacataagtggagaaaggggtttctttcaccttacagcttgcaacctgtcaaaagaggagggcagggcaggaacacacggaaggaacctagaggcaggagctgaagaagagaccattgaagagtgctgttgactggcttgctgttcatggcttgctcagcctgctttcttgtactacccagagccacctgcccagggctagcaccacccacaatgggttgggtcctcctacttttaccaatttaagctttgcgcgctaatggtctttccagcccaaagttcctaatattttgcaacccttcccagatcaggtctgtcacagcaatagccaagtctttggtgccaatttctgttctagttgctttctattgtgacagtgatcaccccaaagatgctagggtgctaactaagctgggtgacctgcataattagattattaggaaacatttgttttataaagtattccttggctattttcatttagttatgcttaagagaaaagaaataacctttagtatttaagccacctaggaaaatacccattgaatataaaatgggaaagctaagaatctatattaaatgctgagcaacttcctagttcaaaataggacgctcacagcagtacagcgtgccatgtggaacaagggggtatgctgtgctggtaaggacggttggcttaagctgagaaccaacggcatcctgaggagcagtgttctctctgcacagtctgggcctgctgctcttctctaaggagaaaggaatggcggtcatttgcttttttattttagaaatcctgccactgcctcagcagctagccagaactctccatgtctatacatcaggaacgtgggctggcctccgctggctcccacagaattctggtcttctttgaatcactaatcacacagctctgtgggaacatggttgccttttgtcacacaaaaggcatggggtgtgtcccgggcctgccctgtccattttctagtatgaattgaaaggtctgtgatctccaaaagcaaattgggcattttcttggaattttctgggacccgtgggacttcggctcactccacagtgaactaaagcaggtgctcaggtggcgtttgcgctgtgcacgatctgacgatctgacaatactgcagaggttgggtattgcaagggtttctagagagaggggaaggcaggcagtgttttggtgaatatgtaaataattacaaggaacatctgtgtcacattgcaatgtgatgcagctgttttctgaatggtgacagattgcaccacttggggctgttgtccctctcctcagccttgcttcaccacagattatagtgactgacatctgtaatcccatcactcaggaggttgaggcaggaagatggccacaagtttaaggctagtatggactacatagtgagtttcagaccagcaagggcggcatagtaagactgtgcctagaatgaatggatgaatgtgtctgggagctgactttatgggtaaactagttaatatgcaagcgcaaagacctaagttcaaagtcctagaactcagtaaaatcggacacatctcgtgcctgtaatcccagtcctctacagtgagacgggtgagggagagagatggggagcccctggtagctcaacaggagacctggaaaatgggagaccctgtctcaaccaaagtgcaggcaaggacttatgccgcctctcccttcacatgcactcagtgttacacacatacatgcatattacagagacacacacagagggagagagacagagacagagatggggggcactttaagagtttacagaaccatgtttttgttaataattctcatgagttttatggggatagtccttttactgtggttgcctctactctgcataaggacaagactgtccctacggatgaagtgaatgtaaatagtgttagacagaaaacgaaatcctcccccattttagtgccatctggtgcaaagaatgaggtgtcaaaggtgcttgaatcagaaggtttgtcttcccaaaactttattccaaagaatttatggagtagtgatggaagtgcttttaaagagttttcctcaatttccagccgaaaacttcagatactaaaattaaaattttgtctttccccaaggaaacttcctactgtactatagtataactggcatgcagaagtcttgagtgcataaccagatgagagtgttcttccgaatatggccagtgggaagtttttgtccttcccttaccagtcgggatggagtagaagaattgtggattggggtctggatcccagaggacctctttttctattgctccccatagcccattgataccttttctccttgggcaggagactgaggggacagacaaggccctgctgcttcctggttgaggctgacttgatggacatgaatcttaatctctgcctgtgcactaggagcctaaccgcatgagcagtcacccctgtgtcctgtgtcctcgtaaacttgcttctttgtgagctacattttcacagacgaggccctgaggctcagaacaggggctgccacacgcagcacacttggcctttagggattatctgcaaaatgcatgtataaagttaggctaagtgttgaatatatgtttgtttaaagtgcttccatgtttttatatatgggagaaatgagcacttttaccattgtcagtcaatgttacagattgttttgcctctctagatatggaggaaagatagggaaagattttgaaacagggtgctgtgtaggccaggctggtctcacattcattatgtagtcgaggatggccttgaatgtctgatcttcatacctcttcctctcgggttgtgattacaggtctttataaccacacacagtttatggggtgctgggaactgaacccatagcttcgggcatactatgcagtcactctactagccgagggacattgcctggacttaacaaaacaaataacttttgatctctaagtgagactg

SEQ ID NO: 920 - DNA, 836 bp, Mus musculus
ttggcctgctgttgcggatctgctggctgctccctctgctgtggctgctgccctaagttccgacagtctcggaccacccgcttcatgtatttattctacttcatcctggtcatcgccctctgctgtgtgatgatgacaccctctgtgatgaagcaggtgaaggaccacattcccttttttgaagagttctgtaaaaagactcaagccggtggtgacgcctgtgagaacctggtagggtattctgcggtgtacagagtctgctttggaatggcttgtttctttgctctgttttgcctgctgaccttaaaagtcaacaacagcaaaagttgccgggcctacattcacaacggcttttggttctttaaattgctgctgttaggggccatgtgctcaggagcgttcttcattccggatcaggagacctttctgaaagtctggcgctatgtgggagctgggggcagcttcctcttcatttgtatccagctcctcctgattgtgcagtttgcacataagtggaacaagaactggactgcaggcaccgtctgtaataagctgtggtacgcctccctgtccctggtgacactcatcatgtattccgttgctgttggaggcttggctttgatggcagtgttttacacacagtgggacgactgcatggacaacaagattctcctgggagtgcacggtggcctatgcgtgctaatctctctggtagccatctcgccctgcgtccagaatcgacagccacactctgggctgctgcagtcagggctcataagctgttatgtcacctacctcaccttctcagcactgaccagcaagcctgaaaaaaaagg

SEQ ID NO: 921 - protein, 279 aa, Mus musculus
  VARIANT (1)...(279): Xaa = Any Amino Acid
LACCCGSAGCSLCCGCCPKFRQSRTTRFMYLFYFILVIALCCVMMTPSVMKQVKDHIPFFEEFCKKTQAGGDACENLVGYSAVYRVCFGMACFFALFCLLTLKVNNSKSCRAYIHNGFWFFKLLLLGAMCSGAFFIPDQETFLKVWRYVGAGGSFLFICIQLLLIVQFAHKWNKNWTAGTVCNKLWYASLSLVTLIMYSVAVGGLALMAVFYTQWDDCMDNKILLGVHGGLCVLISLVAISPCVQNRQPHSGLLQSGLISCYVTYLTFSALTSKPEKKX

SEQ ID NO: 922 - DNA, 51928 bp, Homo sapiens
  misc_feature (1)...(51928): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaactttgggaggctgaagtgggcggatcatttgaggccaggagttcaagaccagcctggccaacatggtgaaaccccatctctactaaaaatacaaaaattagccaggcgtggtggcaggcgcctgtaatcccagctactctggaggctgaggcaggagaatcacttgaacctgggaggcagaggttgcagtgaggcgagattgcgccactgcactccagcctgggcaacagaggtctcaattaaaaaaaagcggagggggggggggcggtcagatgatagaagcttatggcatgttgagctacagagaggaataggggcttggggcctctgggagttgctggcaacacgtaatgggagagtgaggggaagaaatgtatggtgaataaacgtctgatacactttactaatgtagatttcctctacagatgtaaattttttgtataaaacagcagctttgcagagctactcctgtgtcttcagcttctcagaataacgagcttgaaatacgcaaagaagaatgttttagggtggcatatcttggtttttgtgagtgacgccaaggtcagaggtaaccaggtccacgaacatttgtgtctttccataatgttggacttaactgatgctatttcagttacaaaagccaccagctatgtggagttcccagggagccaattcttcttagtacttctcatccactcattagatctgcaggcacacaggttccagcctctgcaccagccagtcagtattgcaaaccgtacacaatcgtatactctgtcaatatataaatgttactgattaaacattgtgcaacaaacaaaataacatttaacattaagagaaagggaataggaaaagggttaatgaagtagtccagggagagcaataaagaaaaaaagaatttcctggtctgggctggttaatctggttggttgtgcaagaaacagtctttgatgtgggcagagccttcggggcagatgccaggtgcttgtcacgagttagaaccgtacctaccctttttatggccacagagtcctccagtgaggactgatagttgaagactgtgcttgtttatctacttatctggttggatgcagtctttatcaagcaaaacatcttgtctctgttgtgacaaaatggtgtaaaaaaaaagtcataaaaaatgtacagttttaggaatttgctgaaaacaaaatgttggctatttcctcatgaagtctttcacatgtcttcatgaaaatggagctggccaggtacagtggctgacacctgtaatcccagcactttgggaggctgaggcaggtggattgcttgagtctaggagttcgagaccagtttggtcaacatggtgaaacaccatctgtacacacacacacacacacacacaaaattagctgagcttggtggtgcatgcctgtagtcctagctactcaggaagctgaggtaggaggatggcttgagccctggaggcgacggttgcagtgagccaagattgcgccactgcactccagcctgggtacagagtgagaccctgtctcaaaaaggagtggggagaaaatggaactctttgtttgtttgtgtaaaggaaaataaaccctctcaggactgcccaaactctttatgccaaatggaaacttaagactggagagacagtcacgtgacactgctgctgtcccctcgcaccttgcccccctgcccagtagatagctgcgacttcccaaccttgtgtcaaagcgctatgcattagccacacccctggagaaggcagaaggcctcgtgcatcccggatgactgccctcaaattgctcataagtaaattctctgctggtccctaaacctttcaagatgtgtatcttcccataaaaaaggacatgtcagctgtaactttaggtctgcaatctaagtctagctccctgtccacggaattgcagtctgttacatttcacactgacaatgcccattacaagcttatcttcccaggtgcagaacaaagacaggacagcagtcatttctctgcctaccctgagactacataattaactcttcctttactccctttttgaatgtttatcatatctcttttatagcggagtttactgggcactagttaaaatctcaggagaatgttgcatttgcctcaccacctgcccccttttcctgcatgccttctcccctttaaagaaatgggtaaataccgagcaacctctttgggagcgccagccacagaggattctgtgatttgtgtgtttctcagcagcccctcaagctctggcttaattattccccattgagactcttgcctcagtctctcatttgggttgacatttgtttatggaaatcgtgatagccacagatattattgtttcttcagtatctttttctggagaagaaactgtaaattatcttctttatcacactttccttttaccttcagttttgtgctattttttctctgtgatactttatttttcttatgaataatagttataatgtgatttattttctgttcagaagagtgttcaactttgatgttgataagaagcaagtttttatgactgaccaaatccttattttatgacattactaggaatgtgctgcttgttctcattgtgtaagattttaattattctgataatgaaactgattatttcatgtggaagtcttctaatttggctagaataagctattgtcaacatttatcagaagattaagacccactaataaagagctccagtggatcaagaaaatacccaattaacagccaattcagagaaaaaaaacagatggccataaacttgagaaaagatgctgaatctcactagtaataaggaagatgtaccttaaaacaggatattgggtttttgcctttaaattagatgtccaagttgggaaatgtgcaatctcagatattactggtaggatgtaaattggtacagcctttgaaagtatgatttaactcatcttgaagtttaaaaatgtagatactggttgaatattcctaatccaaacatctgaaatgtgaaatactctaaaatttgaaacttttaaagtgccaacatgatactcaaaggcaatgctcactgaagcattctggatttttttggattagggaaccttagccagtaatatagtgtaaatattccaaattctgaaagacttctggtcccaagcattttggataagggacattcaacctgactacttgacctactaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaatttttgtatttttagtagagacggggtttcaccatattggccagtctggtctcaaactcctgaccttgtgatccgccccctcttggcctcccaaagtgctgggatttacaggtgtgagccactgcggccggccaagctcagtctttttttttttttttttttttttgagaccaagtctcgctctgtcacccaggctggagtgcagtggtgcaatctcagctcactgtgacctccacctcacaggttcaagtgattctcctgcctcagcctcctgagtagatgggattacaggcacccgccactatgcctggagtttttttttaagtagagtcagggtttcaccatgtaggccaggctggtttccgactcctgacctcaagtgatccccctgcctcagcctcccaaagtgctaggattgcaggcatgagccactgtgcccagccccagctcagtgatttttatagacaaactggaacccatgtgatgtgacttattcaaggttatagcgtctttgtggcagagccagaagtcgaaccgagtccttgtcccctgtctgaaccttgtttctttactggtcattgttgactttttacccaataaaatttgaacctttgattttcctggcaatatgtgtttgcttttaagttgtgggtcattatggattttatgaattagggcatctattagggtacctggcagatgtagtgtggaggataagcttggatatttcagggtcagactgcctgtgttcagatcccaactataccatttattgactgagatgttgtcaacctacatagattctcaatttttctcttctgtaaagtgagtgacatttataatagtaatacatatcttatatggttgtgtgacaaatatgttaggtacactgatcatctagtaaaaattagctgtggttattctcttttgagcaaaatacaacgaaaggttgcctcattgtgttcttcatggtcttttgcagcctggcgctatgtgggagccgtcggaggcttcctcttcattggcatccagctcctcctgctcgtggagtttgcacataagtggaacaagaactggtgtgtgcctttatggaaagcttcccattgactcacagaaactgcccagttttgaccaaggctgtactcaactgcattgctagggatttgcagttttgtttccctttatacctgcttttttgtacctcttcatttactcctctccttcattcacttctcactttttgaccccctgcccctactcccttgcttgggctctgagtcaaccagtggtgtgaattagccacactcaatcccctgctcgtacgggtctcgatctcctgacctcgtgatccgcccacctcggcctcccaaagtgctgggattacaggctcgagccaccgcacctggccttgctgtgtttttttaacagactcttgcttataagaatctagaaaatgtgctcattgctcttaatagaacaactaaagtaccttttcttccctttttcatttatctctttgtaaatatcttgagaaggagatgatcctaaaaacagtaggatagaaaggtcatgggcctggcaaccaggagatgcagatttcagtacccttttgttttctttttcttttattattattattattattattattattatttttgagatgggatcccactttgtcattcaggctggagtgcagttgtgtgatcatggctcactgcagcttcgatttcccaggcttcagtgattctcccacctcagccccctgagaagctgggactacaggcatgtggcaccacacttggctaatttctttttctgtttgcttggtagagatgggatttcgccacgtcgcccaggctgatcttgaattcctgggttaaagagatccttctgccttggcctcccaaagtactgggatgacattgtgttcggcttcagtgccccttttaatgcttgctctcactgtagagctcatcagtcggcccctctgacctccattttcacacttaaataatgtgtttggactaactggtgtgttctttttttttcctttctagctcaaattttgtggtttacagtgtcaattctctattagaattgaaacaaagggctttaggtgtcgagtgtaaagactttttttggatttttagtgggatgggagagcaccagagggccttaaaaagggaggaatataatctgttttaagtccagaaaggtgaaaaggtgtcaggggtgcaagtaaggaggtcagggggagtcaatccaggtgagggaggagtagtctggaactaagtggtagcaaggagctggatcctcctatgttccaaagccagctctgggtggaggtgggtgggggaggggagagcagcaagaagcttccagagtgaccacagttcttttgttcttttcttttcttttcttttcttttgagacagagtctcgttctgtcgcccaggctggagtgcagtggcacaatctcggctcactgcaagctccgcctcccgggttcgtgccattttcctgcctcagcctctcaagtagctgggactacagtcgcctgccaccatgcccggctaattttttgtattttttagtagagacggggtttcaccgtgttagccaggatggtctcgatctcctgacctggtgatccgcccacctcggcctcccaaagtgctgggattacaggcgtgagccactgcacccggcttcttttcttttcatttcatttcatttcattttcttccttccttccttccttccttccttccttccttccttccttccttccttctttccttcctgcctttcctcttcctttccttttccttttcctttcctctttctttgctttcctttctttcctttcctctttctttctttccctcttcccctaacaatgggaagttggagttgctgttttctgaggttgggataattgcacaatagcaggtttgggggatggaggaatgggggtgtcaatatcaggaagttagccttagcctggatgtgccaagtttgagataccagttagaccttcaagtgggtctccaattgttaaatgaacaaggggataatataagtgacattcaggggaaaggttagggttgaagatttaactttgggatggactgtaaacataaattaactgaaagaaagtccttcatattctaataacataaccaaaaagactagtgaatagaagcgttggtcgtctcccacgcacaaaccagtcagcagtgtttacctttttctgtataattcatgctgtctccccatcatccattattatttgctcttagatatttttttccttcttaaaatcccatttttctctcatttcctttgtatgccttttatgttagaataattccaaggtcattggagtgtctggcacagtttcaggaatatgacggtcattatcattttggcctttcctccctattttctttgtttctggttgcaggaactttttcatcattaaaacattttagctgggttgcttgaacactttccagttttgtgagggcataaagcaagttgctttttctgtgaggtttgggagaatgtggttacaaagagcaatttaatcataaggcagatgacaatgattcattcaattcattctccctgttctgtcctcttcatttagcatttatagatacttttttttgttctgaacaatttccctttttgtgtgagacagggtcttgctctgttgcccaggctagagtgcagtggcatgatctgggctcaccgcagcctctgcctctggtgtccaagcgattcagccactcaagtagctgggattacaggcatgcaccaccacgcccggataatttttgtatttttggtagagatggggtttcgccatgttggtcaggctggtctcgaattcctgacctcgtgatctgtccgccttggcctcccaaagtgctgggattacaggcatgagccaccatgccctaatttattttttaattgacatattgtaattgtacatatttatcgggttcattttgacgttttgatacatatatgttatatagtaatcaaatcaaggtagttggctattcattacctcatggatttatcatctttttctttctttcctttctttttttgtctttttttttaaagagacagggtctcactctgtcacccaggctggagtgccgtggcgcagtcatagctcactgcagccttgaactcctaggctcaagaaatcctcctgcctctgcctcccaagaagctggctaattagcatgtccagctaatttttttgtttgttttttgttttggtttggtttttggtttttgtagatggggtcttgctctgttggccaggctgtatcatttctttgtgttgagaatcttcaaaagcctctcctctagctgttttgtaatatacaataccttactgctagccatcatcaccctaccatacagttgatcaccagaatttattcctatctatttaactttttttaatgtcaaattttcctttactattccctgatactattttagataaagaagcagcacagttacaggtccttctcttcagtacagggaataaagagctaaggtcagccagtatggctcttagtaaaggtaattctctttcctccctaagaagatggcatcagagctgctggcaacactttgtttctgtttttaaaagtttatttattattattatcaaacatttagggccaggcacagtggctcatgcctgtaatcctagcactttgggaggcagaggtgggtggatcacgaggtcaggagttcaagaccagcctggccaagatggtgaaaccccgtctttactaaaaatacaaaattagcccggcatggtggtggatacctgtaatcccagctactaaggaggctgaggcagagaattacttgaacctgggaggcgggggttgcaatgagccaagatcacaccacagcactccagcctgggcgacagagcaagactctgtctcaaaaaaaaataaaataaaaaatttagacagggtcttactcttgcccaaactggagtgcagtagtacagtcatggctcatagcagccttcatccacccgagctcaggtgatcctcctacctcagtctcccaagcagctgggactacaagtttgcaccacaacatgctgctaatttttgtagagacaaggttttgccttgttgcccaggctggtcttgagctcctagcttcaagtgattcacctgcctcggcctctcaaagtgctgggattacaggtgtgagccacctctcctggcagcactttggagtagagactatggcgcttcggggctctgtgtttatggagaaaacttggggaagcccagtgaagagccacttttttcatcctgccaaaaactgacccacggtggttcatagtcagaatggagaagctagaataaagtctgtaggtagctaaaggaaataaagagtctcaggactgctcaaactcattacaccaaatggagagttaagcctggagacacagtcatgtgacactgctgtctccccccacctgcccatagatagctgtgacttcccaaccttgtgtcaaaggactacacattagctagatctctacagaaggcaaaaggccccatgcaacccggatggctgccctcaaattgctcataagtaaattctctgcttgtccctaaacctttcaagatgtgtatcttcccataaaaaaggacatgtcagctgtaactttaggtctgcgacctaagtctagctccctgtccatggaattgcagtctgttacatttcacactgacaatgtccattacaagcttatcttcccaggtgcagaacaaagacaggacagcagtcatttctctgcttaccctgagactacataattaactcttcctttactccctttttgaatgttgatcatatctcttgtatagcagggtttactgggcactagttaaaatctcaggggaatgtcacgtttgcctcaccacctgcccccttttcctgcgtgccttctcccctttaaagaaatgggtaaatactgagccttctgcaacctctttgggagcaccagccacagaagattctgtgacttgtgtgcttttaggtgcaccctcagacctctggctcagtacacctcggctgattgagactgttgcctcagtctctcatttgggttgacattattcattttaatgaatgaatacatttgtcgcagaaagtggaattctctcattgttgagagaaaattctcagcttgagtcaagaagtttccatatttaccagaaccttctagctttgatgagcataatcactgctaaaataatgtgtcttctgagcagctgggtaccagtgcctgtggcctgtagcattagttactgcctgagggatggtgactgttaccgcagaatggtgggcttcgttgacttgtcttctctcctctccctcttacccacttcccggagaaacaggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgtaagcatgtttttttccattcttcgttacttatattttcctaagtgtctttgagcaaacccaatggctttttttgttttgttttgtttgtttggaactagtgtattccttaacttactgtggatgtgtcagcagtaggcaaggtggggctccagtctcttcatatctcatgctcgagctgtgatagccaagcatttctcatgtcgagaaagacctgaacgtaacgaagtcaatgaataggaagatactgcctttgctaaataatgtaccacaaagagcctttaaatgggaaatgccttccgtgtatatcaagatcaggtgtttatgagcttgcctacaatctctgtgtaaaagttgaatgaaagggccgcagaaggggttggttctggggtcatctttcactcaaggctgtggacagtgtggtctgggagtcaggaagcaggacatcccatcccagctcagccagcagctggcccatgtgctaaccttccttagacccaggttcttcctcagtaaactcagtggaaacatgtgagcctgaccttgctcattgttgtttcaaagccggaaggaagagacagtgggatctgaaagtgctttaggaagtataaatgtgaattgccatttataaactactcttggtttcttaagccagggtatagtgtctttgggcttacagtgagatgtccctggtctgattttttttgtgggtgtcggaccctataggtgatgaaaatgcacatgacattcaggttctaggtaggaaaatacaggcaataaatgtacagcccccttgaatcatttctaaaatagtggtttaaaaaggcaactagtggtcgggcgcagttgttcatgcctgtaatcccagcactttgggaggctgaggcaggcagatcgtctgaggtcaggagttcaagactagcctggccaacttcgggaaaccccgtctctacaaaaaaatacccagaaaattagccagccatggtgggacacgcctgtattcccagctacccgggaggctgagaggcaggagaattgcttgaacccgggaggcggggcttgcagtgagccaagatcccaccactgcactccagcctgggtgacagtgagactctgtgtcgaaaaaaaaaaaggcaactagtcacaaataatttgttttcttctattaaaaattttaagaccattattgaaattgagagtattattctcctaatccctttaattgatcagttaagagttcctagaacaacttgatattccgattaaaatctttgggttaagtcctaccttttgaaatagggataatgttttgaaatacttggtttaataccattaggtgctaaggaaaatcttattcccttgccaaagagcaacattataacagggtctattttatgtctttattggtaattacaatttaataatgataattttggaaacaaatttgaccaaagggaagactgagtaaaaactgcatccttttatgtcggcaagtggtcgaaaatttcgcaggaaagaaagagagatcccttatcacatcctggttactctgaaggatctgaacccttagtttccttgaaatattataactttcaaaaaataacagatggcttgtgaagtttcagagaaaaatgaacacttatacactgttggtgggaatgtaaattagttcaaccatagtggaaagcagggtggcaattcctcaaagacctaaaaacaaaactatcattaggtccagcaatctcattactgggtatatacccaaaagaatataaatggttctcacataaagacacaggcattcacaatagcaaagatatggaatcaccgacatgcccgtcaatggtagattgaataaagaaaatgtggtacatatacactatggaatctatggaatacggtgtagccataaaaaggaaagagatcatgtcctttgcaggaacgtggatggggctggaggacattatccttagcaaactaacacaggaacagaaaaccaaataccacatgttcttgcttaaaagtgggagctaaatgatgagaacatgtggacacatagaggggaacaacacacactggggcctatcagagggtggaggtgggaggaaggagaggatcaggaaagataactaatgggtactaggcttaatacctgggtgacgaaataatctatatgacaaacccctgtggcaattttccccttacaacaaacctgcacatacacccctaaacctaaaataaaagttaaaaataaatgaataaataaataaataaccttaaagccattctcccagtgaatgctgagccccatagccttcctctttagccaagagcagttcttgtattctgtccccaaaagctttttgatcattggcaggtaagagctttttgccctgtcatagactgtagtatgtgatgaccttgtagaatccagaatacatcccctatgaaatctggtttaccacttactcccctccccaattaagctatgtggttttatcaacaactatggtaattttttttctgatcttgtgatttaagaactaatgttacaaacctcagggagactagttagtgtgttttaagtgtagccataggcttgataaagtattggtagataacttggcagaacctgatgtctttgaagtagcaatgttcagttcagcgtgtaactctctcccccttaatatctttttagttttatctgagaaacatactacatttttttctcttttctttcctttaaaggtggatgctcaagtttgaggactgtcatggggactatcaggttttttaggcatgtgctttctttttcttcaaattaaaacctgttgtctgtctcttgtcacttttcaggacagccacactcggggctcttacaatcaggggtcataagctgctatgtcacctacctcaccttctcagctctgtccagcaaacctgcagaagtaggtaagccagcctgttagtgggcttgtgtttgcggtgtgaatattttcattcatggaggaatgagctattgtttaaatattggagaggccttggagatagagagcagaaagatggttaccagaggctgggaagggtttgggaggaggttaggatgattaatgggtacaaaataaataggaagaatgaataagacctagtatttgatagcacaacagggtgactatagtcaaatttaattgtacatttaaaaataactaaaagagtataattggattgcttgtataacacaaaagatcagtgcatgaggggatgggtaccccattttagatgacgtgattgttacatgtttcacacctgtattaaaacatctcatgtaccacagaaatatgtacgcctactatgtatccacaaaaattaagttaaaaaataaaaataaacgttagaaatgtaccaaatcacagtagagagatgatctagactttttcatgaaaaagtctttaacttgagctatgtaaaggaaaattccctttttcgattcttcctggtgtgtaggacagacaggaggaaaggtttggctgtggagtttgcttttaggcctaaataacctccttagttgtatttcttttcttttctgactatagcagtggaataaagagtggaaagaatgtgggggagtggggagcagggagcaggatctgagcacagatccatgatttactggctatgtgacctcaaaccactcgtcttaaatgacatttatttacagagacaacagaacatagtgattagagcatgagctttgaagtcggactgcctggtttatagactgatcctgctacttaagtaacttgcagaaacttacttatcctctctattacttatgtgatgtataaatgtaaatatacacagacatacatacatatatacatacatacacataagcatatataaatgtatgtttgagtatatttgagcttatataagtcaaataaatgtagtgtctaagagaattgaagttgtttcctcttttaaatttggaaagctggtgcaatgataattttgaaagttttagcatatacacatagtatttatgggtttgtccttgttgctgtttatagtggaaagtaatgtaagtggaggtcttaagtaactattgcctaacctggatttaagttttttttttaaatactctatcttgactctgtaagtttacataaatttagtctctttaagactttcttttatgactgtttatgtattaatttctggctttaacttactgggatttttatttacaatattttttaaatggcaggtatccctttaaaacagaaaaaaaaggctgagcgtggtggcacatgcctgtaatctaagcaccttgggaggctgaggcaggaagattgcttgcagccaggagctgagaccagccttggcaacatagcatctctacaaaaaaaaaaaaaaaaaaaaacagaaaaaaagttattttaaatttcaagtgctctacatttttttaattagcctaagaataaagattcttgaaaccacagcatacacagggaagtttatagcattaaatgcctatatgaaaaaagcagaaagattacaaattaacaacctaacattgcacctggaactagaaaatcaagaagaaatcaaacccaaagttagcagaacaaaagaaataacaaagatcagggctgtgtgagttggctcatgcttgtaatcctagcactttgggaggttgaggcaggcagattgcaggagcccaggagtttgagaccagcctgggcaacatggtgaaaccctgtccctacaaaaaaatacaaaaaattagccaggcatggtggcacatgtctgtagtcccagctactctggaggctgaggtgggaggatcactggagccccagaggttgaggctgcagtgagctgtgagctcttattgcaccactgcactctacccagggcaatagacagggactttgtctcaaaaaaataaaataaaataaggaactaaataaaataaagacccccctcccccccaaaaaaacccatgagaacaatacagaggatcaacaaaacaaaaaaaaggtggtttgttgaaaagataaacaaaattgataagcccctggactaaccaagaagagagaagaccaaatcaacaaaattagaaatgaaaaaggaaaaatcacaataataaccacaaaagtacaaaagatcattacagactattatgaacttccatatacttacaaactagaaaagctagaggaaatggatacatttctggaaagcaagaaggaatagaaatcctaaacaggccaataatgagtagtgatattgaatcagtgatttaaaaaatcttccaataagaaaaagccaggaccgaatggagtcatagccaaatcctaccaaacatataagggagaactaataccaatcctcctgaaattgtgccaaaaaatggaggaggagagaactctccctgactcattatacaaggccagatatatcaccctgaaaaccaaaaccagacaaggacacaacaaaaaaaaattacagaccaatacccctgatgaacatagatggaaaaatcttcaacaaaatactagcaaacacgatgtaatagtacatcagaagataatataccatgatcaagtgggtattataccatggatgcaagaatggttcaacatatgcaaattaataaatatgatacatcatacattacatattacataaacagaattaaagataaaaaccatatgatcatttcaatagatgcagaaaaagcatttgttaaaattcagcatcttttcatggtaaaaaaaaaaaccctcaataaagtaggaacataacttaaaataatagaaggaatacaacttaaaataataaaggtcatatatgataagcccgcagccagtatcatactgagtggggaaaaatgggaagcattacttttgagaactgaaccaagataagggtgcctgccttcaccatgcctattcaccatagtactggaagtcctagccaggacactcaggcaagaggaagaaataaaaggtatccaaattggaagagaggaagtcaaattgtcgtgtttgttgatgatgtgattctatatctagaaaacccaaaaggctccaccaaaacactgttagatttgagtaatgaattcagtaatattgcagtatacaaagtcaacatacaaaaattagtagtgttttggctgggtgcattggctcacatctgtaatcccagcactttgggagggcagggtgggtggatcatttgaggtcgggagcttgagaccagcttggccaacatggtgagacctcgtgtctactaaaaatacaaaaattagccagtcatagtggtgtgcacatctgtaatcccaactacttgggaggctgagacaggagaatcacttgaacctgggagggggagggatcttggctcactagccaagatcgcactacagcacccctgcaccccagcctggacaacagagtgaaactccgcctcaaaaaaaaaaagtcagtagtgtttctatacaccagtaatcatctagcagagaaccaaatcaagaagccagtcccatttacaatggctacaaaaaataaaataactaggaataaatttaacgaaggacgtgaaagatctttacaatgaaaactactaaacattgatgaaaaacttaaaaggaggggccatgtgtagtttcacatccctgtgatcccagcactttgggaggccaaggtgggaggatggcttgaggccaggaatttgaggccggcctgagcaacatagggaaatcccatctctacaaaaaatttacaaattagctgagtgtggtggcatgcacctgtagttctagctactcatgggtccgaggttggaggatcacctgagcccaggagcttgaggttatggtgagctatgatcaggccactgtactccagactgggtgaaagagcaagaccacgtctcaaaaaaataaaaataaaaaggatgcaagcgaatggaaagacatcccatgctcatggatcaggagaataaatattgttaaaatgaccatattgcctaaagcagtcttacagatttagcgctatccctatcaaaataccaatgacatttttcacagaaaaacaatcctaaaatttgtatagaaacaacagagccagaatagctaaagcaatcctaagcaaaaagaacaaaacttggaggaatcacacttcaaagctggaggagtcccttcttcaaattatgctacaaagctacagtaagcaaaacagcatgatatttgtataagaatagatccatggaaccacatagagaacccagaagtaaagccacatatttatagccatctggtctttgacaaagttgacaagaacacacactggggaaaggatacccttttcaataagtggtcctggaaaatttggatttccatatgctgaacccctaccgaacccctgtctctcaccacatacaaaaatcaacaaaaatcaacaaaaggtggattaaagacttacatgtaagacctgaaactgtaaaaatgctagaagaaaacctaggaaaactcttctggatattgctcaagggaaataattcatgactaagacctcaaaagcacagacaacaaaaacaaaaccagacaaatggaactatgttaatctaattagcttctgtacagcaaaagaaataatcaacagagtgaagagacaacctgcagaatcagagaaaatatttgcaaactgtgtcttataggggagcaatatgcagaatttacaaggaacacaattcaacaacaaaaaacaccaaataatcccattaaaaagtagtcaaagaacatgaatagacatttcattttttttctaaagaagacatataaatggccaacaggcatttgaaaaaaatgctcaacattgctaatcatcagagaaatgcaaattaaaaccataactagatgtcatttcacaccagtcagagtggctattattaaaaagacaaaaagtaacagatgttggtaaggatgtggagaaacggaaacacttatactgttgatgggaatgtaaattagcatagcttctatgggaaacagtgggagatttctcagagaactaaaaatagagctaccatttgattcagcaatcccactactgggtagctacaaaaaggaaaataaatcattatatcaaaaagataactgcacctctgtgtttatcgcagcactgttcacaatagcaaagataaggaatcacctttaagtgtccatcaacagatgattggataaagaaaatgtgatttttatatatatacatacatacatatatatatatacacgtgtgtatatatatacacgtatatatacacgtatatatatacatatacacacatatatacatatatatacacacacatatatatatacacatatatatacacacacacacacatatatatatctatctccacacaatggaatactattcagccataaaaaagaatgaaatcctgtcttttgtagcaacatggatggaactggaagccattatcttaagtgaaacaagcagacacagacaaatactgcatgttctcacttttaagtgggagctaaataatgtgtacacatggacatgagtgtggaatgatagtgaagactcaaacataggaaggagggaggggatggatggtgagaaattacttaatgggtagaatacacattatttggtgatagatacactaaaagccaagacttcaccactacatgtaaaaaagttacacttgtaccccataaatttatacaaataataaaagattccttaaaccacagcatacatagttacgtttactgtttcaagtgcaaatactagtcataattttagtctcacttcagacacttgaaatatgcacgtttgtaaagtggtttctagagtgttactttatgttacttgctttggtggcaaagttggcagtcagacctaggttgggtgttccaaatggaagactccatgttaggtaaaaggtaaattaccactgatggttatattataggaatctttgttacgtagtgtttagaataactcagtttttcttactgtttcacactacaacagtcaacacagaaggtttctgtgacactaaaataagtggagatttctccccaccagcaagcaggcagtggacatcagttgggtgtcctccaatccaattcggatgctctacctggagataaggtcagatcccacaggtcgaaggctcaattccacaaaacagccctaccattcccactggtcacaagtccggccctccagaacttctgaccaactgttagggctcccacagttaccccttctttgggatggattaatttgatagagtggctcacagatctcaggaaatacttatctttactgatttattacaaaggatattttaaagaatatgaataaacaggcaggtaaaaatatatataaggcaaggtctcaaagggtcctgagctgtctccatgcagttggtgtggctgggttcctaacatgtggatgaggtggtgttcaccttcctgtaagcctccagctctcaggaagctttctgaaccatgtccttttgggccttttatggagacttcattacacaggcatgattgattaaatgattaaaccattggcccttggtgatcaactaccattcctcccattcctggagtttggagagtgggtctgaaagtcccagccctctaatcctaccttggtctttctggtgaccagcccccatcctgaggctacctaggggctgccagccattagtcagtcattaacatataaaaagacaccattttggagatttcaaagattttaggagttgcatgcaagtaaatgcgaatgaagaccaaatatatatttcacaatatcacatgtagccactcacattaaaaaaaaaacacacctcaggagtttccaagttacagacagaaagataccacgattatcatatcacttacagcaaaatgacttctcaactagtttaggagctattgttggctgttgattcacctcagcactgcttggtatctgcaccctacctctctttagaggctgccttgtcaactgaaaaatgcacctgacttcgagcaagactctttccttaggttctggatctgtttgagccccatggcactgagctggaatctgagggtcttgttccaaggatgtgatgatgtgggagaatgttctttgaaagagcagaaatccagtctgcatggaaacagcctgtagagtagaagtttccagtgataagtgttcactgttctaaggaggtacaccacagctacctgaattttcccaaaatgagtgcttctgtgcgttacaactggcctttgtacttgactgtgatgactttgttttttcttttcaagttctagatgaacatgggaaaaatgttacaatctgtgtgcctgactttggtcaagacctgtacagagatgaaaacttggtgactatactggggaccagcctcttaatcggatgtatcttgtattcatggtaagtcttgggagttactcaaggtcacttttgcagactttaaaattacaggaaaagaattgaaataactttcagtagctgtgaggctgcaaccatttgaggaggggggaaaataaccacaagtaaaaaggcgaagagcgtgaactcatatttgaacttcgttcaccttacttgtttttatttggggtaaataaagcaaatatatggtatgtaaatatttgaacttcgtttaccttacttgtttttatttggggtaaataaagcaaatatatggcatgttgcagcaccgttgcctaaccccctttaaaagatggtcgaatagtagtttgctatacctttactggagggcaggggagcacaaagtgaagaagagatagaatgtgccagcatgtcctggcagctttctgatccaaaggaaatagctttcttctgctgttgatggaaagagtacagagtgctgtgtgcgtggtcattctgtgcagacaagaaatgttcattctcttttctgctaaacccacaatgctgttgttcactcggcaaagcagctcctccaaaagtagatgtgatatatgagtgggctgtgtttcagatgcttgtggtgggggttattccacctttaaaaggtttaaaaggttgctagagggagaaaagtcaaggatagaaatggctagttaatctggatatatatttcgctgataactaagcttccctttaacagtaaccttttcacatttagcctttacttctgtgtttacattttgttaatgttcagtataaaaattcaattccattgaattcagccataggcacattgtaaacttcctttttgctgaaacgaaatactcctggtggtgatagcttgtataaatataatgtctttctgagcatgttggcattttctcttacctcctttaacaacttctactattagaaagggaccaacggggacacagaccttttagagtctatttgctcagggtcacacatcaagcaataaaatgcttgttgttttacaggtaggtgttaagatgatggtgacatacattcattcttggcctgtgtgacatagtgacagagtctccttgttgttgcagaatggactgtggtaacttctttctggcctttcaattttattaattcctaagttgttcgcagagtacctacaatataggaagcaggctgcgtggtgcagtggctcacgcctataatcccagcactttgggaggctgaggcaggaggatcacttgaacccaggaatttgagaccagcctagacaacatagcaagaccctgtttctacgaaaaaaaaaaaaaatcaggcgtgatggcacgtgcctgtggtcccagctacttgggaggctgagatgggaggatcacttgaacccaggtgtctaaggctgcagtgagctaggggtgtctccactccagcctaagcaaccgagtgagaccctgtcttttgaaaaaccaaccatgaagatatttgatagaataaaatcatgtttttgtgggttactgggtacccaatgaaaaaaaatatttgcccttggccaggcgcggtggctcacgcttgtaatcccagcactttgggaggcaaaggtgggtggatcacctgaggttaggagtttgagaccagcctggccaacatggtgaaaccccatatctactaaaaatacaaaaattagcggggtgtggtggtatgcacctgtaatcccacctactccggaggctgaggctggagaattgcttgaacccaggagggggaggttgcagtgagctgagatcacgccattgcactccagcctgggtaacgagagaaactgtatttcaaaaaaaaaaaaaaaaaagaaaaaaaaaaccctttaaataaagtagagtttggatttgccataaacccttcaatggaaaagatggcaaaaattcttcttagcctgctgcataatggttaccacacatagggcatttcacaacatggaattttcaccctatcatattttctcactatttctagcaggtgtaaagaattcttctgagttggcccttgagtgagagatgataaataaaatgttgtttcttacaggactgaggtaccatagtggagattggtaagggctggtctgatattcccaaaagatgtcaattttcaaagttgatagctactaaaaaaaaaatctgtctaaataccagcaacaaacattgttattgaattcgtaaaccacaaaactgcagtgtatggtgggatgagaacatataaaactgcagcccctacaaagtggagatgaggatgaccactctgctctgtagcgtacttctgtaatctgtaggcaagagcacactctgtgggctgggccccctaggagttagttcccccggggtccatgtgattgatgtttgctgtaattactcactgcagctcttcgaggggtcagctttaagaacactaaattcaggctttgtagggcctgggaataaaaggaatgctgtaggggtgggagttagcccaactagggttttttcagatctggacttctgaagagtttgttttccttcctgactcagaggaatgaaaggttggaggatgttacaaaaaggccacatcgtccgtgtgggaactgtcatttgaacataattgcaggaatatctaggattcttgatagaaattgcaggaagccagagactatagatagtatgtaagttaaaaggagaagaaggccaagattgcctggggtccactcttgtaaagttgtagaagactggaaatctccctagctcctctctttcccttcgccctccagagcccccaagccccacccccaaatacttgtttcctttggggtatctccatcctgactcttgcagctggggtactctctaggagtatgttttaatgtttgtagcctcagctcagaagaagggctcaacccaaacctactccctgcctttctgcctggggctgccttctctccagagcctccttccattgcacccaggaatcattgctgtgaaagaacatcatagcttggaccccatgtaagccctaaccttggtccacttgtgggagttctctgatagctctttttatttttttagataaaaaaaaatgttttaaggcaagttctcactatgttacccaggctgggtaaactgtccttaagggatcctcctgcctcagcctcccaagtagctgggactacaggcataaccatgacacctggcattctgatggttttctctctctctctctccttctttcttcctttttttttttgagacggagttttgctctttcacccaggctggagtgcaatggcaggatctcagctcactgcaacctccgcctcccaggttcaagcgattctcctgcctcagcctcctgaggagctgggattataggcgcgtgccaccacgccaccatgcccggctaatttttgtatttttagtagagacggggtttcaccatgttggtcaggctggtctcgaactcccaacctcaggtgatccgcccgccttggcctcccaaagtgctgggattacaggcgtgagccgccatggccagccctgatggctctttctataggcgcatccctccacacccctttagtctggagctttgctgtgacaaatcctggcctccacgaactatttcttaattcttcccttggtctctggattttgattgaaattgttattctgttgccttcaacttcagactgtcagcctggacaggatcccagagttgatcaggtcagtctcctcattgtacatgtaaggaagcatggagcctatacctgtagctctctactcccaacttcgggcaacctttccttgaggctccttttcgggagtatttagggacactggtggatagtctctccccggctctttttcttcagatggcttggtgtaatgtcccctgagggagaaagataaactggatgacttgcgtaattatattattacaaggcatttgcactataaagtttcctgaccattccacttttatctgtgtttaagagaaaaaataattcttaatattgaaccatctttgaaaatatccttttaaatataaaactggaaaaagtaagaatctttattcaatgtcaaacaacttcctagtttgaagtggggaggttcgcaggttggtgtgatagcattgccgaggggattgttctacattaaaaaaagttgggaaatcaaggaagaatatttatttttttggtacattctgggcctttatgggggggtggggaaatttgtatcttccccaccaggagagggggagatttgtgtcttcattttgggaattctgctctggcctgcctgccagctagaaatctccaagttagaaatcttccaccccgtggccaggcgtgatggctcacgcctgtaatcccagcaccttgggagggcaaggcgggtggatcgtctgaggtcaggagttcaagaccagcctgaccaaaatggagaaaccccatctgtactaaaaatacaaaattagccgggcatggtggtgcatgcctgtaaccccagctactcgggaggctgagacaggagaatcgtttgaacccagaagacagaggttgtggtgagccgacatcgagccattgcactacagcctgggcaaaaagagtgaaactccatctccagaaaaaaaaaggaaagaaagaaaaagaaatcttccaccccatgccccaggttcacagagagctcaggtctcctttgggttctatagcacaggggagcatgactgatcttcatcattgcacaaaggctgggaatagtcacgggatctgtcaagggcctaccctgtacgtttgtcagggaggcggaatgtgtgatctccaggaaagtttggacgtgttatttagagattttctgtggtctagtggactttggccagcttcaaaagcatctgcagtgccagtgttgaggggcacctgcattgtgcattcttctgccagtgtgaaggggttctgggcactgtagtggttctgcagggaaacaggacacggcttttcttttttttttttttggctgtcaccatgactgcagagcactgctggcattttggctgggttggggtggggtggcagcaggcagagacagtaaacacgctgtggtgtgttaggcattctccgtacaataaagcattgtcttaacccaatgctgtaagtctcctcctatccccacgggaaatactgggttaaagtcacacctatcttagcacaggaagaggtaaggcttataggtaacccaggaattgttttatagcaatttgtgctgtgctcaccaaacagtggtctttgtaatagcctgaatgcagataataagaatttcctaggctttaagagcttataaaaaaaaaaccttttcttgataattccaagaagagtgttgtatggagaaaggctacaactgaataaagatctttttttttttcctgcaacatctgcctcccgggttcaagcaattctcttgcctcagtctcccgagtagctgggattacaggcgccccccaccatgcccggctaatttttatatttttagtagagacagggtctcaccatgttggctaggctggtctcgaattcctgacctcaggtgatctgcccgcttcagcctcccaaagtgttgggattacagatgtgagccaccacgcccggcaactgaataaagatcttaatgtagggtaacatctacctgtagaagtcacatggcattaatgatgctctgaatgtagttctttttaaaagtaaaatcaaaagcttccccatgttaggcctctttgatggtgaagtggcaaaggagcccaaatcaagagctttgttttccggaaattacgttaacccaaagaatttatagagtagaatatttactctgaggctttgtttttctttttgagacagagtctcactttctcgcccaggctagagtacagtagcgtgatctcagctcactgcaacctctgcctcctgagtgtcaagcaattttcctgcctcagccccctgagcagctgggattacagctgccggccaccacacctggctaatttttgtatttttactatagatggggttttgccatgttggccaggctggtctggaactcctgacctcaagggatccacccgccttggcctcccaaagtgctgggattacaggcgtgaaccactgcacctggcctattctgagcctcataaataatgaatgttaacctttcaaatgaaaatttcagatagtgatctcttcttaaaattaaaaacttatcttttcccctgtgaaaactatacactgtactaaatcaaaacttgtatgcacaggatatgtgccactcttttttttttttttttgagacagggtccttctgtcactcaggctgaagtgcactggtgtgatcatgctcactacaacctcccaggctcaatttattctcctgcttcagcctccccagtagctgggactgcagacatgtgccaccacacctggctaatttttgtattttttgtagcgacagggttttgccaagttgtccaagctggtctcgaactcctgggctcaagcgatctacctgccacagcctcccaaagtgctgagattacaggtgtgagccaccacacccagccgggccactcttaaatgtcggattaggtgttgtgttccttgggtgcgcagtcattgggagatgtttctgtcttcctctgaccaggcacacagtcaggaggtggagtggcatgggcctggattagcatgcatcagttcaaagcagaaatgaaagtgatgctgttgtacttgagtggaccacaaaagaaacagtgaacttggatctcagtgggcttctgtatgagaaagctttttattgtttatctctgtctcattgatctctctccttgggaaagaggatgagactgcgcagtgttgcctcatggggttcgctggattgagatgagtgtgtgtccccacctttccatgagcagaccagcttcttgagcaccaacacgcccgcccatgtcaggccagcacagaagctacatgacggcaggattgttgcctgtgtcactgagtccccagtgcttagaatcgggcctgacacatagtggccttcagtaaatatttgctaaatcaatctgtaaagttagctggaaccctaagtattgtatatatttgcttaaaatgttctgtgtttttgttttgtagagatgaggtcttgctatgttgctcaggctcttctcaaactcctggcctcaagtgatccttccaccccttcctctcagagtattacaggcatgagccaccacttctggcctgtttttgttttcaggaaaaataaattattttgccccatgcaaggcaatttgtctaacattttacctttctaggtctcagggaagtggcagaattttttattacctcgactgctactcttccaaacagcaagccttgttctactataggctatcacagtaaataactgcgacttttgctttcatgcccttgctttctgttgccatctctgggctcgttgcttttgattccctctaagcaagactagtcaaagggagggaaagataaactgaaattagaaaactattgtagcatttgagggaggagaggcaaaaagcaatactgaaaaccaagatatcttacttctctacctacaaccttctttgcataaaatgatctaatgcaatccatgtaaaatgatatcaactatagaataagccagccaattttggaataaggagaggtattaaaatagattgctttgatttaagtctcctgaacggtaggttacattgaggctctcgtcggagcactggccagccggctttccccttcattccatgtgttgtaatgtgttaatatgcccagctgacgtttttgtctgtttcttagtttgacatcaacaacaagatcgagttctgacgctctgcaggggcgatacgcagctcctgaattggaggtaagttcatttccttttcctgtcctgcttcatctcagaagatccatttctcaggagggccttttgtgtttgtgtctttatcagtctgcattccgtgatcctgtttttctgctgaggaaagatttttgtatagaaaaataaatgctggccgggtgtggtggctcacgcctgtaatcccagcactttgggagtccgaggcgggtggatcacctgaggtcaggagttcaagaccagcctggccaacatggtgaaaccccatctctactaaaaatacaaaaattagccaggcatggttgctcacacctgtagtcccagctacttgggaggctgagacgcgagaatcacttgaaccctggtggcagaggttgcagtgagccaaggtcataccactgcactccagcctgggcaatagagtgacactttgactcaaaaaaataaaataaaaaagaaaaataaatgctttcctgctttcctttgtatgctatgggattaaaatgaatcagtccattcttgattttctgtaagaaagctggcctcttgggtggcatcctgccgctcacccccaaccagaggctcaggtaaccttgtcaggctgcaccctgcgctcttcccttgccgtagtggagtcttggtgggttttattttaacttctgatccacccacctgtttcatacttgtctgtgccctccatacacagcgtggctgtgagattatgtaatagctgtttggaagaaaggagagaggaaagggaaggaaccatatctgctctgcctgacgctgttgaacgttgtagatacattaactcatttgtcagttccatcaggtgggcgttttgtcaggtagagtgttatggacaatacatacattggttgcctgcacatccaaagcctcaaggtgttcagcagatgcctatcagtcaacaaaatgtctgttattttcttaattgtgcaagagtctttctggggctctcatctaccaacaacagcaaggtctaatcagatggaggcagccagggaaggactcagctgtgacccaagaacgaaaagaaccaggggttccaaagatggctaagacttacagcacttgctatgtcccaggcactgttctaagttcttcctatgtgatttcacttaatcctcataaaaacccagtgacgtgctattacctccattttacagaggggaaaaccagaagagttaagtcatttaagcctcacaggttttgatttgccagaatataaaccgtgtactctggccccaggatctgtgttcttgaccactgctgcccaggagctgagctgctgaaccctggtccttgctgctgactgcgggcagctggtttctggccactgcctgcgttttaatagctttccgtggatggaaaagccctggtgtctgtctagatatgggcattttactctgcagctgggtgtctggggttggtctctcttgcacctgacctggatatagtgagccattatgaagggctgtcaatctgccaacatcattcaccaactctttctgttgcctaaaggagaaaattgtgctgagtttgaataggttactgcctattatagagaagagaatggtctgtagaaggggtgtttattctcaccattgactaggtgaccacctgctgaggttgcatggttatggtttcaatgtccctattgtgtacagagttcaagctcaaagaacagcaagtctccaagttagatttaagagaggatgtttttcttctcagtccaagggaaaatgtccgagtgtttccttctgaactggagagcatgcgggatggaagttggtttgctctcctgcgtcacatttcacaggatacaactttgaaagtgagagttcatagtttcttatggtaacttgaacttcaaaataactaagacctcagcataccgtgtcttgggcccactgaatgaattagtggtttttagaccatggcacttaatccaagctcctgttaaggctaatacctccgttaaaggtttccttgccaagcagggaaacaagggcttggccttgatacacaaatgagatgaaggctcaagctctcatattcttatccttggctctctgttctttgtagttgaaatatcttcagccacaaagtgctaagggccctgcacttcccaggctgtcttagtactctgtttaccagagtccttctgaaatcacatactttttttctttgcttttttttttttgagacagggcctcactctgtcacccaggctggagtgcagtggtgggatcacagcttactgcagcatcaaactcatgggcttaagcagtcttcctccctcagtctcccaaatagctgggactatacataacctgattttttaaaattaagtttattgttttgagtaggtaagaaataatggccgggtgcagtggctcacggctgtaatcccagcactttgggaggccgaggtgggtggatcacctgaggcctggagttcgagaccagcctgaccaacatggaaaaaccccgtctctactaaaaatacaaaattagccaggcatggtggcacatgcctgtaatcccagctacttgggaggctgaggcaggataattgcttgaacccaggaggcagaggttgcagtgagccgagatcgtgccattgcactccagcctgggcaataagagcaaatctccatctcaaaaaaaaaaaaaaaaaagaataaaaaatacgcaaggtaccagagatgcttcaaaggcaagcattccctccatccctgcccacggcccgtgcaacagcttgattttgataggaaacatgggtaggctgcttccagattccttcactttactatttcagatcctaccagcttcgccaagctcctagataccacgtgttacctattgtgaatcatggatcttggtgtccccatcctgcattcgtctgttccagctctgtcactaagctagtttggtgactttggccagttaacctgcctgacctcagtttcctcagctgtacacaggataataataagcccaatgcaaaggtcaaagagggtttaatgaaataacattgaaagcaaagcacgagaagggagcaccaggagagtggggctcttgtcacgttcattgggtttcacattgagttctccagaagcagaggctgaggcagtttgttgcgtgggatatttattaaaagtcagcacatgtgggagggagaaggggaaggggaggcaaaattgggcagagggtgaagttgaaggacagtgcagctggacaaagcctccctaaccctaggagccataaaggcacggcctttacccctgccatgatcagccattccatggcagttacccaggaagggtaaaggagctcctgtctcgaggctctgctctcagcattcatggtagcaggagcgagcaccaagtccacggatgaggatctctgtggcacatctccctccatggggtttcctgtcaccaacacccagcacacctgggaaagaacagtccacatcttttgaagggcctgggaggtggttcaaataagggttactgttgccttgctgaggtggactagaaatagaacacaagccgcctgactgttgcttttgctttcacagatagctcgctgttgtttttgcttcagtcctggtggagagggtaagcagagcgcttttattctttgcacctgtgtggcactgcagacctataactctaatctgtagtcatttgggattcagacacaaataacttgaatagtaaggagaaagttttattctaaagctgacttactacttatacacttttcacattcttcctgaaggatagctgagttttgtttgtgttggtattctggtagagagaatcagtccaaattttggtttaaatgtaagttaaattatacagtgagatttagagaatcagagagcacattttttaaaaaggagtgatttggaaaataccaagaggtcctgacaccttattttggggccatttcattccttcaccttactttccaaggtggattggaggattccaagggcttgagaactaactcttgttttactctcactttctgctgagcttatagtaagttttacgtctttaagggtttttaagggttctctttctgttaaaataaatgtggcagggcaggcacggtggcttatgcctgtaatcccagcacttcgggaggctgaggtgggtggatcacctgaggtcaggagttcgagaccagcctggccaacatggcaaaaccctgtctctactaaaaaacaatacaaaattagccgggcgtggtggcgtgtgcctgtaatcccagctacttgggaggctgaggcaggagaatcgcttgaacctgggaggtggaggttgcagtgacccaagatcatgccactgtactccagccggggcaaaaagagtgaaactccatctcaaaaaataaataaataaaaataaatgtggcattaggtaactcttcctgttacggaagttgctagggtggagtgggggttttgtgcttagggcacagattgaagttgccagagggtacagatggctttctggcatcttttctactgacagccctgtagaattagcgagcgtgactttgctgaatggtaaacacacacattcactcattgagcctgggctccctctgtgcttcacagacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaagtgagtggcccatttgcttaggtatttttgaagcaaagccttaaagttaagagttaagtactgttcgtgtttgtttgtttgagaaggagtctcactctgttgcccaggctggagtgcagtggcacgatcctggctcactgcaacctctgcttcccaggttcaagcgattcttgtgcctcagcctcccgagtagctgggattacatgcatgtaccaccatgcctagctaatttttatatttttagttgagacggggttttgccatgttggccaggctggtcttgaactcctgacctcaagtgatccacctgccttggcctctcaaagtgctgggattacaagcgagttctgagttttaacagtggatgggtatgttttaaccctggaaactggtgatgcttatggcaactttaagaaaatggaaagttagctctatatggacagtctggaaaacatggtaatgaaggaaaaataggaactcctaagcattcatctgcctttcagaaagagaaaatatcccttttttttctacttcaaattttgtgtatctttttccccatttttcttcattttcattacaaaaattggaaacatctttttttaaaatacaaactaaatgtggaattatgaaaagtaacaatgtggtacccccccgcctctacttcccccacacagataaccactgctaggatgtgtatccttctccttttctgtgcatttataaacctctgtagtttttttttgtttttagttggagtcttgctttgtcacccaggctggagtgcagtggcgcaatctcggcttcactgcaacctccgcccctgggttcaagtgattctcctgcctcagccttttgagtagctgggattacaggtgctgccaccacactggctaatttttttttttattatttttagtagagacggagtttcaccatattggctaggctggtctcgaactcctgaccttgtgatccacctgcctcagcctcccaagtgctgagattataggcatgatccaccatgtccagctaattttttttttaacataaatgtcattatacatgttttcccctggaggcttttttttttttaacttggcagtacatgattgacctggccttccctggcactacacagaggttcatactttttctacaggtccacagctttggttgtatcataatttttttgaccactaagttaagcttagacatgtaggctcattgtgcttccttttatcattcattcaacagatgtgcaagtggctcctatgtgccacacggttctatgaggcaggatttatagtccagcaggagagacagactatgacgcaagtcaaatatggtgtgttagatggtgatgagtattggggagaaaaataaaattaggagagggaattggggtaggggtggtgggagtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagaaaagatggagaaggctataattaaaaaggcagataataacaaatgtcgaggaagtggagaaattggaaccctcttacattgctggtttgaatgtgaaatctgctttggaaaagagtttggcatctccttaaacaattaaacattgagttacaatgtaatccagctcttccactactcctgagcgtatacctaagacaaaaagaaaactaggtccacaaaacttacacagcggtgttcatacaagcatcattggtgataatcaaaaaggggaaacatcccaaatgaccatcagctggtgactgcctaaacaaaatgtgctctatccatacaataagatactatttagcagtaaaaaggaatgaaggactgacacatgctgccgcgtggctgagccttggaaattgtatgccaggcaaaaaagccacacacaagagaccatgtgattccttttatatcaactgtccagaataggcaaattcatagaggcagaaagtagattggtgaatgcggggggtgggctgagggggccatggggaaggggagagcacctaaggggtgcatgatttcttttgggggtgatgagaatgtttggaaatgggtagtgttgatggtagcacaagtctgtgtatgaatacattgaaagccgttgaattatacattataaatggatgtgaattagtgaattgtatctcaatatattcctgctttgaccgcggctaggtgtcttgtttccacagctacgaaagtgccaacatcgagagcttcttcagcgggagctggtccatcttctgggtcaagatggcctcctgctggatatgcgtgctgttgtacctgtgtacgctggtcgctcccctctgctgccccacccgggagttctctgtgtgatgatatcggcggtcccctgggctttgtgggcctacagcctggaaagtgccatcttttgaacagtgtccccggggcagggactggcgccctgtgcctgagtgggtctgaaaaagctttgagagagaaaaaaaaaaatctcctgattagctttttacttttgaaattcaaaaagaaactaccagtttgtcccaaaggaattgaaattttcaaccaaactgatcatggttgaaatatcttacccctaggaactggataccagttatgttgacttccttctgcatgtttttgccaaaacagaatttggggcacagcatcttttcacagggataaaaatatcttgtggggccagtcattctcatcctcggaatagaaaaacatgccaaaatcttgagtccccagcgcctaacagaatccagacccctctcactcacttccgcctcttagagccttgtccccagggggctttgaggacaggactcagcctgcagggcccctggtatttatagggtccaagaggaggcacctgcttttcaactgcaccctcagtgctgcctcttcacggcccctaaacgtttccctttgaggttgtgatgctgggaatcacagacttcactctctgcctgcacccttccccgaggtctcatcttttctgggtcccacatctttgtaataatgtgaaaaagcacaatttgtctgatcaccccccaggtggttccccaccttattatcactacctgatccgagttactgcaataagtacggcgcttatttatggtgttattcacatgattatagaacaagattcatgttttctctgcctaagcaatggagggctatcattcttacttgtttgtgctgttgataatgataatacttttaggaccttaactgaaaagctgcttcgtgttgaagcctgctgcatgcactgctctttcagttgttgaggtcagcccctcagttttttctccaccttgaggcctttgaaactgtaaaagcggaagtcgttttgtgttctggatctgtaacgtgaccataccgttcaggttcatgctggcatccttggagtaggtttgctaatgtgagaatttctgaggtgaggatctcagacacactgaccagaagaagcttgttaggcaatgtgtggaagtggccgaatatacttaaaaagaggtgggcagaggcaggcggatcacttgaggtcaggagttgcaagaccagcctggctaacatggtgaaaccctgtctctattaaaaatagaaaaattagccgggcatggtagcgtgtgcctgtaatgccagctactcggaggctgaggcatgagaatcacttgaacccgggaggcggaggttgcagtgagccgagatcacgctgcacaggaatttccaaaatacgtacttgcaaagtaatacagaaacgtgactttcggcagctacccaagatgatgcctattttcagtgttgatgtattcaggcagggaaaaggtttacttggtggaaactcctgttagaatttcattcggggtggaaagaatcttctcgagctctctgtaagtgaggatctaagaataaaaggctcagcctagtcatttttttctgtgccctactgtatgagttgggcagaattgagtgccacctaagctgggcttctgtgtgccaaaatgctggtgggtgaaattagtgaaattctttctattcattcctttgcccttctcccaagaaaacccatggggaaacaaattacaggggatgaattcctttagaactttccctacttagagtgtttgagattcagtttcaaaaggcactccatctgtgtgtgtggtttagagagccttgttttgtaaattccattaaatttccttttttagggcaggagctctgtactcagcagttaaaagattcatctggagtcgcaaaatgaaaagccgtgttctaacctgaggaatcagttaggggacaggagttccgtgggccaggaatgggctcagggagtggggctgcgtgtcacacacagtagctgtgttgcagtggcctagggccttgggggttgtctttaggaaacaccctgaggggaagcaggtaaagagcctgggcagtattgtgactagtttcattgttttcctcctgctgaggtctagcagagcccttgctttgtcctctcggctgggtctggctgccagctggtgtgatttgagaaactgaccttacgcgcagtcaaggtccagctgacaaggccttgtattccttggctggccgtgattggccctttcctctgcagaaagcagcttagggaagcccaagcaagggagtgtggccggtagaaggccctcgtcgcttccttctggagccagcccagccacacaacgttttccagatgcgtgagtctggtttgtgacatcccgttcccttctgccggttggtctgatgcaagaggaagagttacagttgctctgaattttattctcagctgaaaatgttagcacgtgtatctggatgaacaaaacagatgtggatgtatctgaggattgagggactatcaatgcagagttaatgttaatggttattaattgtgatatacaatactcaggtgaggagtcaacattcctggatttaaagaatctacagttttgtgcaattgtgatttgagaaactggaaacattgtgccaatggctttgagttcctataacaacggtgttaatttgattaactcactgatatcttttaaaaataatagacatttgcttcctacacctttttgtacatgacctaaagagtatattcccagaagctgctggtcagacacatttagggatgacagttgaagaggacttttttaaagctgcatgtgaatatttcctctgtgtgatttgtctgatgtagaaaagttttcccctcatttttatgagtaaaaacactaagtgggtggcaggggggtgggggttcttatgggagtgtcataccgcggcatgttacctgactggagactagagactatttccattataagccttcagaaacccaaccacgtctttactgtgtctagctttttaaatactgattggttagttttatttttgcccacagtttcttgggcaaaaaggttcttcattttgtctgaaaaagaaattatttgccagaggtatttggagcctctttgaaggggagatagagtgggggtgggttgtggggagggtggagttattggggttttggggttctgtttccatacaacattgtttatttccgattcctcagaagatcctttattatgaataacctcagtgtaatgttaatttcctgtccccatgtcaaaattgtcaccctaagcctttttttttttttttttttttttttttggagacgggctcactctgtcagccacgctggagtgcagtgacatgatcttgactcatggcaggcttgacctcctgggctcaaggaccacctcccaagtagctgagaccacaggtttgccccatcacacctggccgatttttatttttttgtagagatggggttgtccaggctggtctcaaactcctgagctcaagcaatgtgcccgccttggcttcccaaagtgctgggattataggcgtaaaccactgcacgcagcctaccctctgcctttttaagatgatgtatttatttaatttttgccatcattggtgcttcaccttcctgcgaaggaaattccagagcctgtatttaagctacctaggcttttacactccctttattgcctttccaaatagtatctcatttggtgtactctagtgtcctatacctcttggaaacgaaagagggcccaacctacaactaagaagggacaaaccttgaactaagtaagaccttacacacccagaaagaacactgggccctccttcttcagggacaatgcagtagccacttggcttgtggaatttactgaaggctatttcctgtaacttgctagttaacttagttttgtatttcaggcagaggtgcgctctgtaatgttgggcctttgacttcacagtactggagagctgttcacacagatgtttagacctttctctctctctctctctctctctctctcttttcttctttctcaacaactctttcacagaggcagtcattttgaaaggttgaaatatttggcctttaccaaagagctttttttttccttaagcaaaatcctttcagaaagaaacaaatggggaagggcagattaagaatgcatatgtcccaatccacttctataggagtttaatcatattcacatgagtaaaatgatggaagaactctttaaggtaatcctttgggataaaggatcctgggaagttctctcaggtaaagaaagcttacagcagatttgtaatatatgtctggagagctatttataagaaatttaagaggattgttttgttttcctttattaaagatttaagcctttttactttgcaaaaagaaaactacaaaagttttatagatataactttgctaattttttaaacttttctgaaacgattagctgtagccaaattatgtggttacgttttgctacattagaatttgaaaatgcaatatgtgtggtaaatctactgtttgaaatttataatggtctctgatatgattcgaattttggtaacttttgaaagttattttccccctttagtcatggatttctatttgttttttaatgttaatttttctagaaagcatctgaattgactaggcttttcctatataaaaaactcaaaacttgttaactctgtactttaataaaatttaaaattaaaactgtgttgtttttttctcttctgctagatacatatataattaaagtactcaagttagttgttttgcagagatgttgccttcagatgttaatcaggtctctcaagtttcatggagtctatgctgatcctttaattgacaaataaaagatatatatctgtggtgtgcaacatgatgttttgaaatatgtatatattcaggaatagccaaatcatgctaattagcatatgcattacctcatgtttttgtgctgagaacatttaaaatctactcacagtaattttttttttctgtttttttggagacagagtcttgctctgtcacccaggctggggtacagtggcgcgatctcggctcactgcaaccaccgcctcccaggctcaagcgattctcttgcctcaacctcccgagtagctgggattacaggcatgtgctatcatgcccaggtaatttttgtatttttagtagagatggggttttgccatgttggccaggctggtcttgaactcctgactacaggtgatctgcccacctcagcctcccaaagtgctgggattacagacgtgagccaccgtgcccggcctactctcagaatttttaaggtacagtgccaggttcctaactctagtcaccgtgttacacagtagatctcctgaacttctggctgatattttgtgttctttgaccaacatcaccctgaactcccccctcgcccagtcccccacctccagcccctagtaaccacctttacactctgcatctcttaagtcaaacttaggaagtttgactttttaagatttcatggatcagtaagatcatgaagcatttgtctttttgtgcctggcttattttacttagccgtgtcttctaggttcctccaaattgttgcatattgcaggagttccttcttttgaggctgaattttttattgtgtatatataccacttttcctttttttgagacagagtctcactctgtcacccaggctggagtacagtgacatcatggcttattttggccttgacttcttggactcaagcaatcctcctgcctcagcctcccgagcagctgggaccacaggctacaacaccaagcctggctaatttttgtattttttatacagatagggtctcactatgttgcacgggttggtcttaaactcccgacctcaagcaatcatcctgcctcagcctcccaaagtgctgggattacagacgtgagccactgcgcccagctcacttttttttttttttgagttagagtcttgcttggtcgcccaagctggagtgcagtggcatgatctcggctcactgcaacctctgcctcccaggttcaaggcaattttcctgcctcagcctcccgagtagcagctgggactacaggtggccgccaccacacctggctaatttttgtatttttagtagagacggggtttcaccatgttggccaggctggtctcgaactcctgacctcatgatccgcctgtcttggcctcccaaagtgctgggattacaggtgtgagccactgtgcctggccacatattctttatattcatttgtggacactcgggctgattctatatcttggccattatgaataatgctacagtgaacataggggtatggatatctctttgacatactgatgtcattccctttgggtatatacccattagtgggattgctggatcatatggtatttctactttcaggtttttaggtgttttttttgtttgtttttttttttttttttttttgagacagggtctcagtctgccaccccagctggagtgcagtggcacgatgtcagctcactgcaacctctgtcagcctccaggttcaggtgattctcccacctcagcctcatgagtagctggggttacaggcgcatgtcacaatgcctggctaatttttgtattttttggggtagagatggtttcgccatgttggccaggctcgtctggaactcctgacctcaagtgatctgcctacctcggcctcccaaaatgctgggattacaggcgcgagccactgcacccagcctgacttgagcactttttcatgtatctgttggccatttgtatgtcttttgagaaatacctattcaggtgctttgtcaactttttaagtgggttgttttcttgctattgagcagttttgagtttcttatatatcttgaatattaaccccttatcagatgttgtttgcgagcattttctctgatgctgtaggttgtctcctaactttgtggtttcctttgctgtgcagaagcttttcagtttgatgtaatcttgtctacatttttgttgcctagctttagtttcgggttttaacagctaagtctttaattcattgtaagttgattttttaatatggtatgaaataaaagtctaattccgttcttcaacatgtggatatccagttttcccagcaccatttattaaaaagacattccttctcccattgttgtgctaattgttgagaatataaatatgaaaccccgagcttgtcttcttcctctgaaagctgtggaccgcacttcctttttcctgcccttatgctggtgacaccctgtcctgatatatgagaattagagtaaagcatttttttttgtttttttgagacgaggtctcttgcctaggctggagtgtagtggtgtgatcgtagctcactgcagcctccaactcctgagctcaagtgattgttccaccccagcctcccgagggcttgggcctacaactcctgctctcaagtgagccttctctcttggcctcccaaagtgctgggattacaggtgtgagccaccacaccgggcacttaaccatttttaggtgtacagttcagtagtaggaagtgcatagaacattcacattatttggcagccaatctccagaactcttcaatttgcaaaacaactcattaaggaactccctgttccccacttcccctctcctgtggcaaccgtcatcctactttctgactctgaattcatcatttgcttttttttttttcttccctctgcttcttcccacatagatactgatagtcttcagctctcccagcttttgatttttgattgtgctatctagttgctatttttatgtagcaattcaggaagatccaaaaactatgcttctatcattgcccccatctcttccattcacacttgaactcgccacaataaagctttcacacacttaaattgaaaactgcttttcgaagtcatgggtgacttccatgttgccacgtccatcgtccttactttacttgacctatcagaagcactggacactatgaactgtttaaactgcactgcaaaccttattcagatttcatacactcatccttactttttgaaagggattctctattgtagttatctttttcctcctcacattgtacaaggaatgtgggaggcagataacttgtctttttagttcttgggtccctgcacccacagagccatccctgtggagccttatccacacacagctggacctgatttacttcctaactccaccttctgggtcggccttcctttactatttgaaaaagcgtgattgggcctggcgtggtggctcatgcctgtaatcccaacattttgggaggctgacgcgggaggatcacttgaggctgggagttcaagaccagcctgggcaatatggtgaaaccccgtctctacaaaaaatacaaaaattaggcgggcttggtggcatgtgcctatagtcctagctactccagggaggcagaggttatagtgagttgtgattgtgccattgtgctccagcctgggcaacggaggagaccctatctcaacaacaaaaaccctgatttgcagccaaatagtttcctcagcctatttcctgccagtaaatggttaggagcccagtggctttgttttgaacagtctttgtccattttagtccaagctagtggtgcttgtgttagttcagttctcttaaaaacattgtgagttttctgtggattttactgggattcactgtgttagataaaaaccatctccaccaatctttttaagatacgctccctctctggggtgcatgtcagggtgctgtgtgagaacacacttgttctttcagaagcctgtttgtctaactaaccatgagggtttgagaagcaattccttacatctttctgggattttaacaaagggcctcatgttgaccagaggccacgttttacttgtggcatcgaaaccacctttgcataaattataactgagaggattatgacaatgaaagagatgtgacctaacttactgatttgttcctaacctccaagctgtccttgttcattcctgggtgtaggctgaactaattttggaaggaacttaacttacagtttaactttgttttttgttgttgttgtttattttgttttgttttgttttgagacagagtctcactctatcacccaggctggagtgcagtggccccatcttggctcactgcaatctccacctcctgggttcaaacgattctcctgcgtcagcctcctgagtagctgggactacaggtgcacgccaccacgccagactaatttttgtatttttagtagagacagggtttcaccatgttggccaggctggtctcgaactcctgatctcaaatgatctgcctgcctcggccttccaacgtgctgggattacaggtgtgagccaccacgcccggcctatagtttaactttgaaacaaagatggtaccagccctttccctgaacaaacacccttttagcctgggaactataaactgcctttgcaggactaacaaattagctacaagattagaaattgtggtttaggagtcatgcagctggaggtggcaagattctaaacccctccaaattgctcctccagataacaggtattttggagaccctgcactcgatggatcagctgtccctaaccagattgataaattggttcatctggtcttgtggcccccacccaggaactgactcagcaccagaggacagcttcaactccctgtgatttcatctctgacctaaccaatcagtagtccccactttctgaccccctgcccaccaaattatccttaaaaaccccatcccaagtctttagggagactgatttgcgtaataatacaactccagtctcccgtacagatgactgtgtgtggattaaactctttattgtaattcccctgtcttaaattgagtctgcctaggcagtgggcaaggaaaattcgttgggcggttacagcatcttagatttgttctttgcctccaagttttattttgattttagaacacgctgctaactgactcagacagtcttgggccctctatattcttctaaa

SEQ ID NO: 923 - DNA, 1152 bp, Homo sapiens
agcctggcgctatgtgggagccgtcggaggcttcctcttcattggcatccagctcctcctgctcgtggagtttgcacataagtggaacaagaactgcattagttactgcctgagggatggtgactgttaccgcagaatggtgggcttcgttgacttgtcttctctcctctccctcttacccacttcccggagaaacaggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagttctagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaactacgaaagtgccaacatcgagagcttcttcagcgggagctggtccatcttctgggtcaagatggcctcctgctggatatgcgtgctgttgtacctgtgtacgctggtcgctcccctctgctgccccacccgggagttctctgtgtgatgatatcggcggtcccctgggctttgtgggcctacagcctggaaagtgccatcttttgaacagtgtccccggggcagggactggcgccctgtgcctgagtgggtctgaaaaagctttga

SEQ ID NO: 924 - protein, 343 aa, Homo sapiens
AWRYVGAVGGFLFIGIQLLLLVEFAHKWNKNCISYCLRDGDCYRRMVGFVDLSSLLSLLPTSRRNRTAGTASNKLWYASLALVTLIMYSIATGGLVLMAVFYTQKDSCMENKILLGVNGGLCLLISLVAISPWVQNRQPHSGLLQSGVISCYVTYLTFSALSSKPAEVVLDEHGKNVTICVPDFGQDLYRDENLVTILGTSLLIGCILYSCLTSTTRSSSDALQGRYAAPELEIARCCFCFSPGGEDTEEQQPGKEGPRVIYDEKKGTVYIYSYFHFVFFLASLYVMMTVTNWFNYESANIESFFSGSWSIFWVKMASCWICVLLYLCTLVAPLCCPTREFSV

SEQ ID NO: 925 - DNA, 31645 bp, Mus musculus
  misc_feature (1)...(31645): n = A,T,C or G
aagtccagccagacaacaaacaaatttaatgaagaaaattataagcatagtgaaaagaaaaccaggaagatgatgttttctcacctttacgagctgggagtcacctaggcgagacccgacaaatacaacaccattatcaagataagttaggcactcagcaatggaggtctagaagaaagtcaacagatggaggaaattaggattaaccctttagccataatttggtaaacaattactgagttatttagtatccccaggacacatgaatcacatctttacatccctgaactgtgtgacttctcacagcattccacccacaccccacaacttattgtgctagttccaaacagtaactttaactcaacacctccagtctgcacaatgtaattaaaaacctctcaaagtcactgcaaagtattaagctttgccagaagaggagagaggctgaatggcaaggtgaaatgacacatgaaaatatcagtaattacaaataataaagatgaaagcaaaattttaagaagcattaagtcttttaggagctcctctcagatttcattatcaacactggtctggccagggcagtggtggcacatgcctttaatcccagctcttgggaggcagaggcaggtggttttctgagttcgaggccagcctggtctacaaagtgagttccagggcagccagggctatactgagaaaccctatctcgaaaaacaaaacaaacaaacaaacaaacaaacactggtctgtagtccttgtcttgtactctgatttcctttcttcctttggtgtccttggtgttttggggggaatttgccactgtcctgccttagcctaagtgctaggatctcaggtgtacaacaccacatccagctgtttcactttctttttatgcttcagatgttatctaacagcatgtaaaactctccaatagctaactctttcagaaaccaacttcttgctggatggtggtagcacacacttttaattccagcactcaggaggcagaagcaggcaggtatctgtgagttaaggccggcctggtccatagagtatttctaagacagacagggcaacacggaaatatcctgtctcaaaaaaaacaacagaaacaatttccacagtagaactgacaaccccttctaaaaggtgttgagaatcctaattcccaaagtagaagcacggaaccacacatttgggctaagcacctaggaaaataagacaggagcagggacaagtcctacctctccgaggagttccactcgaaggtccttgagggtgacagtgccatccatctgctcctccttctctaagagcagcatgaaaagccgtccctccatatctcccagaaggtaccgcgagccattaggatccacccggttatggcacacaatagtgctttgctgccaagcaggaggaagcagccattagtcagatcttgtaaactaggagcccttacttacttaatgtgccttccaaacctgctgggccgctgcattatccaaactcagacagttaatccccaaagaaatcagtcagatgataaaacaggcagcctttgaagataagtttctaaagagttcaatcaacataccttcaattttactcctgtattttatagagaacagaaactaccactgagtactctagacctgggacagaactcaaggtgtagctcagtgcagctaggatattaatgtgtactgattcaatccccagcacacaagaggaaaagagacaaaaacaaaaccccacacacatacacaaaaagacacaataataaacagctacaagtactcactcagtacaaatactgacacagattactcaaaaaagtaaataaaattaagcttttatgctttaactttttggcttaaagtgctaagacctaagattttttataaaatttgggtttttaattttatgtgtatgggtatttttgccaacatgcatgttatgtctgcacatgacatgtgtgctgcaccccataaaagcctgaagaggcatcagatctcatgactggaattatacacaattgtaaactgccatgtgtgctgggaatgaaaccctggatcttcaggaatactagtcagtctcaacccaccgagccgcgcctccagctccctttgtgactcgccttttaagtctatagaatttatcaatgtgtatttaagcccgaaaatgctacattcagtacaatttgctaaaattctctcttcttttccttggtggctgggattaaacagagcctcatacatgctaggtatgcactcagtatactctagacctcaaactttccttcttaaagttgccatgtttcaaaaaagtaaacagtatttctcctagttagcaagcaagctaagcaaaaccaagctactctcacaccgatttcccaagagtaaccaacatctcatgtgcacagtgaccagtgtgatagatatgtgtaacctcttcctgatccaccgagaaaaggagaggagcacggtcaagatgtaaaggaaggcaaggaactagaaagtaaaacacttgctcaccttaatgataggaggagcaattgccaggtatttatcaccgttatgataggtgattgattcctgtccaatgatgatggcacctccaaaaggctctgggactgcagaagaaaaacagcaagcattaataggatcaatactttgaaactaccactgaactacatacattcctattcctagaactcactttttgtttgttttgagatgggaatcttactccactgcccaggctggcccagacacctaggttcaggtgatcctccagccccagtctactgaatgaggggaatctacaggcacttggtatttttcccattcttggtgctttagttcagaagggtagggatactctcactgctctcccacaggtactccacccctgcccagttccttcctacacttctgaccttttcacaaatagacttttacctgcttccttgtcccttctcttgttccttagcttgaccccaaatactccttatatcaaggtcacttttaagaagagttaatactgttttgggattttaaatgttggatgagatggacaatggaaacataggggggaagagtgtaaggtgaggcctggacaagtcccactcagctatttctaatctatgaaagaagtcagactaagtaagctatactggctccttcaggtaccagatgtaaaagtgagacagactttacataaaacatctcaatgttttagctgtcgtgactacacctgaagagtaaagttacacttctgggggaaggaacaaaatcagaaaatcccaaaatcaaatatcaaaaagccattcagaaaggagacttaggggaggacaagcttgtatggttttacataagcttaatagtgtgcactgaaaaggaggatgaagatgaggaagagaaccagatcatacagggatctccccccaaacccaccaacctgctatcaccattgaagcttcggcttctacattctcctgtttccaagggcccttgttgaactccttctctcgaagagacacctcataggttttcacatgccgcccctgaggatccttgagtagaaagagtggaatgattagttagggtgccccaaactgtaggggtcctgtaagggacaaaccaccaccacccaagatttgacaatcctgtcacaccaactttcctgtccttatttgttagaataccaatagtcacctgctgagcctttattactttctgagtagactacagggtctaaaatgtgctgtttctaataattcaaatcaccagcaaagtttaaatggaaaattgaacctgtcacactatgcatacaactgagagatagacctcttctcttgacctcaaggaatgtatcaaataaacaagagagagagagagagagagagagagagagagagagagagacactgaagctaaatctaaaagattaagaagagttgttttgacaattccttttccctcattttctgtgtatggaggggagtggggtatgtgcacatatacatgtgtgcaagatcatgtggaggctcaaggctgatgttgggaaacaccctcaattccagggtctctcaatcgaacccatattgtgcctatgtagctactcttgctagccagcttgcttctggggagcctgactctgccttctaaggccggaattacaggcagatcgccacacccaccagtcctttaagtggggtcttcatgctcatacaacagcaagctctttaaccactgagccatctacccagaccctgtttgatacaattctcaagaatactctgaagaggtgaccgcagaaacaatacaacttattgctcccttaaaggtagtcaaaaatgctccagtcccgccactgtcaactccatcttcctctcctttttctgagtcgtgactcttcccctccttttttggaatcatgactcacatcagtcttggggctgccaaagtcacctttaagaggctaaagagcaggggagaaaacgacattcagccaatgaagatggcttcaatcaagctcagaccaaagtctaagacatcacggaaggaatttaatcacgtgtttcaagaagcacatctcagccactgtgacagcccatgaagtgcttagctggaacacctttcacatacaaggtgactaataatcatcaaattaaactgttggcataaaacagtcacttgcggttgataaaaactttttcatcaacgagaaagggaaaggacccatcttcacagaaagttcagtgaacatggatttgagtctctgggacccacagagagcaatgaaaacaatcacaactggcagccctggtctgggaatagacagagtcaggccagccccatatagtcaacacccttgttttaatgatacaaaactgaagaaaaaaaaaggaaagaaattcaaagttttttatttcagttctgatagctaataagatcaaataaaatcatactcaactagttttggctttatttaaccttacgttaaccagtaattacacaaaaaaaataccacatacacttccattactgcacagctatgtaagtgttcccaggcccacactctaccatcctatgtagaaagggaccattatttatttcactacaggcaagtaacctgacctcacacagtctggccctttgttaaaggctgagattttaccaagatgttgttggcatgttagtctggagctctgcgccccacccccacttaacaagtctgaaccagagaacagctgtccaggatcagctctgctaaaattttaggcacagactaaaatagaagtcaagagccagcaagtcaccaaaagtgagtgctagacaaaacatgaatggctttttcaaagactaaactaaagcactaccaagatattttctcttggctcgtaaaggcacgttctgaatcactgttctacagctaagtttttataatcctctaggcatgttggtaagagactcaaacaaaggataaactaggtcaccctataaaatcccccaggcctactactggagtgtaatctcaggattaaaacctgctataaacctgacagcattcgctacccccaaacaagtagtagtacacacacacaaaaaaaaagggtgtgtgtgtgtgtgtatgtcaagggtcagctctgacccgtattaactgtttttttaaatgtttcagaaatagtcaacacttctcctagcctgctaccaaacccagacacacacattcctttggcaagcatcccactcccatcattccaaaccagcttctccctctcttctcagctcatgtacctggtagacaaagcaaatggtaggtgcttgacaaccatacaggaacttgacatcaatgacgtgcagttcctctaggcggatgttaaaggccttgagctctttattgtctcggtctagtggaatgaccttgaaaaggccatcgtagagtcgaaggccaatcatacggcactcagggtcaatgatgccaatgatgccagtctccgaggggcgaccaatgcggtcctgaggggggaaaaactggaattagggtagggaagctcactcaaagcagcagaagatactgggtacaaagctttcccaggcagatataggttataagaccacccaacatgccaggaacccaaacatgagcacattgtcgttccatcgtccgtcccccacccccacgctgtgagtgaatttttcactttcccttggaatatcaaaacaattcaagccatgtgggcgttctccatttctctgattacacagagtgacaccctgacagttaactgctgctcatcactgcatcatgacagcagtccttgcaggaaaaactgatcagcctgaagcagccacctcacctggacattgccatgggctcttgtaatgatgtcaatgctttcgccactctgcttatactccaagatacaggcattgtatttagcagtcaagatgaacagcaggtctttgctctccccctggaatattatcaagagattctttcaaaagcaggaacaacctgttcagccttaacaccattctttaagtattctaagcttttaaagaatcttccaagttctactcgccacacagaggaaatactaagcgagcctgtaacatgtactaagctcgcacaagaccctaaggggatgtacaaaaggccaggactgaggctggtaagcatctaggccttgcaatttcagctctctttctctctgctctacaagcaaagtcctctataattcacctcattctattcaagatttgagaagagaatgaaatgtttctccttcacctatgtatgtggagagaaagtaatctgtagtaataacaagcaaagctacaatagatctttactaacagtcctcaaaaacattcatggttttttggggtttttttgttttggatacagttgaattacaattgttctaatagtaatgaaactgttaagctaacaggatgtgcttactctgtgaaaatcaatcattttatcttcacagtactctacgggagagggcaccgttacgcccatttgtaaacggggaaatcaaggctttcaaaggtgctttacatgagatgactaagaaatgaagctaggattaacactacaacctctgcggcattaacccacaagctccttcaggttctcttccctaataactctctccttctgggattctggttacagactgccattcccaaagagtttctacttaagccttcacccatcccatttaaactctgcacccaagggttccttcagggcccgtcccttaccttgggcctgaagagctccatgactgcaatcttcccgtacattcccacctctttgactggccgaagaccctccgcagtgaccacatagatctctaatcttgtgtttttagcaatcaacaggttcagatcttccgctgaagtaaagtgtcctgaaagaagagagcctctaactttggaagctggaggataggcctttcaggtacctctaaataaatctacctaaggacctcgcctcctcaccaaatgaagcacctcaatgtctcgcttcacacactcaacaaagctatagtcttaatcagacttttaaaaatgtactgtcgactgggcaacaacagcctggccttcaacaaactatgaccacgaaaattcttcggatggttgttgggttttcctttctaaattacaacagcagactgtaattgacgctaatggagaaagcctgtgtttccttgagttcccatccagaaagataaagcgaagaaaatttcccagagccttcagtgttgtccttttatctcccaagcaatctaccaacaccacccagccctctgtagctctctctgaacaagaaacttttgttctgaaatgattagcatttacgtaaatacacgaatttaagtagctgaaaatatgagttcaagatgaatgttctttggtttgggatgtaactgccgataaagagccacgcacacaaacaaggcaaagctcgcacactgacgggccaaccaaaccttgttctccagcagcgccctggagtaaacaacagccccaggcaaaagggtgggtctggagagggccgggggggggggggtgcagacattgctcaaattcctcaacctcctggacatccaccggaaaattatgaactcaaaacttgccccattatcatctcccctttcccctgaccacatggggcaagtttgaagactcaatcaaccacgcacacaactcacacttcgctctccgtcccaccaggcctggaccaatcctcaataacaagtgacctcctatgagcaaaaaaggacccagaatagctgcttccgctgcccaaaaggcgcgtggtgggaacagctcctttgagatcgcgagctaagggggacgttccgcgactgccagcgccttccattcccggagcccaagtttttgctcccgccgcccctggggccgctggcctccctaggcctgggatccctcccttgcccgggtctccggccggggcaatctcaccggtcacacagccgttcactgcagtaggcttctgcgccgttacgacgtagttgtacgacatattgaggccttgggttggcccgtggggcgcctagagcgacgatagagagacgggcgcgagcgaagagactgagaacccccaccctcacgcagccaactccgtggctgctgcctccgcccctgagacacgttgcaggccagagaggccaggcgcagaggatcacgggacggcctcacctggcctcttggaggacttacggagcccgaggcggccaaccaagcgaggccccgccccctgaggtcccgccttctcctaaccgccagaggtcgcagtacccggatgagagcgagagtaccggtacgcaggcagaactggcctcctctttggtctgctacgccctaagtggccgcctgctggcttcccagcccagatccgcgccccttcctcagattctgcctccttccttcctccatagctccaggcgtcctcggggttttccctcttttaaaacaggaagggctgcggaggactagactggggataagaggtgaccatctgtgcacatcccagagtagaatcgtgctttcctttgcttaattcttcgagctcctcctgatccctcgaatgccctcaactgactttagaacaatcatcccagcctcacacatcacctgggggtgtgtttgctcacctcttttaatttctccagaaacgaaaggactctccactaaattacttgatagcactattagtgcctctactgcgatacaaattctaagctcaaatacaacgcaggaatttcacaggaagagcctaaacacccaggtgactagtgcaatcagccccgcagatgcaggtcccaggcttcatcagacagcctccatgtccccaaccccaaaggaggagcagcagaagcctagtcctgaagcatctccagaatgccggaggaggagagctaactccctattttacaaatgaggcagagatcagtgtagctaggtttgaaccaggtggaactgaagatgatttgtacctccccagctggcactcgacttgactctgggaaactggttgactaaggggaaacattaggctttgtagcaagactagacatgggctcaagtcctaactctcagcaacacaatcttagacaactcactagagctttcagtctgtgttccagaagtaaaataggatcacagagctgactcactactagtgtggccagccagaaaggtaaaggtctttgtacattttctccttcccagctttaagctggacatgattccaaacactgccttctggctaagtgggggtgtgaactttggtcagtccccacgctcctctccattcctagcccacgaactagagtttggacttggatcaaagtctgaggcagctccctaattcttaaggcacaggcacgggaggcatgacattgccaatcggctgcccataccttcagcaactcaagtcctttccactcctgcaggtgctgctgtctctacttcagacctggtagcagtcaggaccgtccacccggcggcatctcagagcagaagtgtgagctcagcttgtttcagaactttcccaccatggtgagtcctgtgggagccacaatagagggacgaccatggggaaccccactctggacacccggactctctctagtccccatctgagacgatgctgcctcttggggttcagaagacaagaatttcattttgtatctccagcttaatccccgttccctttcctgtgggcggggcactgggccaagccaggtctgaggttaacctgaggcaccctgaaacccctatggctaggatctcaggcacgcatttagatcagaacaacaagttacttgctgtgtgataagtcactttgctagtcaaggagggaacctggaggaatgatcgggcccttgttcctcagcctgggcatgtgtgggctgctcccagagcagggaactgcaatgtgggaggctctcagtgtccccggggtttgctttaaaactgatcttgaacagatctgggctcgatttcagcctcgtgcccatcactgtgttactactatgccaaaggcttcacttctccgggtctctcctctcgccaacctcatctgcagtatggcagactaagacctgctagcacatggcctggccgcacagtgttgatcagactagaatcctagtggcctagtctgtacctcccctttcttgcctttcctttcccttgtgttactgggaaacaggcatggctctggtgcaggaatgattgggaatctcttggagggagactcagtgatccctctttccccaccctgtgcctgtgacttcagccacttgggaaaacagcatgtggctgggatgaacctggagggtctaggcactggctggctgtgtgactttgtgcacagtcatttgttgtgcttcagttttctgctgtttgtactaatcttacctccaaagggttattggggaaattaaattagacatattcgtacttagaaatgggtctggctcttagtgcgtaagaaatggagctcattttattctgcttgttgtctgttgacctaggccactctcgtcatccttaagtaggtgttatggccttggcccttgttaaatgaaggaaagcctggcaggaagacatcagcgcttcattttgcataaaggctcagaaaaaagaggcaggaagtgtgttttgcggagacctgggtcaggctgcgatcactaggtggcgccagcagtctcttctggatccactttgaggctcgctcttcctgcctcctgaggacaaaggctgctggctacatcccatcccggaacagttatttagctagctccagcttttcaaagcctgttcacaaaaggggctatggcacctttttagcgagcttttcccgtaacactggtataagctctgtaaatcactgttcccagaggaagaactgagcccagaacagaggtttgctccctgagttcaggcgtggtgtcctgctgacactagagcctgggcacacggcgactctggtctctcttactgcacacgctgtacagactcagctggacccagaggtattctccagggtttaggtcagcctttgcacgccctctctcctaaggaggcccatagctcaccgtgtaactgccctggcagaatgcagacattctaaagagacatttcaccccttcccattagctatcagactgctgaaataatgcctgcaacaaagtggaattttcccaagaatctcaagctgggggaggtaaagacagagagacagaggccctgacactcacgaggagaagcagccaggaagagatttcacatgtttctgacagtgtttcagctgcctgcaagaaggggatgagtcagtcaaccacaccttggccctaactgactaggctttttttttttcagtgttttattttttatatttgtttgtttgttttgttttgtttctgcctcctgagttctggaattaaaagcacacaccaccacaacctggcttgtttcagggttttttttgttttgtttttttttttgcttgtttgtttttttgtttttttcaagacagtgtttctctgtatagccctggctgtcttagaactcactttgtagacaaggctggcctcgaactcagaaatccacctgcctctgcctcccgagtgctgggattaaaggtgtgcgccaccacgcctggcttgtttcagtttttatgttcagtttgagacacatgggtctcctgtagctcaggttggcctccaactttctgtgtagctgatgctaaccttgaactccggagtcctcccccacccccgccccccaagcctccatctcctaaggcctgtgctaccacacccagctagaactactaggttatacatacctctctgtttaaacctaaacctcgtatccgtgccctgaagatggctttggacatgagagagtatccctggacctctttatttgttcctcttcccaatgagaacatattaatgaattgataaataatgaacaatctgataaattattataaaacataaattataagtaaattgataaatctcctttgtctgctccttactgttgtctctttaactggcctgttgaggacatggctctgaggatagttattaggctctggagctgaggctttgaccctgacgattcctgtgaacgattcttcctgtggcttgtgaggcccctgtctacctcttcctgtaggccatattgcttgcaacactatgtcactctgatgcttccaggagccactattctattctgtatcccataccttggcttatgcttccttctgctccgaataccccccacccccttcccaatgcctacatgtctctttcttgttcttcatagagacttcccctttaggagactgaggcccttttcttctgtgcttccacacacatgtatgtccctcttgcatagcatagcacgtaagaatgatatctgtgttcccatgaagggcctagcactgggccctgctaccctgcatgaacggtctagctctagcccaggaaaaccagttgtggtaccaactgggttggtgtggggcctgcccagactctacccatcataggagtctcaatctaaaacctacctcctctaacagaaactgacagggccccaatttcattttttttttctagtgaactcccccatttgctttacattgaagctgttttgcaggatacatagaaatcatggtgatacatagaaatcatggtgtaaaggtctattagttaaataaatactgaataaaacattgaaagttgagaagtcacagacacctgcacctggtaatgacataactcaaggtaccactgtatccttagaattcctaggtggcttctgtagttcctttcccctggcatgaaacccctggggagatttggcactgtaatgttgctgggcaggcaggatgggggtacctgctgaccacactctgaacctcttgtttcttgctcttcctccacagagttccaagaagatggtgaattctgtggaagggtgtgctgatgatgcccttgctgggttagtagcctctaaccctgacttgcagctcctgcaagggcaccgtgtggccctacgttctgacctggacaccctcaagggccgggtagcacttctgtcaggtggaggctcaggccatgagcctgcccatgccggtgagtatcttgtgttcattgtaaggggtgctggccagagcagagtagggatcctgggaggtcctcagtgctagtgtgaggtaccagacaatcagtgcaggggccagagttagcaatgggcccagtctccatcctcccacagcccccagccactccacgcccagtcacagcctgtctctgcacctggattcttacagctctagaaatgcagggttgagccagttaacccctgaggctgtcacagcctcaggtgtgagacttggtgatttcaaacgtcttcctggcctgtttttccagtccagctgacccaacacctccatgaaactttcttgactctacaagcacaaattaggacccctcttctgcaatcctatcatgccttttcccgcagctgacccatcttagctggtttcctgtttgatgcaaagatgtgatcctccgttaggagctcctaaagcaggcctcagactttatgtcagttcacttctcctgtccaccggcaatattctgtttattcattcatcagctcctagtgagcccacgatattctgatatacttggccctgtacagggcacacatgtgaatcaggcaagatcctcccctgtagaaaacttttatgccccactctgggaagacagatgtgaataagagcagttcagagagccttatgggttataacaaacactagaataaacatggaggggcaggagcgatgactcagcacttaaaagtacttgttcttgcagaggacctgggttcagttcccagtacctacatagcagctcacaaccatctgtaactccagtttcagggaaccactgcctcctctgacctccacagacatgaggcacacatgtggtgccctggtgcacatatatacacacttgcaaaacactcaaataaaacaaatcttttttcaaaagctttatgtaaaagaagaataggaggaagaacagaaaatggtgagagtagacagagttcttcagggtaggaggtcaggggaagatctttcaagatgactcctgtgtaggggttagccatagcacaagcacaaagtagggcttacctaaacatggatctcaggtatgtgggaagcccccagggataacagacctagattctacccggcatccttatttctctttctccaggttttatcgggaaagggatgctaacaggtgtcatcgcaggatctgtgtttgcctctcctcctgtgggcagcatcctggcagccattagagctgtggcccaggcaggcacaggtcaggcttgcatgtaggagagaatgctgtgggtgggctctgttgggggtggggaagggcaaggctcaatgacaccatgctactgttcctacagtgggcaccctcctcattgtgaagaactacactggggatcggctcaactttggacttgccatggagcaggccaaggccgagggcatctctgtggagatggtgatagttgaggatgacagtgccttcaccgtcctcaagaaggcaggccggcgtggcctgtgtggcacagtacttatccacaaggttagcctccccatcctgggacactgagtcaccagccatttcttttccctgatcacaaagtctctaccattactacagcaattagccctagaattcaggcatccacttaaccagttctcttccctcccctccatgtggggatatgtagtcacttgccccttcctagcgcttcctccagtgcaggacaggtcctcatagcctgacctacctaccttcacattgggtcacgactacacttgccttcttctcactgggctaccgtgtttgcttcctgcactcctgccttgccagtcagttgcccacactaaccccagaagtaccgttataaaaatacagaaggctgagactagagggagttgaatttgaaactagcttggccaacgtagtgagactgtgtcaaaacaacaaagacagtatatgcccaattttcatctcactgagaaccccttgggttcccacagttagctcaagccccttggttggggtgcccaccacttttttttttttaattgagggctggagaagtggtccagcagttaagatcactggctgctcttgcagagaacctgggttcagttcctatcactttcatggtaggtcaccattatttgtaactccagttccaatggaggccagaagagggcgtgggacacccggaacaggagttagagacagttgtgtgctgccatgtgggtactgaaccaaatctggaacctgtacaagagcagcaagtgcttttaactgctgagccacctctccagccactccaccaccaccacactcctgtcccagctcgttgactcctggcttcactgtccagcatctttcccttctcccaatgctctgcaaacatcagatccccctgtacctgttggactggagcttgtttctgtggctttatgtccgtcacatctgtgcccctgcacagtcctttctttggccagccttctgtggcctggctcacccctgacattctgtagaggctgatggcgctccacgtggtactctgcctgatggcctcggcaccctgagctacctctgatacctgtgccaccttgcagtcattttcagtttgtgtcttggcttctcttcctcagactctgagttccttgaaagcaggactctaattcagtcattctttttcctttccagttcagtaaattctttgtgaaagtggagtaacaggatggataaatgaatggaatgagagtaaattgagctatgggagaaagctctgcagatcaggaaaatgatcagcagtgggctctgtgacactgaacacataaccccttctctagacatttctctctcaaaagtccatcccagctctactagactagagggaaggagaaaagggagagaacaaatgactctgtgtgtgtgtgtgtggttttactggaaatgggttttaggcatgctaggtaagccttctaccatggagccacacatccattcccaaacagaaactcttgaagactcctctaagcagttaggagagggcattcttctatcttaaatgtgatggaccaggtttagtgtagaaaccctgagatcctcccaacaagaaagctcttcccagcctcttctgttcccactgatctgtgactcctccatccaccgttccctctctctggtggctacaggtggcaggtgctctggctgaggaaggaatggggctggaggagatcacaaagagggtgagcgtgatcgccaagaccatgggtgagtgccgcccagggatgggaggattgtggcagacatggggactcagagcaggcttctaccagctgtacaggagcctttccaagttattccctggagctagcggaaggtcctctggagagagcctggcagccttgggtacctgagtttagactcttcctaagatgaagagttgagcggcctgcttagagaagacgatgcccatggccggggcacccttagcattgctgctgccatcctgccaccaccaacagaaccaccatctcttttatgcttcatttttcctaggtaccctaggggtgagcttgtcatcctgcagtgtccctggcgccacacacacctttgagcttgcagctgatgaaatagagctaggcctgggtaagcctgcggtcaccatgcccctgccgtgactgttttgcctgcctcagaggtcttgcagttgtctagctagtcctccctgcttatttaatgcccctcaggtggtctctagactcataggtgtgcacctgaggcatagcctagactttatcctgtctgactttatctagtttgccatctgtgcccagagccatgtgcctcctgtctcactctcacccatataattccctgttctcttgctccaaccccaatgcacaggacccttttggtccaaaggacaccttttctgtgactgacatgttccacttcttcccatgtatttctaacacaataggtattagtgtcctccagcttctgtgacttctcagctggctctactgccatgccatctgctgccgtgttcattacccttttctacccactgtccatacccattgtgcctagtctagtgttgaacactatgtgccattgataaaagcatggaaagacaattagcagcaggctgtgagccagccagtaatgaccacatctctccatagggatccatggggaagctggtgttcgtcggataaaggtaaatagactccctgatcaacctagcctagccccaagggctcccagacatgctcaccactgcttcctctgacagatagcacctgttgatcagattgtcactcttatgcttgaccacatgacaaacacctccaatatatctcatgtgcctgtacggtcaggtgagcaacctgttgttcccattctccaaggcctttcttgccccctttcacagaagccaccaaaggtgggactgagggtgtcacatctattaacaggctcttcagtggtgctgatagtcaacaatctgggtggcctgtctttcctggaactgggcatcatagctgatgctgccatacgcttgctgggtgagcctaccctattaagaggacctttagccctttgtttttttttctttgaaacaatgtttcactatgtagccctagctggcctgagcttactacatagaccagactggtgttatactcacaaatatcctcttaccggttgtctccatgcccaactcccttaactctttgaacctggtttgaaactaggataagaaaagcagctgaggcagtgtcctgtcatggcccagaacatcagctgaatagaagtggaacacaggcttgagttaaattgtcacttttgccacttaacagatgagggcccaagtctggaagtaataatagcaacacctgccttataggtgccttatgagaattatatgggattaagtataggaaagacacccagaaccttctaagagctcagtaaacgacagctgtagctcatcagcccctcaagggggacacatccaaggaatgtgctaatgggctgtcactgagggatgctctaaggaaatcaagccatttccctactcatcaaagacttcaaccttctaggtccttgttttgctgtttggtagttcccctccccactcacaggcttctttgcttggcactgcagagggccgtggagtgaaggtcgcccgtgccctggtgggcaccttcatgtcagcgctggagatgcctggtgtgtctcttactttgatgcttgtggatgaacccgtgctgaagctaataggtgagagctggacctgggagcactgctagacaaaatcctcagccatccgcacgttccatcctggagaccacattagggctgatggtgacagtctccatccacaggttccatcctagagaccacattagggctgatggtgacagtctccatccacaggttccatcctagagaccacattagggctgaaggtgacagtctgggctctagacctatgaagaggccttttctggtttttcagccttcagctttctctcacccaattctggaaagttggtgttagtgtcttcccgacacctgccttaccctctctccagggcatacctccacctcaatgtgtagtacacacttagtatatccttatcagtttggacccacttcttgtaaacagcttagggaaccagtcttcagggtcaggtgggaagtctaggccccacttgatcttgtctgaaaaagttatgtggctgcctctagatgctgaaactactgcaaaagcctggcctcacatggccaaggtctctgtgactgggaggaagcggattcgggcagctcccacagagcctccagaagcccctgaagccactgcagcaggaggtactgggtcctgctgaggaggaggggaaatcatccttggtggtcaaaactttgccttgactgtagtgtacagaaaccttggcacccatacttcctacactggcaatgtttagtatactgtcctccctttctaggtgtaacatcaaagcagatggcacttgtgctggatcggatatgcaccaccctcatcggactggaggagcacctgaatgccttggacagggctgctggtgatggggattgtggttctacccatagccgtgctgccaaaggttggcttctttgggacacttgggccaatatggcacactagctcttagagttggacattccatttaacaatttcaagaacatttaggagctttcgtggagttgctgcttcccttcaccaagtgaggccatttgccacaccttggcacacccctcagcttgttttcatgaaagaaactccattctgctgcccttagcgcactcagttgcccataccaccaaaaatccctgtttgtctagctgtccaagaaagatgtattcagccgggcagtgatggcacacaactttaatcccatcactcgggaggcaaaagctggtggatctctgagttcaaggccagcctggtctacagagttgagttctaggccagtcagggctaaaaagagaaactgtcatgaaaaaagtcagcacctacttgaagccaagcagcactcctgtctcatctccatggttaaaaagtaaatgaagccaggcaatggtggctcgtaaggatttccaggccaacttaaggtgataggaaagcgaagagaaacaagcaagcaggcagaaaacacgtttttcaggaaataagacaaatcaggaaaatactagcaaaggctagggagagaaaaggaagtggctagcacctctgaaaggccgcctgtctctacttgcagccattcagggctggctaaaggaaggcccatctctaaccagccctgcccaggtactctccagattgtctgtcctgctgctggagaggatgggaggctcatctggggcggtgagtagaagcaggtcctgaagggacagactgatggggagggttgcaggcttggctgggtcccagccagctctgtgtaatcaacattttgatcttccccagctctatggcctgttcctgactgcagctgcccagcctctcaaggccaagactgacctcccaacctggtctgctgccatggatgccggcttagagtccatgcagaagtgagccagcaccccacatcttaacaccaggggtgtgctggggaggtgactcccagctagaccctgtccttacacctaaagtaacaccttgctcattctgtcaggtatggaaaggctgcaccaggagacaggacaatggtaggttcccctttccccctttgagcctacaagccctaaagctcccctaagtgtcagggcttaactcccctttctctgaccttgtccagctggattctctgtgggcagcagcacaggagttccaagcctggaagagcccaggggccagtctcctcccagtcctgactaaagcagtcaaggtgaggacactcagctggacaatcaaggagccactaagctccaatctctgggtggccttaagcaagttaatggtctcttttcactgtcattccacctttataaaacaggggtgagcgcctatctcagaaagtacttatgttgctaggaagataaattgagcctagtctagtacctgggctgaggctcagcaaatatgggcccctttccttgcaagaagcaggtaagaggtgacctttctttccactggatgatggtacagagattgctggcagaatgggacaaaggatccaggcttagatttcagggcccaggggaccgtgtattatgttctggagccaacttccactgttcctcagagtgctgaagctgcagccgaggccaccaagaatatggaagctggtgctgggagagctagttatatcagctctgcacaactagatcagccagaccctggagcagtcgcagctgctgccatcttccgtgccatcctggaggtcttgcagacgcagggagcatgactgcttttctcctcctcagctcatttgttactttgtcttgccttcagatggtcaccctccctccctccctccttccctcccccttcccccaccctccccctaacacccaacctctgcatggaacaggacatccttcaccacaccttcagaactgttccatgaagatcgtatctggctaggtgggtcacatgtccgggcagcactgttcttcccctcctcaggatgaggagtccctcagatcttatccaccccagtctctaactgggtatacccatttcgtttcaagatttcaggcctcagcctggcagtggtggcgcacgcctttaatcccagcacttgggaggcaaaaagattctaggcctcttcctctggaaggcctcctatacccagtcagtatacgaaagaaagttaataaaatccattgaagccataggactttgtccctgtttacagtgaccatgacccatctcttggcaggcagttcatcacctgtgttcaatacaagttctactcagttgggctgcctccctgggggctgcttcggcaggcttccctttccttccccagcacacagcaggccagtatacagcagagtggcaaagagacttttctctgcagcagatcaacaactgagagagtcttcagaaattacatgggcattgggttcccagaagacatggacttactgtgttttgaggctctggtacagctcagaagctgtagttgtgtacattccaaggtctctctagaacaaatattgcctatgccctgactggctgaaaggcagatgactggtgcctggtggagacaccatacacacagctcataccgggtatgagctgtaggtgtagggcactagcaggtcctatccatgacatgaagtcaggttctgtttcaagtcagctatgggaactcatgcccatatttggccagtaaagatctgtaaaactgaataatacccatctcaagacagcaagacagctcactggttagtagcctgaaggcccaacaacttgaatttgatcattaggtgtcaggagataaagttgctttcacatgtgctgtggcatgaatgtgcctacacacaaagtaagattttggttttcagaatggtaaacatctaagaacactgactgctcttccagaggtcctgagttcaaatcccagcaaccacatggtagctcacaaccatccataatgagatctgatgccctcttctgatgtgtctgaagacagctacagtgtagtcataataaacaaataaataaatctttaaaaaaaaaaaaaaaggtaaacatctcaggggctggagagatggctcagaggtcctgagttcaattcccagcaaccacatagtggctcactcacaaccatccgtaatggaatctgatgccctcttctggtgtatctgaagacagtgacagtgtactcatacataaaataataacataaatcttaaaaaaataaaagacgagaatggtaaacatgtagggatatagaaattcagctgaggagaggattcctaagcagtctagtgttgtagtgctgtcaccaggacagggttagcattggtgtcaggcatactcacttaggtcatactaagtaaagggactccatcatctgtgttattcagattagacactgggattccttggcctctgggcctagagtcccttcttaatctgctccatcaaaagtccctggcaaccaggaaaggcgataacatttgaaatgtaaataaaatatccacacacacacaaaaaagtccctggcaacaaaactgggtgtcagcatgtacagactctgatacctgtgcccagcagagggcaaggctatgtccacactaacctgtgcatcccaactctgtcccccagcacagtgacatcagctaactctacttgcctgtcccactccactccttttggagtcttgttttccagactttaaagcagagaacactcctttcctgatgaaagacatatcctatagccattcattatgaagaacacccacacagatttaaatagcatgcaattccaggaacataatcatggatttctggttggccctctctgcgtctgtaagggtcaaacctgggctgaggcctttgtacactgtcaaactctgacttaaccacaatgcagtgtcagcaaagaacgtttctgtgttgaaacagagctcctattcatgaaactttatccctaatgtgatggaattaaggggtggaccttgaggccatcctggtggctcacacctttagtctgagcaatctggcagcagaggacgggcagatctctgagttcaaggccagcctggtctatatagtttcagcttcatagtgagaccctgtctcaaaaataacaaaaaagagttaagacctttgttaggtgattaggggtgatagtgggatcaggcccttctaaatgggacgtagtcatcatttataagggtctgggagcaacttacactctgtaccatgtgaagccacagtaaaatgacggtaggggaaatggcccttaccagacacacatgttgtttccttgatctttgacatctagcctctaaaagtatgagaaataagtgttttgtttaaaattattttttaaaagatttatttatttaaagtatggacgtagaagagggcatcagatcccattacagatggttgtgagccaccatgtggttgctgggaattgaactcaggacctctggaagaacagccagtgctcttcattactgagccatccctccagcccctaaaattatttttaaaaaacagtctgaacaaaagagacctctgatgtttaaaaacatatttaataaaaataagattcatgaagtaaaatacccactcatgagtgaaccaggaagatgttcatgtgggtgccaagagtcatcgctatgtgttcaggcttccatttagtcagcaaatccatgccagccctcctcccaacgtctggcagcctggccactgtctgcagagagttcaggaacccaactctgcctgcctgtctgcctgcttgcctgcctgcctgcctgttgagggacctggcagggctaacacaaaggagtggggcaagactcctccctctctacccagtttctattcagaagagcaaagctcacattctggtatagcatagagggtagctgagtgaccttttggggaacagaagcacccactactcaataaggaacatctctgaaggcagcagcagtgaatggctcccagcaaattgcttcataatgctggtttcaatttcatagtgggctggggccctgtcaggggagagcataactagaggaggcaggaaagcccatacccacaaagggacagaaaggaaggccaaagaaacctcagactcatcactgggagggactctagggacaggacatgtgttcttgggagaactgtttaacggctcgtcatgctacctgaggggaacaggcatgtaagtcacagggaaagggcgggatccaggaagcagctggagcagcagctagaagagggggaatcacaaggtcacaatccacacaatacagcacatcaaagtgaaaagagcagagtactgggcacctgactttacagcagaggcttctccggctgccactgtcccatgaatgacccctcaatgcaactgcccacccaaatacacatccaggacagagcagagggggaagcatacctaactaagacaaatgctcccacagagagcagactttgtattttacacgtgtagactgcatttgaaccccagctttggcttctcccacatccctaggagtggtaaggaaagcagcccaaaatctgcagaccagcagaagagacatgtgtgaccaaggcaagaaggtctttgtgccaatggaggaccagaaaaaaacggcaataagccaaagccacaagaaaagcagaggaacagctagtggctggacagcgagagcctgcaactggagtagcaaggttgggtctctggcccaagagaagtctgttgctgaaaccagccaggagccccagtacagcagaacttctgagggagcagagaccgcatcgctgaccgttcccaggagcccctgcccgcttcattccctgtcatgcaacaggggctggaaagaaggaagatgcacaggggttaaagacatgacctcgaaagaacctgagcttcaggaggcacaccaggcccgagctgctcagacagaccctcaacctgcagggtgaacccagccaagccaccagatctttcagggaagccccaaggttcctgagactggtccatagcatatcttcccacatctgccagatgcctcagttaccaagaacaggcaagacctgctttaagcacttgatgtattactaagctcttgtcccactattcttgccacagaactggcagagcctcgccaggctcaagtccttccaaatgtcatctcacagagccaaggactcttgtaggggaggggaccttgggaagttactcccgggtttggctgctctgacaccagagtccccatcgaccactcaatctgcaccttcaagctgcttggcttcccacctggctatagggtcaatcttcttagcaaggtgcaagtccttcttgagtccttctctacacctggccttaccccacctagaatgggagacagcagccatacctgtctatcagtcagagctcctggatctggacgcttccatgatgaagccagaagaacatagagaaccagcaagccaaaagccaccaccaagagccctgtgctgttggcaaagacagcctcaccaggcaggctggagtagggcttggtggcatttttcctggaaataataaaataatatgggtatttggaagattttttttccttttttttttttttgcctagcaagagactagattcctacaacctggaattaacataccaagtcactatcataacaacaggcaagaactgtgtaatgttttacccatgggaaaaatgaggctcctagtgaaatgagcctgcccgtccttacagaggacagccaagctccaagcccagggctgattcccagtcttatttgctattcactctaccaaactgcctcaaaccgaggacacagtggtgagacatacaggctctggaggcagaagcctaactccgtttccacttctgccatttactggctcttgcgtaagttactctgtacctcagtatttttgacaaagtttcagtgtatagccctgccaggcttggaactcactatgtacaggaagctggccttgacctcagagacctgtctgcccagactgttaggattaaaggcaggcagccgggcggtggtggcacacgcctttaatcccagcacttgggaggcagaggcagaggcaggcggatttctgagttcgaggccagcctagtctacaaagtgagttccaggacagccagggctacacagagaaaccctgtctcaaaaaaaaaaaaaaaaaaaaaaaaaaaaaaaaaggcagccactatgcctagcttattacattctctcatgctaacagcaccagatgttgtagagtgcttaagaggattaaaggtgaggtgctttgagcagtttctgacaaagcaaaggtactgtatcacttggtgtttagtaagcattgccagtttatgaattttaacctaaagaccagttaattctgccaccttccagatcaagaactggactcaagccccccattggctgtcctgcgattataggatgtatctcctgaagccactactccctcccatatcccttagtgttagaggtcccttgaaacttacaaaacaaagaaaagcttctcattgatgccggaaataacagatgtgatggacagggaaaggatgcaggctccaaagaatacatgcagaggtttcaggaggcttcgcagccactgggatgcccagggcaggaggaagacagcaaagcccaggaaccactgtgaacacaaggggagaagtctgtggggctacagggggacaactgtgcgccttcacctacagggcctcctgctgctcactgtccgagtgcccctctctttcaactcaaatattcccaccacacacagccctgaccacacaccacacattactgtgctctgcctatttctattacacaagcaataagtgggcgaagagcttgtagcaaacactcagaaaacttatccatccttgttagccttggtttccgaccagtcctagcccataaacaattcaagtacaggactggcactggaatactgaaattactttttagaactgcttttggttcaaagagggaagagtggaaaaagcaaaaaagaggctgcattggagtcagatgacatgtgagaatcgaaggcagggggacagacaagcagtgtgacaggtataagaaaccagcctggtctacagagtgagttccaggacagccagggctacacagagaaactctgtctggaaaaacaaaaataaacaaaccaaaaaaagaaacaagataaaaggggctggtgagatggctcagcagttaagagcactgactgctcttccgaaggtcctgaattcaaatcccagcaactacatggtagcttacaaccatccgtaacgaaatctgatgccctcttctggaatgtctaaagacaactacagtgtactcacatataataaataaataaatcttaaaaaaaaaaaaaaagatgggggctggtgagatggttcagtgggtaagagcaccaactgctcttccaaaggtcatgagttcaaatcccaaccatatggtggatcacaaccatccatagcaagagctgacacccttttctggagtgtctaaagacagctacagtgtacttacatataataataaataaatcttttaaaaaaaaagatgtttaaaaaagaaacaagagggctggagagatggctcagcggttaagagcaccgactactcttccgaaggtcctgagttcaaatcccagcaaccacatggtggctcacaaccatctgtaatgagatctgacaccctcttctggtacatatgaagacagctatagtgtacttagatataataataaataaatctttaaaaaaaaggaaacaagataaaagtcagactccaactctcacaggagagctgagtctacaggttacaagacccactccaggcaaggggcagagagaatactgggagctaaagctagagaagccatgcccaaagtgcacagacccccagggactcagaaggaagagacagaggacacctacctggcaggcgaagaggactacagtggtgatacccagccagctgtgcagggagtagaggtgtgcgattctcgagtggttgtgaaaccgaaagacggcaatcagccccaccacagtgcaggtgaaggccagcaggtgcagtgctgcatggagaactttccagggcagcctgggccccacccacgatgaaggcaggcggtacaccagtgaggctgcagagagaacagtcccggggctcagccacagcaccttacagtcccctgatgggaccccataacctcttaataggaagaagtaagggccagcacattgatcctgtcctgattggtttcttgtcaactcaatacaaactagttatctgagaagaagaaatctagttgaaaaatcctcctcattagattgcttacagaccagtctgttgaacattttcttggttaatgattaatattggagggccaagctcactttaggtaatatcatctttgggctggtggtcgtagatggtataagagagcagggctagagagatggatcagtggttaacaacactagttgctctgccagaggacttgagttcaatccacacaatggctcacagccatctgtaactccagtaccagggggatcccacaccctctcctggtctccaaaggcactggatacacatggtacagagacatacatgcaagcaaaaaagccatagactcaaaaacaacgattaaaaagataaaaaggcatagtcatctattggatggaacacggggcccccaatggaggagctagagaaagtacccaaggagctgaaggggtccctataggtagaacaacaatatgaactaaccagtacccccagagcccttgtctctagctgcatatgtagcagaagatggccgagtcgaccatcattaggaagagaggccccttggtcttgcaaactttatatgccccaggacaggggaatgccagggccaagaagtgggagtgggtgggtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagccatgaggagcaacccagtaagccacctcctccacagcttctgattcagttcctgccaacttctctttcatgatggactaaaagtgtaaagtgaaataaatcctctcttcccgaagctgttgtcagtcatgttgttttactacagcaacagaaccccagctaagcctgctcagcgcctgccatctctgttatttgcaggtggcagttggccaagaacggtggcaagaagggcccgttaaaaatgggaggagtttttttgaactgccctggctcgatcctgtatgcagcgttgtgagctgatgagcaccggtctcttcaggtctcatcacaatgaatccatccagccaaggctggctaagaacccagggatgaaagctgaggatatcccttgtgaagagaccctgtctcaaaaaacaaagtggggttcacaagatagctcagcaggtaaaagcacttaccacataagtcaaataacttcagtttgatccctggaacccacagttaaaagaaagaactgactcttaaaagttgtcctctgatttccacatgcatgctatggcatgcctgtgcccatgtacaaacacaaacacacacacacataccaccaccaccaccaccaccacacaccaccacaccaataataaataacatagcaaagaatttaggacagagcatagtagtacatgcctttaacccaagcacttgggaagcagaggcaggtggatttctgtgagttcaaggccaacctggtagagttacatgtttatacatatgtgcatgtgtatgtgcatgtgcatatatcacctacatcataagaaaacagtcaagaaccagagggaatgatgtgtgaagtacacggagtgagcggcttttggcaatgctatcatcattcccatcctcatttagatgcacgaagcaaagatggctccttgacccaactgtaacacaagaggcttcaacttctttttctagtgctaggccatatctagcctgttgcctaattccctgataacacttcactgagacacagtcatgcattttacatactttccatggctactcccatgatatgatgcccaagccctcattcttcctcccccgtctgtctctcaaacacacacacacacacacgccccacccactaccatcaccaccataccaataataaataatatagaagcagggctgaggggctgcaatacagattaca

SEQ ID NO: 926 - DNA, 1522 bp, Mus musculus
gtgctgctgtctctacttcagacctggtagcagtcaggaccgtccacccggcggcatctcagagcagaagtgtgagctcagcttgtttcagaactttcccaccatgagttccaagaagatggtgaattctgtggaagggtgtgctgatgatgcccttgctgggttagtagcctctaaccctgacttgcagctcctgcaagggcaccgtgtggccctacgttctgacctggacaccctcaagggccgggtagcacttctgtcaggtggaggctcaggccatgagcctgcccatgccggttttatcgggaaagggatgctaacaggtgtcatcgcaggatctgtgtttgcctctcctcctgtgggcagcatcctggcagccattagagctgtggcccaggcaggcacagtgggcaccctcctcattgtgaagaactacactggggatcggctcaactttggacttgccatggagcaggccaaggccgagggcatctctgtggagatggtgatagttgaggatgacagtgccttcaccgtcctcaagaaggcaggccggcgtggcctgtgtggcacagtacttatccacaaggtggcaggtgctctggctgaggaaggaatggggctggaggagatcacaaagagggtgagcgtgatcgccaagaccatgggtaccctaggggtgagcttgtcatcctgcagtgtccctggcgccacacacacctttgagcttgcagctgatgaaatagagctaggcctggggatccatggggaagctggtgttcgtcggataaagatagcacctgttgatcagattgtcactcttatgcttgaccacatgacaaacacctccaatatatctcatgtgcctgtacggtcagagggccgtggagtgaaggtcgcccgtgccctggtgggcaccttcatgtcagcgctggagatgcctggtgtgtctcttactttgatgcttgtggatgaacccgtgctgaagctaatagatgctgaaactactgcaaaagcctggcctcacatggccaaggtctctgtgactgggaggaagcggattcgggcagctcccacagagcctccagaagcccctgaagccactgcagcaggaggtgtaacatcaaagcagatggcacttgtgctggatcggatatgcaccaccctcatcggactggaggagcacctgaatgccttggacagggctgctggtgatggggattgtggttctacccatagccgtgctgccaaagccattcagggctggctaaaggaaggcccatctctaaccagccctgcccaggtactctccagattgtctgtcctgctgctggagaggatgggaggctcatctggggcgagtgctgaagctgcagccgaggccaccaagaatatggaagctggtgctgggagagctagttatatcagctctgcacaactagatcagccagaccctggagcagtcgcagctgctgccatcttccgtgccatcctggaggtcttgcagacgcagggagcatga

SEQ ID NO: 927 - protein, 506 aa, Mus musculus
CCCLYFRPGSSQDRPPGGISEQKCELSLFQNFPTMSSKKMVNSVEGCADDALAGLVASNPDLQLLQGHRVALRSDLDTLKGRVALLSGGGSGHEPAHAGFIGKGMLTGVIAGSVFASPPVGSILAAIRAVAQAGTVGTLLIVKNYTGDRLNFGLAMEQAKAEGISVEMVIVEDDSAFTVLKKAGRRGLCGTVLIHKVAGALAEEGMGLEEITKRVSVIAKTMGTLGVSLSSCSVPGATHTFELAADEIELGLGIHGEAGVRRIKIAPVDQIVTLMLDHMTNTSNISHVPVRSEGRGVKVARALVGTFMSALEMPGVSLTLMLVDEPVLKLIDAETTAKAWPHMAKVSVTGRKRIRAAPTEPPEAPEATAAGGVTSKQMALVLDRICTTLIGLEEHLNALDRAAGDGDCGSTHSRAAKAIQGWLKEGPSLTSPAQVLSRLSVLLLERMGGSSGASAEAAAEATKNMEAGAGRASYISSAQLDQPDPGAVAAAAIFRAILEVLQTQGA

SEQ ID NO: 928 - DNA, 33361 bp, Homo sapiens
  misc_feature (1)...(33361): n = A,T,C or G
caaattcccaggtcacactaagcaaatgtttctaaatctctgaagtttttgattcttcatctattgcatccctacactcagaaaaatctataatttgtcttgcatattcctgctccaaaagatactgcctaagtattaatattaaactttttgggagcctcctcccagaactgaaatcagcaataatcttttttttttctttttttgagacagggtctcactgtcacccaggctggagtgcagtggtaccaccatggctcactgactgcaacatcgacctccccgggctaaggtgatcctcccacctcagcctcccgagtagctgggactacaggcacacaccaccatacccacctaatttttgtactttttgtagagatggggttttgccatattgcccaggctaatctcgaactcctggggctcacacaatctgcctgactcagtctcccaaagtgctgggatcacaggtgtgagccactgaaaccagctagattgatctttaattccagattatatccttttctgtttccctttcttttccttttctcacaggctgcttggatagattatcacaggatcctgtgagatgctccaatacctaactcattcaacagtcaacttccacagcaggaacaacagtttgttgttaggtgttaagtaacataattcccagagttgaggtgtgggaccacacatttggtgtctttaggaacctaaaagaacattgtagaggaacagggagaacaagctctacctctccaaggagttctacacggagatccttgagagtgacggtgccatccatctgttcctccttctccaaaagcagcatgaagagccggccttccatgtctcccagcaggtatcttgagccattagggtccactcgattgtggcacacaatcgtgctttgctgccaattggaaggaaacagtcattagagattcagcatcttctacaccagaaaacaaaccctactggaccactccctttaccaaacccagccattttaccagcagacaaatcgctcagataacattacatgaaaatgaggatagatcctattgcccattaatagaaaatggggagcttttttattttgaagataattttctgaggcgctccatcaatatatcttatatgtttactgatatgtcgtcattctgcaggaaaatagaaatacacagaataggaagctgctgccaaaatctactgaactatgcatgctactacaaatgttgttatttattcttaataccactaattaccccctaccactgtggcaatgctaccacagattttgttcttttttttaaagacagggtctttctatgtcacccaggctaaagtacggtggctattcacaggcatgatcacagtgcactgtagccttaaactcctggactcaagccatcctcccaagtggctagtactacaggaacttgccactgtagccagctagattttgttcttttttctcaaaaagaaagtaaaatgaaacttttaaggcttaatttttacaacttgatattctaagtccttgacatttttgactttcttagcctttataatttatcaatatattactttatatgacttgagccctgaaaacattacatgcaatagaaattgccaaaattacggctgggcacagtggctcatgcctgtaatcccggcactttgggaggctgaggcggatggatcacctgaggtcgggagttcaagaccagcctgaccaacatggagaaaccccatctctactaaaaatacaaaattagccgggcgtgatggcacatgcctgtaatcccagctactaaggaggctgaggcaggagaatcgcctgaacctgggaggcggaggttgcagtgagctgagatcgtgccactgcactccagcctgggcaacaagagcaaaactccgtctcaaaaaaaaaaaagaaactgccaaaattttcccctcttaaagttgccccatgtggtagttcatgcctgtaatcctagctacttgggaggttgagacaggaggatcacttgagcccaggagttcaaggctacagtgagctacgatcatgccactgcattctagctctccagcctgagcgacagagtaagaccctgtctctttgacaaaaaaagttgccccagtcaatgaaaaggggaagcctattttgattatcatttatctaagttagcaagcaagttctctgtaagcaaatccaggctaatctctctctgtattcccaatggccaacgcaataccttatatacatagtaaattgtgtaacaggcatctgtgaatctccttttgataaataagagaaagggaggagcaaggtgaggacaaggaaagaaaagatgaaaggaaaaaaaggtaggactgcgctcaccttgatgataggaggggcaatagccaggtatttgtcaccattgtgataggtgattgactcctgtccaatgatgatggcccccccaaagggctctgggactgcaggaaagacagcaaaattagaatgctcagcactctgggtctgccaaaccaggactggcaaaagtacaggtctagttagccccaaggcaaactttaaggtcatcattattttaaaaaggacatcaaagcccagggaacatgatagcctttacgagactcttagaatttgttaactggccattatctaatcctggtagtatttttactgccactcttctggtgttcgactattcctatgggtggggagtcttctccatgttcttccccatgcattctcccccatttttcttctcaacttctaatcctttccaagtaaaagcttttacttttttttcctggtttccactcttgttccttagcttaacttccccccattatcagggctaccactgagaagagccaattttctcttaagagttttaaaacttccctactgagtgagacaaacataatgtaggggcagacttaggacaaggagtgaagaggcctggattctagcccagactttgtcaatcatggacaggcatgggcaggtccctctggccctgtttcttcatctatgaggtaaagaaatcagataagctctattgctccctttcagttttttgttgttgtttttttttttaaagagatggggtctcattatgctgcccaggctgaactcaaactcctaggctcaagtgaacctcccacctcagcctcttgagtagctgggactatagatcctggcttcctttcagttttaaatgttatgcccagcaataaaataatgagactcatttccatatgccactgtgcaaatcaatctcaatgttttatagtcaatccctccacccaagtaaaagacaagttatacttttggggggagaagtgaaaaacagaaaatctcaaagacagaaaaaaacaaagcacaattagagaaagaaaacataaaggagtggtaaacaatgcacaccttcaataataccgagcgccaaaacgaagggcagagaaggtgagggagcgaacaagaacagggaactagcctagacccaggtggaggcacatttcctaaaccccctaccaacctgcgatcaccatggaagcttcagcttcgacattttcctgtttccaagggcccttattgaattccttttctcggagagacacctcataggtttttacgtgccgcccctgagggtcctgggggggaaaggtaaaatggttagcccttaggaagggtgagccttgggctagagagaggtgctgtaaggaataagccaccactacccagcatctgacagtcctgtcatgtcagccctcccacccttatccatcactatactgacaagcactagctgagcctgggatgaattcctaggtagactgcagcatctgagatctaccattcttaacaattcaaccaaccaagaaaggtttaaagaattagaaaaatgaacttgtcacactgcactaggtactataagagatactgtgtgccaggcacagtggctcacgcctgtaatcccagaactttggaaggctgaggtgggcagatcacctgaggtcaggaattcaagaccagcctagccaacacggcaaaaccccgtccctgctaaaaatacaaaaattagctggcatgggggcgcgtgcctacagtcccagctactcgggaggctgaggcaggagaatcacttgaacccaggaggcgaaggttgagctccagcctgggcgaccgagcaagactccatctcagaaaaaaaaaaaaaagagatacagtgtgtgtgcctgtgtgtgttccttagcctcgagaaacttacaaaacagctaagtgaaacacgcactgataagctacacctatgagattttttttaaattgatacaattcttaaaagcattctgatggaataatggtagagagaacacaattgattgctccgctaaagttgtcaaaactttcagtcctgccattgtcaacatcatcttcccctcctttttctgaattatgactcatgtcagtcctgggactgccaaggtcacctttaagatgctaaaaagcagggaccagaagaaagctacactcagccagtggaagacagcttcaacaaagaagttatggaaggaattcagcaatgtgtttcagggcagggatcacatcttagtcactgttacagctcctgaagcatgaatacctttcacatagcattaagtacctaaatatttgtcaaattgaatttctggcataaaacagaagatagtaatttttggctgatgaaaacattttcccatcaatgagtagggttatgacacaacttcgcaaaaagttcaagtgtggatttgggcctctgagacacacatgcagaaatgaagatctgatcacagctggcagccctgaagcttagaacaaccagccttgaataatcaacaacatcaaagttttaatgacctaatattacaaaactaaagaacatagagaaattctaagtttttattttaactcatactaagtaagatcaaacaaaatctcctggtttcaaccttattcaattgggtcttattccaatagcttcagaactacagtaacactaagaaatatacaaaaatatatcagcacctccaatatataacaaggctatcaaactgtttatgtgccaacacactctatgtggaactggactatcatttccttccatcacttattcagccacatgcaaatgaaatgatcttatgctgcatggccctttgttaaagggctgagattttaccaagatactggcatgttagtctggtgctctaccaccccacccccgcttaacagatctggaccagagaacagctgcccaggatcagctctgctacagttttaggcagactaaaatagaagttaagagccagcaagttgccgagcacggtggctcacgtctgaaatctcagcactttgggaggccgaggcaggcggatcatgaggtcatgagtttgagacgattctggccaacatggtgaaaccgcgtctctactaaaaatacaaaaattagctgggcgtggtggcatgcacctgtaattccagctactcaggaggctgaggcaggagaatcgcttgaaccaggaggcggaggttgcagtgagccaagatcaggccatcgcactccggcctgggcaacagagtgagactctgtctcaaaaaaaataataaaataaaattaaaataagccagcaagtcaccagtaagtgattactggacaaaatgtaaacctcttcttaaaaaacacatataaggcatcaccaagacaatttctctttgcttaatataaaggcaagatctagataatttcttgacaactaagttttaataatcccctagcactccagtaagagaatcaaagtataaactgggtcatcctatgaaatctcccaaggcccacaaccagagtgtaatctcaggattaaaacctgctacaagccccagagagcttgctgcctccacaataagtactactgcactcaagaagcaacgaaagtctgacccatattaattgtgttgttcaaaacatttcaggacaaacacattaaacacttctctctatcctaccaaacccagacatgccagttagcaaaaacaactcctatcacatcaacctcacagtttctcgctctctcttcctgatccagtacctggtagacaaagcaaatagtaggtgcttggcaaccatataggaacttgacatcaatgacatgcagctcctccaggcggatgttgaaggccttgagttctttattatcgcgatctagtggaataaccttgaaaaggccatcatagagacgcaggccaatcatccggcactcagggtcaatgatgccaataatgccggtctctgaggggcggccaatgcggtcctgagaaacaaaatcgggattagggaagaacctcaacatccacagagcaacagaggacgctgggcaccacttgtgcagaaaaattttaggagaggtattaaaactaatggatctatttgataggccaaatagttggagccccaatgtcagtgcatgcctttttcatgaaacactgaatctcaatgaattattaccctgtcccttgggtcttgagtgaactacaggagtcctttctccaaaaagctcaaacccatagtgtcttctccttatttctctgatcgaatagagagctgcccccagcactttaattttttccatgaatcatgacagccctacttagaaaactttcattggcctaaagcagccacctcacctggacattgccatgggctcgcgtaatgatgtcaatgctctcgccactctgtttatactccaggatgcaggcattgtacttcgctgtcaagataaacagcaggtccttgctctccccctggaaaccaatattatgctatcaaaagaggttctttttaaaacaggaacaacctgtccagtctttaagcacaccaaattctttaagaattttccaaattcttctctccctaaagagaaaatacatggtgagcttgtaacccacactaggtacacatacaccctaagggcatgtacaaaaagccagaactgaagctggtaaacatctagttctcactttcatgattctccatctctctgttctacatacaaagtcttcatctatttcaatctcaagctaatctcaatcatcccattcaaattctgaaagatgaatgtaatgcctcctccactcctccccaagtatttgaagaaagagaaaaaaaatgtgggaataacaacggaagctaaaatggatcaacaaagtcctacttatttaacacagactccaaaaaattgctgttttgttcaaagggttataattaaaattttgaacccactgctttcttgccagattcagttaagacaacataaagcaatgtggtggtgatttggatgaaaacatttgcgctaaaataatgaaaatactgatggtaattgttttttttgtttggtgtttttttttttggagatggagtctcgctctgtcaccgggcaatgggcgccatctccactcactgcaacctccgcctcctgagttcaagcaattcttgtgcctcagcctgccaagtagctgggattacaggcacgtgccaccacacccggctaacttttgtatttttagtagagatggggtttcaccatgttggccaggctggtctcgaactcctgacctcacgtgatccacccacctcggcctcccaaagtgctggggttacaggcgtgagccaccatgcccggcctggtaattgttaacataactgtaaatgcttgctatatgataggccctatgttactgaatcatttcatcgtcacaacaacccaggggatttgatctgaaaggtgccttaagtggcacctaaagtcagaattaacaagaaatgaagccaggactgccccactctgtagcctatcctctgaaacaaactgctttaatttctcccttctaaagaagtcaacttcataaatgtttccctaatgaatctctccttttacttctagaaagcttggtcaagagtacatactgaaatttgctatccaaagagagaaaaaagagaagagtttttctcctaaagcatattccacccatcccaagaattcgcaaaacaacctaacacagcccaagcacggtggcatgcctacaataccccagctactctactccagaggctaaagtggagggattgcttgagctcaggagttcaagacatcctgggcaacactgtgagacccccgtctcaaagaaaataaataaacaaacaaaaataacataaaacaacctacgaccaacagttccccctccactgcttgtcccaactgcaacacttaccttgggcctgaaaagctccatgaccgcaatcttcccatacatgcccacctctttgacgggccgaagcccctcggcggtgaccacatagatctctaatctcgtgtttttggcaatcaacaggtttaagtcttcggccgaagtaaagtgtcctgaaagaacagaccctctaacttttgaactcaggggaagggcctcccatcccttcaaaataatcctatcacttatgtctaaatacctccagaattctcatttacttcacatacttctccaactccctccagctactccccttcttgccaaatccggcacctcaaagagtctcagttcatgcattcaacaaagctacttccctaatcagactaagaaaactggactggacctaagagccgtgtgtcctccaaatgacaatgactgcgtaatcccttctcatgcctcttgcccctccaattttactctattacagttacagtggcaggctctaattgagaatgccggagaaagtgttcacttcttccagtcttcatctaaagtctcacaaaacttttatctgacagaccaagtcaaatgaagaaaagtcccagagctttatatgaaaacactgttttgtccacaccccctgccctcctggcagtctaccaatacctccatccacactcagctacctccaactctgaacaacagttttgttttggaatcatgattagggtgtatataaacatgcaagcttggggtctgcatattcagctgagaatgtgggttaagatgactcttcccgggttctgaacatcggtgtccttaacaatccaagcgcatcgtcaacaaggcaaacccagcactgggccaggcaaaccaaaccctcttctccagcagggccctcatgtaaacaacagccccaggcaaaggggttagcctgaagagggctcctctccctctgtgggataatgcgggcattcctcacatccctccacctcctgggccccccagacttccccacaggaaaatcttgaccccaaagtcgtcattaccacctccccttttcctggccacagaaagccaatctccaggcccaaacgacaccgcacaaccaactcacactcctctgtctcactgggcccgccctgttctcgaggccgaatgacctccccaggacgaaaggggaccctcgagagcggcttccaacccccaaaaagcgcgtacagggacgactctttcgaggtcgcggtgctgggggaggttcctcggccgccagcgccttccattcgccgggcccactcctgcccggccgcccccggggccgcgggcctccctaggccgcggctccccccaactccctcactcgccggggtctccggccccggcagcctcaccggtcacgcagccgttcacggcggtgggcttctgggccgttaccacgtagttgtacgacatgtcgaggcttggagcggcccgtcgggactcgagcgcgacactagaaagagggacacaagcgaaaagacaggtggcccccaacagcgcgcagcgaactccactgccgctgcctccgccccagagacacgttgcaggccagagcggccggggcgcggggcatcacgggacggcctcacctggcctcttggaggactcccgaagcccgaggccgccaaccgaaggaggccccgcccccggaggcaccgcctcgcctctttccgccagcgcccgcaggacccggatgagagcgcacgcttcggggtctccgggaagtcgcggcgccttcggatgtggcggatgcggccgtgagccggcgggggaggtgcgccagtgtcctccgagctcgcccgcagactccccaccccgttccgcgccctttgcccttccccgcatccagtcctccttccgttgctccaggagccctcgggctgttcctcctttgggaacgggaaggactgcggaggcatagagagggaagggagaccgcgattcgtgcatatcccagactagaaccttgcctgctttcctttcactgtctcagttcctccagatccagctggtgccctcgcctgacgtttgaacgaccacctgctcacctcctcccttttgcgcgttgattcttcagacttcaaagggcccaccggtctgcttgcccaacgttattagtgcccctattgctctacaaattcgaacctcaaacacaaaaccagtatttctccgtagggaaccttaatgagccaggagagccgtcagccctgcagcctccagggtaccccacatcaaacaggctccccgggaacaagaggaataccacgtggcttggcacactcgcagaatgccagagaggagccaacccccattttacagatgaggaagctgaggcttagggaggaattggtttacctaagaccctccccacaaccccaagtaggctgaggcagagctatgttgattcttcctattgtgcacccacacagaggccaacacgctgctgaaccaggctgaactgaggaaaagctagaaagtcatcgtggtttacatcttgcctttcccatagcagagactctgcctgactttggaggcactgaattatcagtagtaaaaacacactctgtagaaaaactagacattggtttagattctggctgttacctgtattaccttggacaagtccctagagctctctgagtctgtttcccagaagtaaaatgggtcacaaacctggctagctccccccattcccttcccttttggtgccaaggccagtgagggcaagcgtgtgacgagctttgttaactttttcgctgcatgtgatgcccgtgtaaaagatagttattctgaggatcactgtcctttagtgatgaagtgggtgctgttcctggacataaaggcagacctgtgcttgacatggattgatctgtcttctggcagtgaagtgcaggcatgaaccttggtcagccccacactcttctccatccgtagcccatgtactagagtttggacttggaccgaagtctggggcagctccctaattactagggtgctgaaggcgtgattgtgccagtcgactgcgagttccttccgcagcttgtatcgttacccactcctgcaggtgctgctgctgcctccactgtactcagacccaggtagcacaggattgtccatcctccagcagctcagtgcaacggtgtgaactcagcctgtttcagagcctccacaccatggtgagtcatacagggccgggacgggaatggcagcatggtctcaaagcaggatcccagccttgggcaagctaaagctccttacactttgactgagagatgctattgcctcctgaggctcacgggtgaagagagagggtcatcctctctcccagggtctgatccctgcttttctttgtttcctggaggctgctggtcccagccaggcctggggctgcagcctcttgagtcccttcagagccactctgccccttatctgggtcttgcattcagagtaaaacagtaacagttacctgctctgtaatagacattgtaccggtcacagaaggaatcgtgaagaatgaccatgtgaccgttcctaaccttggggcttatgtgggccggtctggagctgggatctacagtgtgggaggctggccacgtccctgggctttgctccaggcccactgatttgaaccaaaacaagccttgaacatatctggattcaaatttcagcctgccactgaccagctgcatgaccttttacagacctctctgcgcctctttttcttcatctgcattataaggcaaattaaggcctacctccagtggttgtgtggtgttgatcaagcagagtcctggaggcctcacttgacttcctttccttttccatcctttcaggccactgaaaccagggatagcactggtccctaaaccctcttctggctctgtaaaagacagattatcatgatggggagcaggccactttcttggagggtagtgctgctggaggctgggcttggagtgaggccaactcacaacttcattgtgtgttccagtccctggtaggctctgagagccacaaacccatgtcctttctagggcaacctctgtcaccctccacttccctccagcccctcgagaaagcagcatgatatggccaaaagggaaccagctttggagccaggcagacctggacacctgctggctgtgtgaccttgggcaaaatagtttaactgtgcctcagtttcctcactgggctcatctttcctccatagggctgttgggaagttttgttttgttttagtttgggtttttttttttgagacggagttttgctctttttgcccaggctggagtgcaatggcgcaatctcggctcaccacaacctccgcctcccaggttcaagcaattctcctgcctcagcctcccgagtagctggaattacaggcatgtgccaccacgcccagctaattttgtatttttagtagaaatggggtttctccatgttgatcaggctagtctcgaactcccaacctcaggtgatccacccgccttggcctcccaaagttctgggattataggcatgagctaccacacccggcctgttgggaagattaaatgagacatgctcaaaaacacttagaactgggcctggctcttagtcactgctcagcaaatggaaccaatcttattgttcttcttgctccctacagacctaggctactctgaagcaggtggcttagccctggccctggctggatgcaggacaggttggcagggaggcagcagagccaaattttgtacaaaggagctggtgctagcaagctcaggaagaagccacagccggaagttcaccttgccaggacctggctcagctgcaggttcccaccgggccaccaggtggcggtgggagcccagccctctgagtccacgttgggccccagtctcactctgtcttcaggacaaagccaggggctgcagcccttgttcagcagactctggcttttcacagcctgtttgaaaaagggagtagcttcatttgattgagtttccactatatcatgggcatatactctgttctagtaaatccctattttacagaggaagaattttagctcccgacaatgatgtatcttccctgagttcctgcagctaatgagaggcagaagtgggatttgaacccaagtccctgtaacagcagagctcaagccacactccattctggcccccacgctactcacttctgtctgcaccctgtatccactcagccaagcctggcggcactgctctgtaaccctccaccagcctgtccacaacccctcctgaggctgcctgtggccagtcctctcctccccaccccttcctgctggtcacccgtgcttcctggcaccaccacactattcactcatccaggccttggcttatgctccccctctggctggaagagcctcccttttccctcctcccatgtctcctgccccctttttccctaccccggtcctgcttatccttcccagagacctccaggcccctcgggaggctgcggcccctcctctatgctcccatggtgcacgtgcgctcctcgtgtagcagtgcccactacacatggctgtgacctctgctgtgtttccactgagggcaggaacagcattgttatctctttttttatttccgagatggagtctcactctgtcacctaggctggagtgcagtggcacgatgacagcttactgcagccatgacctcccaggttcaagtgatcctcccacctcagccttccgactagtgggactccaggcatgcaccaccatgcctggatcatttttcatattttttgtagagatggagtctcatcatgttgcccaggccggtctcaaagtcttggactcaggcgatctgcctgcctcagcctcccaaagtgctgggattacaggcatgagccactgcacctgagctgttatctctacacatagtgtctagtgctgggcctggcataccaagaggctggggaaatgtttgccccgcgttggagcaccagggagcagcggtggctgtggaacctgctcagctcctcccccagcataggagcctcagcctgaggcttttcttccttttgacagaagaaggtgttgggccccagttttattaaaatattttacactgcaggcaaccactcccccattttctttgtattgcagccattttttcagaataaattgaaggtatggtgcaagacacttcataaattaggtactgaatagaaagtcacacattactgaaaactcacagaaatacccacctaagatgtcgcccaactcaaggaagtcctgtgctcctggagttcctaggtggatgcgggagaggggtctacaccacagcagtgtggctgcgcaggatgggggtatctgtactgaccacattctgacctccttctcactcctcccttgcagacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtgagtatcctggggtggggcagggggtactagtggagtggacagggcctcctgggggatccttagtgctgccatgaagtgcaggatggagctcagcccagaatcaggaactggggtacttcccactctcccactccctccggctgggatcaggggcccatcacggcctctctgaatctgtttctacatctacaaatctacgaagttgggccaaacaatctctcaagtccttctagctctgagagtcggtgattccatgaatcttctggaccctccaagcccagcagacccaccccgattccatgaaggcttcctgactcttccagcctacagcagcacccctcttctgaattcccacctgctgtgtcccacttgtggactgtcctggcttctttcctgtgtggagccagggacgcagactctccttgagggctgctggagggcagggactaggatgcgcgtcatttctctgcttcctgtcttccttcagcaaaatccattcatttggcaaacactcatgagcccactgtgtacctggcgctgtactgggcactagggataccagacaggcaaggtccctgccctcgtggagcttatattctacttaggggagacagacaataaccaagtaaacacgaaagtaaatgagatcatttcagagggtgctaagtgacttagtaaagacagtaaaatggggcaaaggaacagtgagtccctggggagggagctggtgactgcttcaggctgggaggtcacagaaggcctctctaagatgcctcctaagaaggagtcagccatgtgaagacctgggggatctttgagcaccaagcacacagtagggctcaccaaaccatgacccccggagtgtgggaagccccagtgactacaggcgcgagtcccacccagcatgctcactccactctttccacctccaggtttcatagggaaggggatgctgactggggtcatcgcgggagctgtgttcacctccccggcagtgggcagcatcctggcagccatcagggccgtggcccaggccggcacaggtaagcctggcatgcaggaggggctgcggcagggagggcacagtaagcacactgagcccttccggctgctcccgcagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcaccgtgcttatacacaaggtgggcttccaccggggacgtggagactggccagccctttccagccttcccttgcctggcagcacccagtaactggacctttccagcccttccccaagaagctagttctttttctccagtgttccctgatctcagaaggccccgccatcccctcagctacctaagcccagatacaggcattttcccagactcgtccccttttcttctccacacccaatcagttgcccggtcctggtgcttctcctcccaaatgtacaacacacatccttctcagaccccgccctcctgctttgccttggttcaggggtcatctactcatgcctgatggctgcagccacctcctcactgggctcccctgcctgcttcctgccttctggccttgctcatccattctccacactactgccagaggtgtctttttaaaatgtgtatctgactaggttattcatccactgaaagccttcttgggtgcctacaatcaatacaagccctcaccatagctccctgactccccaccttcatctcccatcatccctgccttcctcttttttttattttcttttatttattttttatttatttatttattttttgaggcagagtctcactctgttgcccaggctggaatgcagtggcgcgatcttggctcactgcagtctccgctgcccaggtttaagtgattctccttcctcagcctcccgagtagctgggattacaaggcgcctgccaccacgcccggctaatttttgtatttttagtagagatgtggtttcaccatgttggccaggctggcctcgaactcctgacctcaagtgatctgcccgcctcggcctcccaaagtgctgggatgacgagcgtgagccaccgcgcccagccatccctgccttcctcttatggtctattcacgccagctcctgtacctgccaggctatggatcatctctggctttgcttatgcagtatctgtggcctggaaaattctttccttgtccagcctccttttggcctggctaactcctaccattctacagaggcccagctctgatgtctccccacctggaaggctctccctgatctccatctccccactaccctgagctggttggcagccagtcctagtgtggactccatcactgtaattaccacctcacataaattttcaatttatgggtatctgcttccctagcctctccccaggctgtgagttcttgaaggtggagactgtgacttagtcgccttttttccttttcagcatatactagatgcttggtaaaaattgggtggatggatggatggatagatgggtaaagtgacccaaaatagcaaggctatgggagagagaactctggaactctagagttgggaaactggccacccactggctgtgtgacattggacaagtcaccgcccctctctgggtccatttccccatttgtaaagtctcttctgactccaacagactggaattcttgaagattcctggcaggtacactgtgaatgaggggagtttgctcttctgccctaaatgtgatgggccaggttgagtgtgaaaatcctgaggttcccccttcccaacaagaaattcatcccctgcctgtcttctaccccacatggtacagtgataccctcccccctggggcttttacctctttgtggctgcaggtggcaggtgctctggctgaggctggtgtggggctggaggagatcgcaaagcaggtgaacgtggtcaccaaggccatgggtgagtgctggcctgggagctggggaagagagtggggaaggttggacagccctggggcgaggagcaggttcctgttggctgcctagcggtgctccccaggttattccccaggggtctagggagtgtatccctgggggagctcctggggactggtggccttgggtaccatggctgaggtggagagtctggcagcctttctcagagaagagggtacctgtgggcagggcctctgagatgctgctgccacccttcctgatgcccagtgctaagagtggaacagtcatcccttcatgccttgtttctcataggtaccctgggggtgagcttatcctcctgcagcgtccctggttccaaacccaccttcgagctctcagccgacgaggtggagctgggcctgggtaagcttgtggccatccatcccagccctgcctgctccttggccctggactttgcccaccttgcatacccttagagccatcaacctggtcctctccccaggtggtcttagtatttttacctggtcatttgaggcccagcctgggccaacctgcctgatttctacctgctttgctgtctatacccacagctttggccatgtggagctctgtgcactgcccacctcctagcctttgcctgccattcccaggtcctcctgtccctgccagaatacacccttctttcaacggctattcaaagatcacctggctgcaaagctttctttcctcgcctgtgcttcctccttaactatctctagttaaagctatctccaccaccaggccacaagctcccagagaacagagatcgtgtttttcattattctgtccatttccatcccccactcccgcccacttactgtgtgagtccagcactgtgtgagtccttgataaaaacgatgagcaaatccccaggccttgagtgggtcagcagtgaccacatctatccgcagggatccacggggaagctggtgtgcgccggataaaggtaggtggtccctctggcacaggccgccctaaggccaaggccccccagatgcagctcattcctggctccctctgacagatggcaaccgccgatgagattgtgaaactcatgctcgaccacatgacaaacaccaccaacgcgtcccatgtgcctgtgcagcccggtgggtagcctctcgcccgcgtctcccaacccctcctacacctctggggaggagacgcccagagggtctcacctggggtgtcatgtctacccgcaggctcctcagttgtgatgatggtcaacaacctgggtggcctgtcattcctggaactgggcatcatagccgacgctaccgtccgctccctgggtgagccatgcactgggaaggggatcctacagccctttggaaagggctgagggagggtcttgtgatggcagagaacacggactgtgcgtcagataagcctgagttaaatcgtctctctgccacctaattgccggataccttgagcctctgtttgttttcttgtctgcaaattgggggtaataataatggtacctgctttataccgttgttttgaggattaagtgagattaaacatatgtaagacactcaacacagcgcccagcacctggcacgaactgagtaaatgagacctgtaattactcatcttccccgacgtaggggacacctccagggaacgtggtcatttgtggggttattgagggatgcctgccaggaggaaatcaggacatctccctcccgacctcagagccccagcttccaaggtccttgcttttctgttgttttctttccctgatgcccatttttcccttttggactgccacactctggtattgcagagggccgcggggtgaagattgcccgtgccctggtgggcaccttcatgtcagcactggagatgcctggcatttctctcaccctcctgctggtggatgagcctctcctgaaactgataggtgagacttggaacctggggtcacccaagccagggctccttgtaactggaaggagccagggagacttggagaccccgtcagggctgaccgtgacaatcagggctctggagcctgtgaagaaggctcttcctgggcttctccagccttctccagctctcactggactagaaggagttggtattaggatcctcctcagagaggcctgaccctttcccagggaccctctctccatacccctgtatacagtaggcactcagtccatgcttgtcgaggtggactcccttcctccagggctgctgagaaagccaggccaccagggtcaggatgggagggtccaagccctgctgaatccctggctggacagccgtgtctaagagagttatcttgctgcccttagatgctgaaaccactgcagcagcctggcctaacgtggctgcagtctccattactgggcggaagcggagccgggtagcccctgccgagccccaggaggcccctgattccactgctgcaggaggtaccaacccctgcctttggggaagggacaggcttcccaaaggatgcaggagtatacggtggggcgggtaggggccctggcacccacacctcccaccatagtcaagtgtggttgtgagaagggcctggtgggcctgttcttcagcatcctccctttctaggctcagcctcgaagcggatggcgctggtgctggaacgggtgtgcagcactctcctgggcctggaggaacacctgaatgccctggaccgggctgctggtgacggcgactgtggcaccacccacagccgtgcggccagaggttggtgccagggactttgccaagtgaggtcattcacaaaaccttagccccccttccacttgtttccctgaaggcagggaccttcctttttttttttttttttttaagaaggaatctcactctgtcgctaggctggagtatgcaatggtgtgatctcggctcactgcagtctccgccccccgggttcaagtgattttcctgcctcagcctcctgactagctgagataacaggcatgcgccaccacgcctggctaattgttgtgtttttagtggagacggggtctcgccatgttggccaggctggtctctaactccccacctcaagccatccgctcgccttggcctcccaaagtgctgagattacaggcatgagccaccacacccggccgacagggaccttcttaacaccacaaatgtatgaggttgttatcttagaattaaatgaaatccttcacagtgaataacttacaactcaaggcgaacttattctgttgtccttatttttctcagtttacccagaccagtgaaaagctcttaactgtccagcatcattcattcgagaaaaaggtatttggtgcctgccgtggggcaggcactgctctcagctgtggatacagtagtgaacagagcagacagaaatcactgccctcatggcttatgttctaggtggaagacagtcaaccagataaatcagtaaaacacagaggatgttagcacaaagggctaaggagaaaaaaaccaagccagggagcagagtacagagcgtcaagtggagggcttcggggcaggcctcacctccccaggcccctttcggttacgcagcccagcccctctccagactgcacactggatgtggaaagggatcttgggaagccttcattccacttccctgtcggccttttccagccttcattggtgctggctggaagtctggcagatggagggaggatctctgaattcctccccatctctctctgcctgcagcaatccaggagtggctgaaggagggcccaccccctgccagccctgcccagctgctctccaagttgtctgttctgctcctggagaagatgggaggctcatctggggcggtgggtgcctgggggctgaagggctgacagggaggtggctgggctggctggggtccaggccagcaccacatgctcagcgttgtcatcttccccagctctatggcctgttcctgactgcggctgcacagcccctgaaggccaagaccagcctcccagcctggtctgctgccatggatgccggcctggaagccatgcagaagtgagccagagccctgtgcatcagaccaggggtgggctgggggaggtgtttggtgacatctgcgccctgccaggccctagcccaaccctcagagtgattcccttggttccctatagtgagcctctttcactctctttccctgccaggtatggcaaggctgctccaggggacaggactatggtatgtactcaggctgtggcctcagacctttctccttttggccctgtaagtctaaagagcaccctcggttgcagggcccgtgctcagccccctttccttcaccttgtccagctggattctctgtgggcagcggggcaggagctccaagcctggaagagcccaggagctgatctgttacaagtcctgaccaaagcagtcaaggtgagtgaggctgggcccagccacctggggagacaggcttctagccagcagactcctgtctccatgtgaccctgagcaagttaataaccttcctggaccgcagtttccttctctgtacaatggagatgagcacctatctcagaaggtggttatgtggctaaggaaatatgtagagccccgcacactgcctgggatgtgacagggcctcagtgaatggtgacccttttccctgctggaagtagatgagaagtgactttccatttggtgacagagcagagggtgctggcagagccagggcaagggcgtgcagggccaggctgcacggcagagacgttctgcccatggcaggaaggaggcggcctggtgatctgcccttgaacctgctcccacaccccatcccccagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaagaaagacactgcctcctctgagggaccttttcccaagcatgtaaacaagggggcccacagccctggctgcaggcatcatgacccatcttctaccaggcagatctttattacctgagcccctaaggcagtgtctcctcagctgggctgcttccactgagacccccgacccatcccctttccagtacacacacctgatgcatgtaagaatggtagaggggcttttctcagcattgaattaataattcagtggctcctcgggagtcgaatgggcatttgggacaccagaaggaaaagaaatcatcatagtctaaggttcagttgtagatcaaaaaatgcagccaggccgggcacggtggctcacacctgcaatcccagcactttgggaggccaaggcaggcggatcccttacactcaggagttcaagaccagtctgggcaacatggtaaaaccctgtctctaccaaaaaatacaaaattagccaggcatagtagtgtgtgcctatagtcctaacttgggaggctgagttgggaggatggcttgggcccaggaggtcgaggctgcggtgagccataagcatgccactatactccagcctgggcaacaaagcgagaccctgtctcaaaaaaaaaaaagaaactgcagccaagccagcccctaggtctctttctagagcgatcactgatggcaccagggtgagcaggggcactgtatgcatgtggagacaaacagcacatgcctggcacacatgtagggtagggagtggttaaaggcactggctgtcgactcatacacatgatctgaaatctgattctgctttaacccggctacaggagctaaggcctattttttagccctttgggatctgtaaaatcagaatggtacccacctcatggggacatgaaaggattcaaatgaattgatgaagatgggccataaagcccagcacagtccaagtgctcactcactgagagttacggttatcacaggggttgggcccccagcccctcccaggtcatctgctctaccactagctggtaggaaagagcctcctgccctcccaacccccgtcacctacttggcccaaatttggctgcaggctccccgagtgcctgggcttctctacccagggtcctgtctgtcggctgcaccatacgtccctgaccacaaggcatccacgtgcacaggagtatgcgcccagcagctgggaaggaggctgacctcagacggtggcctgtggatcccagctctgtcatttcctggctgggtgacctcaacctagtcaccctttttgagtcttgttttctcagattatgaaataggaaaaatttccttcctcgtgagataagcacgtgccattagctattaaggacacgcacataaatgagctgcatgtgaatccacacatgccattccatgaagacatcaaagaggatcatgtggatctttggtgccttccggttggcccctccctaggtctgtgagggtcagacctgtcctgaggcttttacaaattggcccagaactcatttaaccacagcatcatttcattagagggctgttattagagactgaatgtttgtgtcccccccaaattcctgtgttgaaaggctcacccccactatggtagtgttaggacgtggggcctttgggaggtgatggggttatgagggtggagccccagagagctctcacgccctttccaccatgtgaggttatggtgagaagatggtctctgaggaagctggcccttgccacacaccacatttgccagcgccttcatcttggatgtctatagcctccagaactgtgagaaataaacacttgttgtttaagccacccaggctattatatttttgttatagcagcctgaacaaagacagctttgattcttaacatatttaatgaaactcgagcttcataaaccagtgaaatgcctacccctatggagacggggagctggtcatgggacccaggtgcctggaggacatcccagtggctttgaaggctccagccagtcaagacggtcaatattagcccttctgccaacatctggcaatgtgaggctggggtggacgttggcctgatgttgccaggagtaggatgctgatgctgccagagagtaggtgggctccaaaccccaggcttctcacttgcttactaagcacagcagtctgaagcttgggacctggcagtgcgtctttggagaaggcaaaaaagccacagcagcaacacttaggagcaagacccttcccgctctccaccctatttcctcccctgaagaagagcaacagctcaagctctagcatggcacagaacgctaggttgggccaggcaagcagccatggtggggccaggtgaagcaatgtgggtctcagcaaggaacccctctgaaggtggcagtggctcccagggctgctgcacactggacaccacaactttggcatcagctgcatggtgagctgcagagtggtcagaggggctggggccctgccaagagagcaaggccagacctgcccagcgggaggcaggaaggccctgatccagcaaggagaagtagaggaagtccacagccacctctgttactcatcgctactgggacatctggggacaggctctgttcttgggagagcaggtcaccaggatttgtagggctgcctgccggtgacagacacgtaagtcacagggaaaggccgggatccaggcctcagctgtagcagcagctggaagaggtggagccgcacggtcacaatacatgcagacacagagcagcaatacgaaacagaacagctcagagcggtcagctcctcagcagaagctgcgtgggccgccactccccctttctgcaatcaccccatgatgtctccaccccacctcacatccagatggggctggatggcagagcagatgaagcctgctctgtggcggggcagcctaactgaaatgcacacctttatgggggaagtggacggacacctcacctccctcatgtttcacaccgtggactgcacttgagtcccagctcttcaccacatccctaggagtcttaagaggaaatcagtctgatttcttcagacaggagcagcaagagcggccagagcgaggaggacctcgtgtgaatggaggacctgagaggctgacgccaaggagtgcagaagccaaagccaccaaggaaagcagacaggcagcaagcagccagagaaggcaggcccagcacccaggcaaagccaccaaggaaagcagacaggcagcaagcggccggagagggcaggcccagcacccaggcaaagccaccaaggaaagcagacaggcagcaagcggccggagagggcaggccagcacccaggcaagaagtctgggcccagcattggaagaaagtcgcctgctgaaaccagccgggagccctgggaagagcagagcttctgaggggagcacaggctgcaccaccaggagctcttgggagccccttcctgctgcttcactccccatcatgcagcaggggctggaaagagaggcagatgcccaggagttaatgacatgatgcaggagtcacaccaggcccaagctgttcagacagacccccagcctgcagggtggtccccatccaagccaccaaatccctcagggaagccccaaagtccctgagcctggtacacaccccgtctccctacatcccatcaagacctgctctgagcactcagctggtcaccaggcacccatcccactagactagcccccaggctggtaaaggagaaatcacacacccttgtcacagtcaagcccttccttggggaagaagataaggccacacttcaccccacagaaccacagtgatttgggggggaaattctgtctcccaatggacagactggggagtcccagcatttcactgggatgcgctggtttgggaccagtgctccccatcagccaccctaactccaccctcaagttacttggtttcctgctgtgccacagggtaagtcttcttgtcaaggccccagcctttcgtgggagatccttctctagacctggccctgtcccaccctggaatgtgggactggaacccatacctgtctgtcggtcaggatccccggctctgggcgcttccaagatgaagccagaaggatgtagagcaccagcagcccaaaggccaccaccagcatcccggtgctgttggcaaagaccgcctcactgggcaggctgtggtatggcctggtggtgtttttcctgaagatgacaaaacaatgtgagccctcgagagatttttccacctatttttgtctagtgggagactcgatgtcactaacagagggtgagaaaaccttcccgggtccatatgtgatctagaattttaacaccctttctttttttttttttttttttttttgaggcagagtcttgctctgtcacccgggctggagtgcagtggcacgatctcggctcactgcaagctccgcctcctgggttcacgccattctcctgcctcagcctcccaagtagctgggactgcaggtgcctgccaccacgcctggctaattttttgtatttttagtagagacagggtttcaccatgttagccaggatggtctcgatctcctgacctcatgatccacccgcctcggcctcccaaagtgctgggattacaggcgtgagccactgcgcccggctgaattttaacaccctttctaagtccctgcaaatatttgtataatgagccaggtgcagcggctcactcttgtaatcccagcactttgggaggccaaggcatgaggattgctttaccccaggagttggagactagcctgtgcaacatagtgagatcctgtctctacaaaaataaaacttagctaggtgaggtggtccatgcctgtagtcctagcttacttaggaggctacattgggaagatcgcttgagtgcaggagtttgatgctgcagtgagctatggtcacaccattgctctccaacctaggcaacagagtgagatgctatctcttggctggggggataaaaggagagagagagggtcttcctatgttgcccaggctggactccttccacctcagcctccctagtagctgggactacaggtgcatgccacggcacccagctgtaataatccttttacccatgaggaaactgaagctcaaagcaatgaaattaacttgcccaaagttgcataactagtaaatggcacagccaagatcgaaaccaaggtctgaccttaagtcctagttgcttttcactacaccccattgcctcaaaagaacggacagtagtggtcaggcatgcaaggctctagagtcagactgcctaatctgagtcccagctctgccacttactggctgtgtgcccttgggtaagttacgtaacccctctgttccctcatttttttttatttttatttctacctgaacagtcctattgcagaatctgttccctcaattgaaaatggcaatgacggccgggtgcagtggctcatgcctgtaatcccagcactctgggaggccgaggcgggcagatcatgaggtcaggagtccgagaccagcctgcccagcatggtgaaaccccgtccctactaaaaattcaaaaaattagccgggcatggtggcacacacttgtaggcccagctacttgggaggcagaggcaggagaattgcttgaacccagcaggtggaggttgcagtgagccaagattgtgccactacactccagcctgggcgacagagtgagactccatctcaaaaaaaaagaaaaaagaaaatggcaatgacaacaataccaatcaataccaatgatgtagggtggttgacaggattaaatgtaaggtgcttagtactgtttctgacacacagcaggtgctaaatcaaactgatgctcaataaatatctgctgacttaccaatttcaacctaaagaaagatcaattctgttaccttccagatcaggagtggacccaaccccaaaatctctcctcccttgggtgagtcctgtgatcacagggtgtatcttttgaagaccctattccctcctcttcaccttagagttggggaccccactgcactcacaaactgaagaaaagcttctcattaatgcccgaaatgacggatgcgatggacagagagaggatggcggctccaaaaaagacgtggataggttttaggaggctgcgcagccacatggacgcccagggcaggaggaagacagcaaagcccaggaaccactgtggacaaaagggaggacacacccgactgtgctatgtgtgaccaaagcacatcccaccccatcagtgcctcctccccatctctgctccctggctcttctttcacaactcaaaccttcccacctggcattgcccactaccgtgctagcttcctcattgtggcctattacccaagcaacaagaacagtaaatgacatgcttagctaccatcccactcccagcaaacccaaccaccttgtttgtctctggttccttccagtccttgctcataaaactcttcactcgcacaggcctgagatcagaatatggaaaccacttcaagaattcttttggttcacagaggtgggagtggggaaagtggaagccagatggctgattagagtcagcatagtgcgtgccatgacaaagttagcagagagggctctgggacgagagacgggcaatgggagggataaaaggaacagggtaagttcaggccactgacctcccacagcccttgaataaactgtcagttctacaagataacaatctgcaagtccctctccaagcagtgagcagaggaatatttggtgctcatgcaagtgaacccccaaccagagctcatggctctgggaacctcgaggaggagaacagagagaacccacctggcaggcgaagaggaagacagtggtgatgcccagccagctgtgaagggagtagaggttggcagtccttccatggttgtgaaacgtaaagacagcaaccagccccacaacagtgaggacgaaggccatcaggtgcagcgctgcatggaggagtttccagggcagtttgggccccacccacgactggggcaggcggtacaccagtgacgctgcaggagagagtagtgccagggctcagcctctcccctcgagctcacccagacatcagggaataaccctgataggatcctacacagcttcccagcaagggaacaggaaatgctagggcactggtatcaactcctcggcatcttctaccctcccatgatttgtgggataacagccatgaagggaggagagaagggccagttaaaaagggaggagtggtcaggcaaggtggctcatgcctgtaattccagcactttttgggaggccaaggtgggaggactgcttgaggccaggagtttgaggttacagtgagctatgatcatgccactgcaatctagcctgggccacagagagaaataaataaataaacagattccaattaaaaagggaggagggctgggcacggtgactcatgtcagcactttgggaggccagaagttcaagatcagcctgggcaacatagcaagatcctgtgtccacaaaaaataaaaataaaaaatattatccgggcatggtggcacatgcctgttctctcagctacttgggggactgaggtgggaggatcacttgagcctaagagttcaaggctgcagcaagctatgatcatcccactgcactctagcctgaaaaagagggaaacctgtctcctaaaaaaaaagtggaggggggaagcaggtttcttggacctctcattctattttcacaataataaattcagtcttgtttgcagtttctaggctaaaaagcatcatgacagtcattgtttcatcaaactgaattgtcacaagtgaggctggctgtcaacacaggtactaaggtcaggcaacataggtccaaatccaggctctgcctcttagctgtttggcctctcctttctttcttttttttttttttttttgagacagagtctcgttctatcatccaggctggagtgcagcggcgcaatctcagctcactgcaagctccgcctcccgggttcacgccattctcctgcctcagcctcccaagtagctgggactacaggtgcctgccaccatacccggctaattttttgtatttttagtagagacggggtttcactgtgttagcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccacgcctggcctggcctctcctgtctaactctcaatttcctcatctgtaaaagggatataacagagcccacctcacaaacttgtaagaacaaaatgggatgatatatgtgaactgcacatggtaagctgctatcatcaatggcatcgtattgccattttacaaatggggaaaatgaggctcaccagggccccaaggcacagatttgaaagcatgggacaaagattacaaagatggatcccaggttgggcacagtggctcacacctgtaatcccagcactttgggaggcagaggcgggtggatcacctgaggtcaggagttcgaggccagcctgaccaacatggtgaaaccccatctctactaaaaaatataaaaattagctgggcatgatggcgggcacctataatctcaggtacttgggaggctgaggcaggagaatggcctgaacccaggaggcggaggttgcagtgagccaagatcacgccattgcactccagcctgggcaacaagagcaaaactccatctcaaaaaaagaaaaaaaaaaaaaagatggatcccggaagagcaagcaagtccctcattcggtggcctgactaaaccatgagaggcttcaatctcctgttctctagagctggttaaaaactacagctcaggtcgggcatgatggctcaagcctgtaatcccagcacttcaggaggctgaggtgggcagatcacaaggtcaggagatcaagaccatcctggctaacacggtgaaacgctgtctctactaaaaatacaaaaaaaaattagccggtcacggtggcaggcgcctgtagtcccagctactcgggaggctgaggcaggagaatggcgcaaacctgggaggtggagcttgcagtgagccgatatcacgccactgcactccagcctgggcgacacagcaagactccgtctagagaaaaaaaaaaaaaaaaaaaacactacagctcaaaggccaaatccagctcgctacctatgtttgcaaataaagctttattggaacacgtgatccacacttgtgtgtatgtgttgtctatggctgctctcacaatacagtggcagagctgagtaactgcaacacagattctgtcttgcaaaactgaaatatttatctgaccctctatagaaagtttgccaactcctgccctagagtatttgtgaagccacccttctgagatgccccccatcttaaccccttcctcccccaaatgacagctaggcccagagacagcccaacccaccctacccccatagccccaagcccaacatttacaaaggccagccttggagagggaaagtgcagctttgtccagcctgggccctatcccgcctcccttcctgacctcttactcaccacctccatagaataccaccatgccagcaaccataagcactgggtgccagttgaacatgtagatgctgccattccaggcaaagccaccacgccagtactgcatccagtagatagtgaagaggatgcacatagagcccagggaccccagcagcaggcaggacaagtagaaccgtccagacaccattctgatcacgcactcctagaagaaggagaagtcacaaatctccactggctcagatgcacccagttctctggctaaaggaggt

SEQ ID NO: 929 - DNA, 2365 bp, Homo sapiens
tctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcaccgtgcttatacacaaggtggcaggtgctctggctgaggctggtgtggggctggaggagatcgcaaagcaggtgaacgtggtcaccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaagaaa

SEQ ID NO: 930 - protein, 575 aa, Homo sapiens
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVTKAMGTLGVSLSSCSVPGSKPTFELSADEVELGLGIHGEAGVRRIKMATADEIVKLMLDHMTNTTNASHVPVQPGSSVVMMVNNLGGLSFLELGIIADATVRSLEGRGVKIARALVGTFMSALEMPGISLTLLLVDEPLLKLIDAETTAAAWPNVAAVSITGRKRSRVAPAEPQEAPDSTAAGGSASKRMALVLERVCSTLLGLEEHLNALDRAAGDGDCGTTHSRAARAIQEWLKEGPPPASPAQLLSKLSVLLLEKMGGSSGALYGLFLTAAAQPLKAKTSLPAWSAAMDAGLEAMQKYGKAAPGDRTMLDSLWAAGQELQAWKSPGADLLQVLTKAVKSAEAAAEATKNMEAGAGRASYISSARLEQPDPGAVAAAAILRAILEVLQS

SEQ ID NO: 931 - DNA, 37266 bp, Mus musculus
  misc_feature (1)...(37266): n = A,T,C or G
atgtcttcttttttatgtgtgacccactgtgtatagttcgggttgcttgcacgagcactggtgggcagttatttactggactaagagctacttatcagtgcctacactactgaagaaaatcatttccttctcccccagcaagtctcagctgccagtagcccagcagggacaggtgggacctcataagtacttccaccgtccaagatgaagtgttgaagggcctgctcctgggtagttgatgggcacaacaaccgtgtcatgtccagaagacagaggttcacatcactcctccctcgctccccctggcccttacatttgtatgtatcctccagagattcagttctctctcttgctgggtctaatttgttatgtaaccccttagtttgaaaacatattcatttggccattgaatttttttttctgttctccttaatgatctcatgctgcttattaaccttaaacttcctgctttgcataaaggagtctactatctggagccctaggatggtcaaatctatttgtaggttgtaggttacttctttggaatctcactcattgtaactagcattttttttttttttgtgctggtgatctctgattgacagctccttggtcaatgttgactagtgggagtcctgcaggaatagagtcagatactttcctccatagactcacacagttctgtcataggatgtcaccaacataaatattttggctttcctaggttcatgtagttgctccacagtcagcccccaccctctctgctggtcgtcctgctttgtccttaatctcctttgtaaggaaagagatcttggcagccaacaaggcctcaaagaatcatggcgtctccctaggatttgtttgtatagagtcacattatgttgcccaagctgctcttcaatgctggacttaagtcatcctcttgtctcaagtagttggaatcacagatgaaccctcccatgcctggcttagggtattcattttcagtaacagaagggttcctcattgcttcaagtccagcacatcgtgaggagcagaaatgcccccgtgtctaaatgcacctaggagtcttcctgggttttgagactattttatgaagctcgggctgaccttaggctcactataagccaaagctaatcttgaagacctcctgatcttcctgccgctacctcccaagtgctgggattacaggactacttcaccgtacttggcccttagaaccacccctttgacatggaaattcagtcacatcagccatctgctcatgacttccttgtccttatatgcagactctagactcaggattcaaagcttcctgccacccccatgatctggtccctaattctcactttagcccacatctttcaatgattcccttctctctcccacccgctcgcctaggatcataggtccaggctacgaattgctgggtgagtttccagagtatcccatacttcccttatttgggtgccttccactcagtgtcagattccgctgtctgaatctcatccccctacacaccaccacctcccaagctgaacttcatgaatggagagataatgccttgatcattgacattccacaccccccatatcaagtgcaattaaatggccaaatgggtatctgctgggctcccagtgttctcttgttaattcttatgaattcttgatatgttaaagatgtggcccctttgccattggctgagcatgctcttctagattatttgccttataatttttgccatgggtgatgagggtaagggagagggcttggaaaagttttcagtgtttacataaacagattggttgattatcttccgtttctatcctggccagtgcttcaagactggccaagtcatcctccctggagatttgatgagtattttcagctgccagccctactccgctcaccttgctaatagaatgaatgaatgagtggataaatggatggatgaaggaatgaaacaaatgttaacaatgctcctagagcatttagaatgaactccacattgtctagcttggtctctgagactccaagccttgagctctcttcccagccctttctgccttttctggatgatgccctattcatccccaagctcccaggaggttgaaggatctgcctctctctggacgtgtctgctttggccactcccaagcctgctgttcccgctccctaaaatgccccacttctactttaactattgcaaatttctcaagttccactgattccaaaagccctcgttttcagtgcttgggagccagagtcaggagtgttgccctgaggtccaggccagccaggtttcatagtgagaccctgttacagaaaaacaagaaatttgggtggatgagatggcttggtgggttaagggtgcttgctgataagcctgacaaccttagttcaatccctggggccctcaggtggaagaggagagccgagttttgcaagtagttctgacacatggcctctgcatgccccttccaaactaaataatgtgagaacaaagcaaaaccagacagggctcacccaacatccatgaatccctaaattaaattctcagcacacacaaactggatttggtggcacgtgcctgctgcgaccccagcactgcaggaattcaaggtcatcctcaactacctagctagttggaggctagcctaggctccgtaagacttctttaaaaagcacacaaacctcactgatccctctttttggaaggtgagcaggggaaagatgagaaagtgatattggaagtcagacccaagtgtctccactcatttgctattggccatatcctttaggctccccggtatcttcatcccaacctccttctcctgtaaaagatgaaacctgggtcttatgcttgctaggcaggtgctatgccacaggcctaagcccctagaccccagttcccctctttaagaccttagtcaggtgtgatggtacacacctttaatcccagcattaaggaggcagaggtgtgtggatatctgtgagtttgaggccagtttaatccatagagtgagttctaggatagctagggctacatagagaaaccctgtcttgaaaaacaaaaataagccgggcagtggtggctcacacctttaatcccagcacttgggaggcagaggcaggcgaatttctgagttggaggccagcctggtctacagagtgagttccaggacagtcaagactacacagagaaaccctgtctcaaaaaacaaacaaacaaacaaacaaacaaaaacaaaaaaagaaaagaaaaacaaaaataaaataaaaataggaacagaaggtaacaaggaccatataaatgggtgtggcatcctatgttagcaggtcagagctgagccccacattccttcatatggactcttccactacagtcatattttctcatacttgtgttggtccctgaaggtctgaatggctctcaaactcatcaggtggctgagctttcccgctgggcagatttaagtgaccaaacaggtttcctctctccaaaccagcccaggggcacctagatacattttcacacacctatttggcctaaaataataatcccccccctctctctgcctgagctacagtggcttcttcagtctctaaatttaatttccaaagaagttcaccaacacccaatgccccccagacatcagcaaccccaatacaatgaggaactagataagcagttctcaatctgtgggttgagaccccacagaggtagactatcagatatcctgtatagcagatatttacattatgactcattatagtagcaaaattatagttataaagtagcaatgaaataattttatggttgggggtcaccccaccatgaggaactgtattaaagtgtcacagcattaggaacttggagaaccactgacttaaatgaaaggtaaccctactccattttaacatgggtaaactgagtctcaaacaaccatcgctgggctggagagatggctcagcggttgagagcactgattgttctcccagaggtcctgagttcaaatcccagcaaccacatggtggctcacaaccatccgcaatgagatctgatgcctgccctcttctggtgtgtctggagacagctacagtgtgctcacatacataaaataaataaatgattctttaaaaaaaaaaaaaaacaaccattgctatagttgggtctggagcttatgtgctttcaaagccagagaaaagaatcttctcttgaggtcctgagggtggggagtactcgggaggggacacagcctgaaccacagagtagtagataggagggggtgtcctgactctccaagcctctctctgagtctataaagcagctggtggcacactctcagaggccactctggccctctattgttttgtgaccatatacagatcaccatataccaaaggctatctcgactgagtcttttgaggaagagcaaagataatgtgactccaaggctgagggtaaggactccctggagcacaagaagtgtgagtttagcatccggagatctggtttatttttaagtttaagtcagcatgctgtgtccatttagacaaacacacctgcccctagcaccccaactgtcctagcaataaaatggagtctgtgggacagaaagatctatgctagcatgatcttcacattcttagaattctccaagagctgttcctcacccagccctgcctgagcccagactgtccccagggtctgacttcatcattggcctgactaagtgtttgacaccatacagctgcccccaccagccatccagcctttctgtagaatcctggccagacttcagagccccatggaacaggagctgcgggcaatcttctctgtcaggcccgggggacacagggagtggggtatccaggcccgtgtttgaacgtcccagtctcttccctttccctccctggagccagcatctccctccctggtgaaatctgagctcagggatccagggagaattctggcagcagaacattccatccagttgtccaaacactgcacagctggcggagggaggggcagccagaggagcgggtcaggagcccagaggttgtgttgttttcttggaaatgagggagaccttgctgggggagtaggtgggtttttaaaccctggctgcctggaaaggatcataggacaaggaggacaaagtagtcccctttgctcacattgtctggggcctgcttgctcaaggtcatcctgtggagcgcctgcaaaagtagattcatctacctcagagcctgcccagccaggtctgggcagctacctctcgccttgggagtctcctcctcgtgacaagactccaggctcaacctcaagcaatggggggagggcaggcagggatgagtatgaatagcaagccccaagagagacactagacaacagctctgttgccagctgtctcactcccaactgtctcccagtgccctcatcagtgaccctgaatgactcttcaagcctcagtttcctgatttgcaagagaccagggttgaccccttattgcctagcaaaggtcttcacagatcttcccttctaagcaaatgcccagaaagtagctcagtgtgtgtgtgtgtgtgtgtgtgtgtgtgtgtgtgtgtgtgtgtgtgtgtttctcagcacttgtgactcagtttccccactgagcaccccccaatgccttttactaccctccaggtctggttgcgtcagggtggtaggagatacactccctttctgcacatcctgttttctgctaatggtttccaggtgagcccttggttgccctgcagaggaaggtgggggcactagagaatttagtaggggatgatcgaggagcaaaaacaggaagggggtgggagcaggccatggaaaattcacagccaggaaaccctctgacagcatctggcttgcattaggctaagcaggcttcacagcctggagctcagcagagatactgttatccgctggcctggccggcgggctgggaggggtgtggtgctggtggggaggggctcagaaggacccaaaggctgaccagaaacaatagtgaaagtagaggaggagaaggaggttaagaggtgacatcagggcagacagaccttccgtgaaggttgctgtcttccataagggagaatagttcctattttatagatgagggccccagagaggttaagtgacttgtccaaggtcacacagccaaggaggaaatcttttcttttttgaaggcacaaaatgggatggaagttgaagttagtgtgagaattgggtgtgtggtgactcagtagttatctatcttgcatacacaagactctggcttcaatccccctcgctactacaactaccctgctcaggaaaaaagaaaatgtggggaacaatgtttggaaagaaaaggcaatttgaggtgtacctgggtggtgacagttagatgtgcttcagaggctaagaatccattttatggttggggaaactgaggcacagaatggctgaagtgatgttgaattgtcctttggtgatagtagttgatgggcttaagggactagctactgagtatctgtacaaaagcaaataaccagcttacaactaggctggacaggcctagtgtttcatcctaagactaccagagataggcagtctctccagcgatcttgttgaagctcagggcatcggcatgtgcggtagcttctctcctgttctcaggtatatcttgtccagctcatagcccacagcccaggaaggaggcccatgtcttccgcagcccgctgagcctcaggagttaataattaagggtttaagaagatagaagcctgtctgggaggccccgcccggccgctgtgctcctgctcctgagagatagcaaaggttagtgtgtgaggctctgcctggtgtggaggcaggctctgcgctcgacctcctggtggtctccaaagggacctcagcctggccccaggcatggacgcctctgaggagcccaggaagtgccctgcccgagggtcatgcccagtgttcttggccatgagctcaggcactgtccgctatgctccatcaggtgtgggtcctgtacctgagaggaactttagagaggagacctgggatgcacacaggtgagctgaggtcgtgggacactgaggggaggtgggggatgagtcttgacactctgcagggacatgggggtcagaagctggcttggaacaaggggtggttttgagttgggaagaaattcaggaagcttctcacaagtgggcactcagaaaggaaccctgattgtctggtccaacttgaggtcttgactaaggtagaaactgaaggtcagagacagcaggccactcaatcctaggccacagctagaaacagatgtaacttcagaatctgagactggttcagattcaagtcccatatgccttcagcctcatcctagtgtctgtgactaacggtagcgagctgggggaggggagggttgacaggaggcggtggtgtggaaggaaggacgatgaggcttttggtgatcagtaactataaatatatctttaatttttttcctccctactggctgggcctggcaccttgtaggtattcagtaaccttctgagggctggctgtacccagacatagcttccaccagcaccagtggctctgggttgtccctagggaaagcttctgtaaagagattccacctcccctcccctggctcctgtgacataaggcaggttctttaacttctctgaggccatccccttccagtggcccagcagggctccctgtgctgctgagaggaagcccagagcttggaagttcacagagtctagatgcacaaatgacaagatatttttggttagtaattgcacgtcaatggtcaatgctcttagggtggcaaccacacacttgtccttggaggcctcaagggctcctaggatgaggcctcttccccgggaaccttcccctttgctgacacatcctctttgtctctcactaattccattgacagaatttatctttgccctggcttttaaacactcggaaggcaaaggccctgtcctggactctttttgtgtcgtcttttcctccttcccctagatggtgaccagagcaaggaacaggaaaagagcatttgcttcaggcttaggtgaagggctcaagtcaacacagatatgttgatatctgctttggccagaccctaagctgggctggattgggtggaggaacatagcccaagggttggtccttgctcaggagaagcctggtaaatatcaccctatagtgagggaaggacgtagaagacctgggctgagagattctgtcagatgaaaaggatgctatggagagctgtctaggttctccatggagaagatgccaaccatgggcaaagacgtggattccactcaccaagtctttgttcctataagctgagataggagcatcttgtctttctttagaatactttattacgtgtgtatgttcatttgtggatttctacacactcatgcaggtgcccacagaggccaaaagagggaagaagagggcataggattcccctgtagctggagtcagagttttgaattgcctgatatgggtgctgggaaccacacgtgggtcctctgtaagtgcaatgcataccctttctggctgagccatctccagcctaactctttttctgtgttgtgttgtgttgtgttgtttggggggggggttcttttgttgttgcagggttttattttggtttgtttttttggctttttgagacagagtttttctgtgtaacagtcctagctgtcctggaactcacattgtagagcaggctggccttgaactcagagatcttgcctgtctttgcctccagaatgctgggattaaaggtgtgtgccaccacaccctggcttttctgttttgaaaagagccactattagttggtgaagatgggtcctaggcaagtcaaggttctggcagtagaggtcctttaaagcaggtctcccattctcctaccatttaccatactggaattccataagccaagcgtgtggtcgtagtcactgagggagctgaggagaaagtattagttcagcccagaagctggagaccaatctaggtggtacatgaccaacaccctcagagaagagggggctaagggaaaggagagagggaggctggggttccagcctggagaatttcttcgtttcacgtggtccttagcagttcagaaggggcggctgttgtgtagatggatgagtgaaatgtgttcttacaagcccagggagcactgtagacgctgcctgtgggagctggtctagcagtactcaaggagaggttgactatgggctctacttattggatcctgatctgaggctgaacttcattcaggtcagtggttagagccaggataaaaggagggcataggaactgagggacaggtgactaagctttttacaaatctttttttaagtacctgggacagacaggtgctagcgaagttggcagagacgtctcctgtgcttaggatggcttgaaaggcagggacgaacagagtattcagagatgcaagaggagggacctggaagtagagctggtaagattgggccaaggtagcgctctcttagcttaaactgctcaacgaatgataacttgttcagggtctgccccgcccccttcccagaagcccagtgtcaatcagggattgatgccatctaagagctccagagaccggtaacagggctagaagtctgaatgagggtacaggagctgtttgtccactttgagtgacaatctgagcgagaaacagagctgagaccacccccgagagccattgtaggttctcaaacaagggtggaccaaaagtgcaaggcagaaagtgatagggaaaggcggaggccagctctggatgcaagatgatggaaccagtcccgttcactctggcgggtcattgtccccaggcagcaagagggacagggctgggccggcaaaggggcgggaccgggcacgtggcctggggcccgcctctcagacacgtgacccgcccagggcaggggaagggctccggtggggcggagccgcaaacccagggcggccagcgggacagactggcggtggagcgattgacaggcggcagggcagctctggggcccccggcagagttggcggcgcgcgaggacgcggctacggcggagacgctgggatgtggagcgggtaggtccctgcacgccggtggctctgcgctccgtctgggccgtgctggcctcctgggatgggtgaacaggggctcactgctgttgtttgcaccccacttgggagataatctgtactctcagccctgcctgcagcagcgaggtgcattgtagcatgaggacacactgcagcccgagagctgaaaggaccttggcaggaccgatctgagttgccccagggtgagaagggtgaccccctccaactcctagctccagtggagtgcatgagagaagtggtagtgggggtggtgcatagtagtatgcatacctcaaaagtaaatctggggcacgtatttaaaggagagcacacccatgaactctggagaagcagtgcagttgagaaagctagctgtgtctctccaaggtccatccctagctagttgactagaaccttctgattcaagatgtgaggtgggtggtaccttcccacagtctggagggagataggcacagaccctgagtcctgggtgaacccctttcccacccctcatcctcacttccatctgttagggccatcggttcttgaagctgactcctgttcttggccagtctaataggaggagaccttgctccctgttcacataggttgatgttctttcttgtctaaatagacaaacgcctcctccttccaggactgcaaagactaggtcttgcggttgttcctgctaaggactgtttcaggataggcagaggataggcggaaggaggagagccctggggaggggaacaggtgagatctatttactctcacggaccccagctgattggagtcgaaatgctaggggaaccatgcagcttcgacacggccagggcactagaactgagctcctgtggggtgtgggctggcttgatcttttagagggagcagaagtcagcctgtgtttcttggagagttgctccagggaaggaggctagctaggcttgggaagtgttttgggtgggttcctggtgcctgcctctggtggaggcaattgtgcttggaggaatgcatgtgcctggggctgtgtgtttgaggagcagcctggtctgaaggaagctgtgagcctttctgctgggtggaccgagacaattgctgtatggccctcagggtaacaacacccccttctctgggttggagccagcttgagcactttgggggaggaggagggtcagaggagatgtcaggtgtcctgtctctctctgtattcccaggtctctcactgaacctggaacttgttgagccaagctggtggcgagtatatgccagtgattctcacggtgctgtgtcccctcgcagtgctgagcttgctggtgcatatgatgaccacactgggatctgaacttgggtcctcaggcttacacagagagccttcttacccactgagccgtcttcccagcccttggacatagggatccgagtctgagtgtctagaatgttctggggacttaggggccttggagcactccactccctgcagaaggtgagagggaccatgctccgggtcatgtcagctctaagaggtatatcctaggaggtatgtatcctagcccaggaaagcttggagcccggccattctggggtttctggaggttggcttcctactgtaaattgaactgagctatggtgttttgtttatggcagagtcctaaatggcgataagcagaagtgactgggccctgtaggagccaggagtagagatccttctgagggtaaaccttgaactctgaattaatggcaacacgagtctgatttttggagtaggggaagtgggtacagtgtctcatgtagcctaggttggcctcaaactccccatttagccaaggatgagtccctctctccatctcccaagtactggcatgacaggcatgtgccacaatgcctggcttaggagtgctgagaatggaatctagagctttgtgctctgcgcaaggactcgggcagcggggctgtgtaaccaaccttagcgtcattttggtttgctttattttggacacaggttcttaccatatagattaggctgacctggaattctttttttttttttttttaaagatttatttatttattatatgtaagtacactgtagctatcttcagacactccagaagagggagtcagatctcattacagatggttgtgagccaccatgtggttgctgggatttgaactctggaccttcagaagagcagtcgggtgctcttaaccactaagccatctcgccagcccctggaattctttttaaagaaatttttattagtatggtgtgtgtgtgtgtgtgtgtgtgtgtgtgtgtaagttgaggggagagagcacatgtgtcatcacacacatgttgaagtcagaggacaactttgtgcagttggtactctcctactactttttatgtgggttttagggatcaaaatgaggcccccgagcttatacagcaaacccctttcctcgcttagccatctcactggtcctcacctagaatttttaatcctcttggcttagcctcctggatgctgcactgctatgcctagctatctaacctcactttcaggggctccactgccccaaacagacagacagacagactgggcttcccctccaccatttcttacagtttcataggcctgtggtcttgggggccaagcccactctaggtgatggagtgaggatgatattttgagaattctgaacctaacacagtcctgggaacattatggttcgttggcagagtccagagactgagttctgcactggttctgtcccactgggcagccacacgacattggtgtgaccagctggtctcagtttctccacttcctggataggacaaatcatacatatctctagggagacccaaattctaatggagatcaccctgcctcccaggagttaaaggccatgcctttacccctggccagcgactagggagttccacagttgcaggtgtctgggctctgcagtcttgagcaagtcacttacctgttttgggccttcactgccccaagagcttctgccatgagacctaagtcaggggactgagggccccaggatcaggcagatgctctccccactcaaccctggcccttcaacagatggaagtatcttgccttctcttccttaccctgtacttttgtgtgtaggatctgaccagataccctcagtagagccctgcctctccaggcctgggaactggatgtatcctcggaaaaccttgggaaatgaggaggggagggtacaaagcaaaatagatggtgaggaggggatgccatggtggctcctgaaatcttccttgcacctatggaaggatcagggtgtggaagctggccaagtaggtgttcactaggtgcatgctataaatgtcaaaggtgtgtgtgtgtgtgtgtgtgagagagagagagagagagagagagagagagagagagagagagatgatatcttggactaaatgtatagggagcccctcaaaagcctgtaccagtagagcatacgattctctcttatctaggcctggttagtggagagacagaaggctgtgtcccctcctagactgagctagtttggcctggggtgggggcagtggcagtggcaggaagaatctggcctggccacctacttagtctcttgatctcttcctcctactaggccctgctgctgctcttgcaacccccaccccccatgtgccaactcccctctgtcacagtggcttaggcccatcttcttcctgccctttgtgtctctttgccttgactcattgggttctgacccaactcttgaacctactaccaaagagatgagatgtgtctctgatctcagggtccccctctgccacccacccctaagcccaggctcaattctggctgttcccaatgatgcctcccaacagctgctacggtcctgccttttccctttaaccacccacagcactctacttcccaaaagcctgagctaccccctttcgcttcctggaagaccccttcccacttcctcattcccatcccacaattctcattcacctttccctcggttttaaattagcttagttaatcaattaccgtactgcatattttaccttctcttctacccaactcccgctccactcctacccatgctcatggaccccctacagtgtgttgtctgcctgtgtgtcctccctcagctaagtcctgcccagcaggcaaggaagccctgggcatcacccttcaccactcctcccttacttgggcactgtctccaacttcctcaaaccccatgtgcatcctgcctcacttctctgaaacctccattcattcccgcttctggggggcaagtcacatgctgtttgtgctgtgcctgcagtctgggggcgggggtggtgtcagttctagtcctgtcacctccttgctttgtatactaaccctgcctcattctgggatgcccatctcactgtgtgactgtcatgacacccatggtgttggaagtggtgggtgagctggcctgaacttgaaccaggagcctggaacccctgtgcacatgctggcttgctggcatgtgggctgcttatagagaaccattacaaaacctttgctggtaccttgttgccacctgagaatcgagtcatatgtctgtcattcttacttagtctcctaaatgggtctgaatccactccctgcaccatagcactgcccttctgagagagagtgagttccaggcaagatttctgaagcttccccaggcaccagaggctcccagccagtcctttccctgctccagagctgtgctcagggccccctctgctgtttatttagtgaaccattgtggcaagagagaagggattaactgtagaaagtagaggtagagggccatgcctgcttgctgaggagcccagagcaggctggcttgccagactgggaagctcagagggtctagagagacccctatttagctctggccaggaattcctgatgagaggggttttgagcatctgagtggccgacaggccacagggttcaggattgctcctttagttatgctttgagaggtagagacaaacattcctgctgcctctacaggatgggctggtggactgcggattgcagccactgcactatgcttcctggggaagtaacccaggagagggcttcctgtacgtgggggcccttggctcctaagctagcttcaggatgggggatgttggccacgccatctgcttctgaccttgactcttaatatctctcacccctagacgattggttcccatcccatagtatgctcctcacaaaagattatattcccacagcatctgcactgaggaggtgcagggatctcaggttcctacttggtggagacccgaagaagaagggttcacgggcatattttcaggctgaagtgtgtggacggtcagagagtctggctctgttggacccagggaaccctttccttcttctctgattctttatgaatcaccagaactgccctcaaagggaagaggatctgccgactagagttgttgctaaacacacacacagttctacccttcttcccctcctgcctctgtatcccttgccaggacacaagcgcctgcctgtaggttcaacttcaggacccagagtcagggcgagcattttgggcgtctctgcccagtcagagttgatctctattcacccagcactgtagcaagtgagttcctatttggttttgataacctccctctgcctcatggtttctttatctatctatggggagaacagattgcaggagcttcaggcattcccaagacaaagcatggccatgatcttggccacagtgccctcctcccccccccctcaccccaccaggcaatctaggcagggtgttttctggcttagcaagagtccaatttgagctggactgggtaaggcttctctgctgtaactcatagctatggagctgccctgggcccagaaacccttgatcatcaagcatatgtgctgattccaatactcaccccataccaggccacttgaccagtagcgggtggcgggtgggggctgaagacctggctgcctgtctccacactacccctgaccagttatgggaactccatggaagtcccctcctctctctgggcttgcacccctatctgtagtatgggggaaagactacaattactgtgtaaagaatatatatatattatatatataatatgtggggctgggggagggagagcacgctcagtcattaagagcacttactgctctatcagaggacccaagttcccagcacccactgcttgatgctctaccaccaggggatctaatacttacttctggtccctatgagtaccgtggaaagacacatatgtgtgtacatgagtacaaataaatcttacacacacacacacacacacacacacacacacacacacacacaagacacatgagtaagccaactggggagctagcttagttgataaagtgcttgctatgcatgcatgaagacctaagtttgagcccggcacggtggcacactcttgtcatcacagtcgggggggggggggggagggacaagaaaatcccttaggctccttatccatgcaacggaagcaaatcggccaaccccagatcccagtaagagaccttgtgataatttcaaagaagcagcctcccaagcttggcctccaacctccacatccatgtgcgtagacatgggtgtaccaacgcaaacacatagacgctgacacacagagaaaacgcccagtccctgggcagagttctcatctcatacagctgccccagcactgtgaggggcctcagacctcaagaaccctgtgccagcaagaccctgcccccaaaacaaaaacaaaagcaatggtattaggaaagtctgtctgtctcacatgcactggtggaatggtgaatctctgcccttaccttatattcattcaatgaggctcagtccctgccaagcagggcccagttccaggagcctcaaggctacacgttgggcctgttccagggcaaagagaaggctgggttgggtagtggccagggtcgtgttaaaggagttggccgtgggctcactgctgtagtttctgagagctcagattctttgttgttactcagagggaaactgaggctcagaggttctttggtgaacttctcaggggcttgaggaaaagagagaggggcaatccccagcatttcctctcagttattccaagacccagtctcattggccttgtgttcttctaatgccggcttgactgagcccctcctcctcacttcccgacagttatcagtcagcccagccccccctctccccaacccgccaagccaccgctgctctgaggctgctggctcaggagccccagattttgctgagcaagcaaagccagaggtgctgtctctgcacaaacggccactggccagacttccctctctcccttctccagggtctgctttctagggggtgttgtagcttggaggtgggagttggttaaggatacaacccaccccccccccccagttattttaggggcttcagcaaggggagggtcctgaggcttccagaagagggcatgtttgtctttggtcacacagaaggccagggagagctgaattttgctcctcactcaaaaaaatccaggggtggcaggaagtgggtctattatgcctggactatttgtagactcttcctgcctgctgaggcctggtgcttcctctctggtctgcctttgtggacttctatcatattaccattcccagtaacgataccatggcattgataacgtttgaagggtttctgcccatccctttcaactcttggaagtgacaagcactgggacaatcctatctatggtgtaaggattgatacatttatattcatttgtcagctcaacaaatgtgaattgagtttgcacttggtggtggttgcctgctgcgtaccaagcactgcccagtgccctaggttggggatggtgggtgacaaaggtgcatgagtcctgcctcgtcccctaagaaagttcctgcttggtcattctgctcttgtgacagttcagttacagcttgcagtggctctattttacagacgggcagactgaggcttatgtgacaggtatgtcacctagggttggtccctgggctcagttctgcaggtcttgagtccccatcctgtgtgtgctcatgcccttgtttgttttgcagccaaccccaacaagacgagggcctccctgtgggcctctctgctatcccagtcccctggaaaaacctaggccccagcaaaagtaacagggagtcctcaggaggcctggtagaagcctccacttcctgggaggaggcccagggtgaagaacacccggcacctgctccactggatgtgtcacgcctgcgcagttcctccatggagatccgagagaagggctccgagttcctaaaggaggagctatacaaagcccagaaggtgggtgctccaggagagggttgggggctgaggaagagcagctgcactgagtgagcccagaaagctgtggaaggaagggagaggagaaatcacttgtcaaagccacatgcactgggcgtggtggtgcacacctttaatcccagcacttgggaggcagaggcaggcagatttctgagttcgaggccagcctggtctacaaagtgagttccaggacagccagggctatacagagaaaccttgtctcgaaaaaaccaacaaaacaaaacaaaacaaaacaaaacaaaacaaaacaaaacacacatgccaggcccgtgctggagtcctgagaactcaaaggaaaaggctggttcaacccagagctaagcatgctaggaacacagtccatcactgaagtctcagagtctaaaatgactttcacacatccagacttacctaggaatctgctccagctgggatgggctgtcaggctaggcttttagcctcatgcatgggctaccactaccacatgggctaccactgaatgtcagatacccagagctggtggctggggaaacagagtatggttagggcaggctaacagcttcctgcctgcacccaggagctgaagctaaaggatgaagagtgtgaacggctttgcaaagtacgtgcacagctggagcaggagcttgaggagctgacagccagcctgtttgaggtacgctgggcagcctgggaacgggtggcccatgtgtccgggctctggtgaccgctcatgcagagatgctgctcttctaggaagctcacaagatggttcgggaagccaacatgaagcaggcgacatcggaaaagcagttgaaggaggcttggggcaaggtgagacccatccctgtgtgcctaggccagcccatggctcctggcatagcccgtgctagggggtactaccctcacctagcaagggcatgcaacagactctgctaccaaacctaccagacatcaaaaacaggagaacccaagtctgggacaggtagggtgggtctgaaatttaagtagcccatgcaccagactccatcagtactctcgttgcaccacggagacttttctagggtcctctggatccaggaggacccagtggttattatagcgtctcctgcctccaaagcagaaatgtcagccgtggcagtagaacacaggcagggagtttcctctcttagaacatctgccaaccagtaaatgtgaagctggggctgcttttcatggcttctggggacccatgaatacttagtgggaaccctaggaagttcccagatgccgccttcagcagagtctcacaatgtgacctgaggcaggtcatgtctcctgtcagccttgggtgccctatctctagaatagataatcttagaggttgttccaagggtaaggagacaggttaggtactgctggggatgcttggctgccaggctgtggtagccatggtgacattaaccccatgttggggttgatggtcatcttgtctgggacagatcgacatgctacaggcagaggtgacagccttgaagacattggtcatcacatccacaccagcctctcccaaccgtgagctccacccacagctgctgagccccaccaaagctggaccccgaaagggccactcacgtcaaaagagcaccagcagctccctctgccctgttgtgtgccccactgcagggcatatccctacccctgacaaagaaggcaaggaggtgaggcacaggctgcaatagtgggctcacaatcgggagggttgatcatgtaaaccagccaagtcagcgtcctgaaaaagctatcctgacccctcctgtggaacctctttctctcctcgctgggcttcagggttccctggaaccacgaaggctgggtaggctgataccaagcaggaggtgataatctttgaacttgaggctgttaggacctgaaggtcctctctcaggacatctcttcagaggtgcattttctgtgttgagtgataggtgcactggggctacctggtgttttgtgactacagtctttttttgtttttgtttttgtttttttaagatttatttatttatttttatgtgtgaatacactgttgctgacttcagaaacaccagaagagggcatcagatcccgttacagatggttgtgagccaccatgtggttgctgagaattgaactcaggacctctggaagagcagtcagtgctcttagccgctgagccatttcactagcccgtgattacagtcttaaggtctaagaccacactgtgacacgtgctgaagcagctacggccttagacaaatgtctctctcctgcctcaacaggaaatgcagggtgagaggcttggtccaggctggactgacatgaccataggccattgggtagaatttccatcacttcacacgccacataccatgcctcccttagggtgaggataaaaagccagcctttttagtatcagagggttaccggggagacatgggtgagatttagcttcctggactcttgctcaagcccaccctagctcagaactttcttcatccgtcccctgagcttctaggaaggaagtgcaagtcctttcagtccccttctgagcaccgcgcttcccaccggacactgacatctcctccttcctcctgtctgtctctgtttgtctgtttgtctatccatctgtccacccatcccctggcccagcctgggctgccccctctactctccctgctcctgtgcgtgatccccagcaaggccatccacctcacctacgagccgacctggcagctcctatctagggagccgcccacgacccccaactccgatacctctctctccttttcccgacaggtaatggctcctttaggggccaccctctctctccccctctgggcttcactcactgtgcatgcagcccagggcaggccattgttgccccttccagtgggcagcagggaaacctgtgaaatgttctctcctgtgtgcatgtacctatatgtgtatcctggacatagagggaaacctgcgggttcctatggggacccacaggttctcacaggcttgctcttgatgtttcttccaaaaggagtcagtagcagcattcaggccaaggccttggatccaagtctgtaaaattgccgtgccaagaaacttaatgtgcacccagacacaaactgtgttgttcttaattctttggtgcaaagggcagacaggacctcttctttgcctggactctgctccctgcatggctgctgagggcaggcctgatggtccactgaggcctcctgcatctccctgctcttctctccatcagctctgctttctctggtgtgctcactctcatccctgactgcccccacttggctcccctctcctctaggtggatacgacgctgtttgcagagttccaagcttggagagcttcacctaccctggataagagctgccccttcctagaaagggtgtaccgggaggacgtgggcccttgccttgacttcacagtgcaggaggtgaggtgggctgacagtggttagctggggatccagcccagtagttccctgtcacccagcatctcaatgctcttccctgatttgtcacagctctcagctctggttcggactgctgtggaggacaacacactcaccattgagcctgtggcttcacagacactgcccgctgtgaaggtgcccactgttgagtgtaacaacaccaagtaagcttagtgtgctgggtcccttcctgcccacatgggaaagtccagcatggagccttgggtagcaccctgggggggactgggatatgagcctgagtcttgggcctcctagatggatatagagcctcagggtgggcagggactataacattcagggtgactgactgtctcccgggattcatgacctaacctagggactcccaagagatgggcatgggtctgggggatatagttcagtaaagtccttgactagcatgcacaaaaccatgaatctgtccccagcaccatgtaaaaccaagtatggtggcatacacctgtgatccaggacttgggaggtcgaggcagggaggtcagaagttgaaggtcattcttggttacatagcaaattcaagaaaagcctggcctacataaaaccctgcttaaaaaaataaacataataaaccacaagggaggagcagtcaccactgtctccatgtaggaccaggaattatctttgacaaagattcctgctgccagctggggtgtttttttctagctgtagccagtcatccttgctccctctctctcctcttctgtcccagagagatactgggctctgattggcaaatatgtgattgctagtggctggctctatcccctgccaataaataacagccctggggtcttagcctgcatactgctcagccagccctgagcagaggtagcagcagaactaagaagttaaggtggcattccagagcttgttcagtggggctggttccacaaaggaagcctggccacaccgagggaacatttgagtcagctttttacgcagagggaaaagaatgagtgaagaccagggaactagagtttgcactacttcagagtcagggcatagccatggagcagagatctggggctgagtctgagagggttgcttgatgtcagagtatgaagagcctctgcaaggcagggcaccaacttactagggtggtatattagggggtaccagctaattcgtccttaaaagagagttctctgttccattcagccttacagtcaaggaggagacgacaaacactattaattgttccttcccttgggattctgtaactacttcctgggtgatctggaagccacggggaaagatgatgggtttgatgtggcctttggagaagcgcctggctataatgtagagaagaaaggagtgagggaaaagagagagtggttggaaagagctgaggaaatccaagcgaaagggctgagtagtctggggacatggtgaccaagttcaggtgtaggggtgggagccaggagagttcatcacggaggcggggcctgtggaggagcaaggtttgggagcaggaatctggaagatgggctcttggtgctaagtgggtttcctcggcttgactgcggggagaggtgatgacatgggaaagggattcttgtgaggcttggtgagcaatacagggctagatgaaagtctggtgtggggatgtgagaggcagccagaccagaattcagttagagaaagaggtgattgggcataaagaccccagtaatgaggtgtgggggggttcgaggcagtggagggtggggctctcgtatacctggcataaggttgaccaagctcctctgcctatgtggggaaaggaacggggtctgagcatggctccagctgcatttaaggtttatcctgaagacttttgcccttccccacctctttatttgaccctaggctcctttggaagatgggagcggggaggccaggccttcctgcctgcctgtctgctgtgctgtgctcactctccatgcatgctctaactagggcacattccctgcatctgtgaccctcattgagcaccttacacttcctctgttctccacagcacatgtgccctgagtggcctggcacgtacctgccaccatcgaatccgcctgggggactctgacagccactattacatctcaccgtcctcccgggccagggtgagtcagccatccttcacctttgtgctgggcaaagctgtgtagtggaagagactggggctgaggagggtctaatggtttggtatgtgatccttgcttagagacactgaggtgtcgacagagaacacagcccaggggagaaactctaccactctgtctgctgccagctactgactatgttgtgccagccttctcccccaccccaccccccagccttgcttctccttcccagcaccaggtttggccacacctggctagtgttcctctcctttcccacactaccctgcttgggcagccttcccccagttccagctctctgtatcctctctggcttcctggtgagttccactagcaataggaccacccctcttctttcactcaccagtctctgggtgcctcacatgtagggctttcctacctgagaaccctgggtaggggctcctgtgggtctggctgcctgctgccttccatcctcactggttctttagatgtagagcctgcatggacatttctggaacttcctggtggagggagggaagcaggatgagggcagggaaaggggggcaagccaaaattggccttagcttcagctagatccagaaagagtcccaagcacagagctaccttcatcctagccaaagagctggcttgcattccctccacaaaatgggcccatgggctcaatgtagcctaaaccctcagaatctgggagaggggggccaggcctggggatggccgctgggcaggataacaagagcggagtttttgtggctatgccagtgaagggtcactagagcttggcaacaggcctctctagccattcttggtcctcaagtatggaccaaggcagctcagggaagtgactgtaattgctttccctggaattacacacggcacctagtttatgtctggcaggcccagaccttcttgctccaaaggagcaggtccacagagggcagagcttggctgttagtgcaggctgcctgattccatctgccagcttggccactttctcacgccacgcttgacagtctttatcacaggtaaaatgggcacggtgagtgtctgtgtctcactgactgcactgccaacaggcagctgtggcaggtattcttaggaacagtgggagtcttgctgttgctaattaaacctgggaagccgaactctcctaaagtcagagagtattccttagctctgccaggtacctgggacttattgttatggctttcagaggggtcccctagagtatggggaatcctggtgggtcacaccctctccattctgcccacagatcaccgcagtatgcaacttcttcacctatattcgctacatccagcaaggtctggttcggcaggatggtgagtgccccctagtggtcttttcaagcaatagtgcccaagggagagacagggcagaatggggctggcagaattggccttccaagtctacttgaaagcagcagcagaggcaggaatctagggttggttcctccagtagaagaccaaaaaaggggaacactgtaggttaacaaagttaacctgatcctccttggtgctgggttctgtgtcactggagagtgaaccttccacatcactggccatgctgccttttcttctgcatagaaatctctctatggcaacaaagacagcattcctgttactagctttgacattcaaagttctttatgatgggtctctcctgtgactcttgcctacttcttcatgcccccagaaatggctctcctgcctcctgagtccttgcttaaagggcccttctccagacacagggactggcgtcctgggccctgctcactgctctggggtcagggtgggaaaacatttgcaactggagaagtgtagttaagcctattatgaaaacaattgtgtgcagtgcatgaatgtctgaccaggctgaggggtctccacatcactgccctgcccaaaactggagaggcggccagggcagttgtgtgaagggaccatgaactcttctctctgtctgcagctgagccgatgttctgggagatcatgaggcttcggaagggcatgtcactagccaagcttggcttcttcccccaggaggcctagggcatggccccaggcctgaagtaagctctgagctagagcaaacagctgccttgggacagacagacaagaaatcctggagccagctctgagccagaagctgaaaggacagataaacaaccaggctgtagagacagttctgagcccgtaccacccatccgtcctgagacagacaaaaggacagcctggcctggacttcatcagatgaccctcttgcccactgagctctgtagccaacaagagaatctcaagaaagcaccaaagaccaaggtgctcggagcaaggagctcagccctggggagaggacccttgagtagccagtaccctcacacaatcccctgctgcttaccaatgctctcttgctgccacatcttcagaaaggggctgctctagggtggctggatttccagccctgggacaccagcacccccttgtggccatttctcactctgtttccaagtggcctcattagactgccccagtggtagggcaaatgtctccaatctgaacaaggtggagagataactgccccgaagtgctctgaaggtgagtccaagatccctcctccattcttctgcatggaggcctccctctccccttcctctccacttcaacaccatctccaggaggccctgttcctgaagttgccaggaagtctgggccctttcttcctaaagtgtgccaccaggggagcctcaggacgtaaccctgggcagccatccagacttcaggggccctggatgtaggacgggatggagaggctgggccaagcaggacatggaccctgccttatccatcatagcccactgggaactgggctcggggggaatccaacctggacatatccttcaccacgcccctatttccttccaatggaatgtaacgcgatctctatttaataaaggaaggctttgttggtaggggctaggcggcagtggccttcactcctgtgccctggggctctggccagggcttgggcatctgaaggaatgaaatcaaatcctttcctaactggcctcgtgcttgggattaaacccaaatcctgaagctacccccatggctaccaccactttcttgctgtagggaagactgttgaagttgtccttagcttttcacggagctatgagggattggaatgagttgaccactctcctgagagttcagctctgatctgtgaatccccccaaagcccgtagagatgaccccaagtctactagaagcctggagtcaaaacacccaggcttcctggggctgatcgatgccacctgtcataggacagatggggacgacagaagtgccaggcatggcaggcacaagtggaggtgcggggcaaccgggatcctgagagacctcagagtaggaatgaggagagagatgtcttgtggttcttgcctctgcccagccagtagggctttgtgctttctgttaggaaggtgcagcagattctgggctggggcagaggttgtcagtagcccacagagatttctctattggcctgaggcccaggtgtactcagatggtaggtcagctggggggctggccagagctttgtcaaggtcctctgccgccttcacatgttctccggcaagtagcttgttcccaggactctgctgcctccattacccctctgttcttatatctcctccctgctccactatgactagaatcctttgctgtgtccccagcccccatagacacctggtcactgaccagaccctgtcgtctccactcattcactaactaatactggggttttctctgctggacattggccacagcatgcataccagtaatatatctgcatccaggttactggatggagggaagtaaaagccaaaggatgtcagggaaggacgtggtgtgctgtgtggaatcccatggcatcccctgctatgtcaaacccttgttcacctggagacaagagtggatgaaagcctgagcactttaatcagtcttaacttctgggttctgggcccagccatatgcaggaccacaaagccaccaggaaacacccagaggcccacagaggaccttactcccctgacttgtcctgcttctacagagcattgtccatgatctgatgccaggtggggccatcaacacagccacaccctgctagtagcaattaatatctaagcactagtcatagctcgcagccctctctgtgaacccattattccagtctcttagcaatgttaaaacatgctattatccctcatgtaaatggatagaggcactggagaacacaaagaggtcctgaggttgggtttatttacctcagtggtagaggcttgcctagcaagtacaaggccctagctggttcagtctcctgctccaggaaaaaaaaagtcacaaaggggtcctaagtgtctggaacctgtagtattaacctacctcttggtggttttttgttggttggttggttggttggttggtttttgtgtttttatactgaacactttcagtgaatgtaggtttttcacctctttaattgatgcagaagggtgtgagtgtagatcagtgctagagtgcttaattcaaggtctgaggtttggtcccagaaccacacacacaaaacaaaagaaacagagactgggatcgaattgtaacctaggttcctctgctgtaccctggaagtagctcagggcttcgactcttgggggtgacttgagaggttaactgccacaccagatgttcttaaattttctagataacccatttgggtttgaagtcttggcacatagaaatcatctgagctctccttggctagtcctgagtctggcttctaggcatggaggtattaaacctgactaagcacatttacctggtgcaggaccctgagatgtctcactttaccatcttggtgcagcacctgagatatctcacttcaccatctgccaaacctgccctgatttgaatcctgccagggctgtgaccttggagcaagttgcttttctcagttatgaattgggattattattcttcccacacagacacaaacaatcttccctcattcactcattcatacaatgcatgcatttggtgtttgtgagctgtgcatgtgtgaatgcacatgtgccatggttcacaaggcagaagacaactcttatattgtcttggtcctcatcttcccccttgtttgaggaagtctctctcattgacccttgaagcataggtcaggctagcttctgggaactgtgccatctctgcctcccaccttcccactaggagcatagggattacaggcatggactaccggatcaagctttataagatttctgcagttctggactcaggtcatcagactttcacaggaggtgctttacccacgaagcaatctctgccatacttattttttaaaaaaataaaaacctaacatgtaatcttacacattttaaagtgtagaattatacttgtgctaggcacattcatactgccatgaaaccaagctacaaacattttgcatcttgcaaaacaaacactatgcccattgactaattccctatttctcctgcccctagactgtggacatcagcattccaccttctgcctccgtgaatctgattcctctagagatttgctgtaaatggaagcagcatactcatcttctagtgactggcttgtttcacttaatgcaatgtcaatatccatccatgttgtaagatgacaggatttccttttaagacttggtaatattctgatgtatgtgtaacagcccactgtgtttatccattaattggagacacacacgggttactggtacctgttaatgtatatgcaaatatctcttggagaccctgcatagagtcctttgaataaattaccgttagtaaatttgctcatatattagggattttttttgttcttgtttttgtatttttagaggaccctccgtactttttccatgatggctataccattttatagttctaccaacaatactccagggttccaacttttctgcctcctggccaaaattgttttactggttttggtagtaactattctaagagacatgaggtatttgctccctggactttgatctgtgtcctgagtagtgctttacagtcttctcaccttcactgcacatttctgtgtgtcctgctcttaccaagggtctgtgttccaccatagttgccgataggcttgtcgttgctggcctaaatagtttcaaatagcctttacataatcctgtggtgcccatggcctctgcccctcctttctcagaagagttgtaccccggactaataaccaagctcatgataaggtctgtgactcaagccaaaccctagagctctgacttgtgccccccccccttttttttttgtgcttttgctgcctgagctccaggactgctctttcttggtggcttcagagctttttcctaaagccactgcttgcatatccagcttgttgagcctccctggcactgtacaaacatatcttggctccaggacagtagctggtggctctgtagggggtggtgatttcaaggcatccaaccagaggcctgggtggaagcttacaacagtaaagaatccagctgggacagaggtaaggggctgtattcaaggcattccaggggactctcaaacctcaagctcgccccctgccccaaagcacttcatttggctggcttccctctgcctcctacactcgcacaccctggcagtgatccaatggcagctcaggaatgtcgagtgatgcctctccctttccaagtggtctgagaggcctcagctgcccagctttggggatttggggatggacaaatggagactcaannnnnnnnnnnnnnnnnnnnnnntcagagatgggggggggggggagagagagagagacatctagagatgaccctaagacctacagagaactaaaggggaagctctttgtgtgggaagtggagagaagttactcatagtttatgctttatggaaacacacatctagatacaggtggaaagtctaccacctgtagactccatgctggactgaaatggccagagaaggcagcatagttagggcctatccttggtttatctcccaagtctgcccagcctccactttggtgtccacccctaactgcctcccatacctgaggccaagatcccagggaaggagcccttgaatggctcttgagccagccacatcttactgagcgagaggtgtgagaatgaatcaaggccacaccctatgagcatccaagtttggatacaataggtgtattccctgggaagcataggctttctctatcccagtcctcactgtgaccatgtgggggcagcagtacctgccatcctctttggccagggctcctgtatccccaggtgtgaagaagaaaacatgttccaggattttgaagagccttcatagaaagggattgaacagctcctgtttgtggcaatatcttgggctcgttggtcctggctaagcaaagcaagagttcctcaaactagagagaaccaagaggctcctttcttcaagctctggtctgcctgtgatacacgtcatggattttccttctctctgagttctgcagcctaagatggaacaggagtagattggacatgttcagaaaagaattctggaagtttcccaaatgtaagactggactgtgacaccctcctcactctccatggaggcagtgtgtacgtaggctgcccctgatgtcacctctcctcatctcacaggtcccaggtatctaaccaacattctttagagtattgctcgcctctgctttcctccttgtcctgtgtatttaggcctgtaatagttgcatctggagtgaatgctttcagccttttttagtcttattgttccctaaacaatgcagtgaacaattatttatagagcatttacatcacattagacattattaagaattcagagctgacttaaagtgtatgaggggatatgtgaaggttacatgcatatactggttttttgtaggcaagaaacacaggttggttttgttatccacaggggtgccttagaggtcaggtcacctacaaatccttaggtagaccaagaggaaatgtttgcacattggaaaaaatacactttaaggttctgaaaagatttgctcccaacaaacaggtctgcctcacctttctgccctgagtcacactagggtggtgtgcgggagtctgttttaactagccctcaaggaaattctgatggaccttcaagtttgccagttgtgaaagcttttaacttttaaggaactgatgtctgtctcaaagaaacatcgtacaattgggaacgtagttacactctcaagaggatttgaatttaataagtcaaaaatgtgacaccatgaatggggagaactgggaggtggtgacaagcaagccacccattgcagactggaccattctttcatctcctgaacggcagacctccacgcagcagtgtcctctgctcctcctccagtggccaacctgggcatccccaatcctgcgtacagccaggaggagaggccatctgctcctgcagattgctttagatggcttcctcgcgtggatattgagggtttactgggggatgaggtccattgtttggtgggctgttgacagtcaccccaaggtagtgtcctcatttctagctacctgggatgcctggttaaagaccggtgacgtccctaactacatttctcagcctttcagggctcagacttgggctcatttcgggcccctgcgggtgtgcctgggcgcagcggcctgcaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcgcggagagccgggcaggcgcacgctcttacggcggccgcagcggcagggcggggccggtggggcgggcggaggaagacccctgattgccacctcgcctccctcagtgtctctcttagaccttggtcacgtaccggggtccggaggacttgtgtacagcggcaatgggcggtgtcggggagcccggagggggacccgggccgcgggaggggcccgcaccgctgggggcgcccctacccatcttccgctgggagcagatccgccagcatgacctaccaggcgacaagtggctggtcatcgagcgccgtgtctacgacatcagccgctgggcacagcggcacccagggggtagccgcctcatcggccaccacggtgcggaggacgccacggtaagctaacccacagccggcggggtggagcctggcactagcggtggagagggagacgttgttcataggcttggcgtctcattccacctgcggaccttagcatcctttttgctctttctgacctttgaccccttccctggctccagagttgagatggagcctgagggaaggaggtctctttctttcacggaggatgggctgtttgggtcagtcagtggaataaatagatctcagggaagaatgggcccccagaggtgggtgtgccgtgaggggcagattctgccccaggtaagtaccctcactgttgtactgagggtttcttttctgctctgagtgtcacagactattatctggtgcttccaagagcctggggcagggctgggtccctagcgatagggacgtgccatcagaaactgggggctgggcagcagagcttgggcagggcctggaggtctgtggcttatccagcacttgtgtagactgttctgagggccagtgactcacctctgctgggctggcagctacacgtgggaagactttgccaggctgggtgggcctccacgggaagcacagtcaccccagtcaccgactagcccctggggactctggcttcccattctcagtccgtgtctagacaagaagggatggaactggcctgaaggactatctggctagagcccagtggtgaagcaatttcccagacccttcctccttcagtcccactccatggacaaaggttgaggccatggtgctctgccctcgactatccaaaattgtaggttagtcacattgggtacccggaaggtctttaagactggagggaatgattctctagtggaagaacttggtggcagcagaggaggttctctgtgtcccaggactgtcattgtccctctcctcccggattcactccaggcaactgagagggataagaatgagacaattcctgaaaatcatcaacctgtgggccagtgtgtgtgtgtgtgtgtgtgtgtgtgtgtgtgtgagccttccttctttctaccagagcatgatgggcatgaggtgccacagcccctcccactgagccctggcagtcctgtgaggatcgtgttgtagcgtaggacagaatgctgggcaggagaggaggacaacagagagcactgactgctttttcttgctcagggccagccaggaggcccctcctacatgggatttctaactttatatttagctcagtgccctgagacctccatctaatggttttgctccagccaccattttgattcacagccagtaaggtctgtaaagaaaacatcactctacatcttgtagtagggttctagctctgccattgaaggcactcagaggtaattcctctgaaccttagctttgtcattggacgggtggggagagctaggctatatagcaagccagccaagggcaagaccacaccttctccaccatgctgctgtgttgtagatgtttgttcagtagctgctctttagactatatgtatgcagactggagagtgcagtgggacagtcatagcactcccaagccttttctgggagagcttgtctctgaccctgccagtaataggaaaagattgctataggccccagacgttggggtagagttgctaaaaatacctggtgtactcaggtctcagggccgggaggggtctaggttcagaaggccctagcctttgtcagtgatggacccacaaggaatactaggagttgaaccaatccagtgccccatgtggtcaagtctagatgccaggtatcccatcccagaatctgaagctcaggttaggggtgagatgtggctgcccacttgcatcagcccagccacccatcagctgttctcatgtccaggcaacagaagctttcctgccaggaaattcccagagttcttgtgccatgaagtcagcttgtggccatcctgggatacagagcctgtgccctagggagagtactctgggccctgggccaggtttgtctaagagtcacaggcaaccctgagatgagaagaggcagccagagaggtctagcccttgctggtcataaatatgtgagagtcacataccaaccacctactatgtgctagattctaaatcaatgcttgctattgatactgtttcttaatcctcaggataccaaccagcgaggcagtttactactgttatcccactttacagatgagaaaagagattcaaagaaacagtgaaacttgaaacagtggcaggtgtgggatttgaatgcacagccacactctgccccacgttggttcctcagtaatgggactccctgaacccacccatgaatatctcctgtgtgctcctcaccccctgcctctgcagatgcagctgtgaacaaaacattttcagggaaggagtgtgcaacagatgcatcagctagagccaaggctcggaggtgggaccatgccacccatacctaaggaacagagcatggctgtgctagagagcagccacagggaggggaagtcagaaagcagacatgccaagctcaccagatatttttgtttttaggactttggtttattctaaagaaggaggagatcccgggagggcagagcagggaaaccaaaggggtctgatgtatgtttaaaaggatctcaaaagggcgggttggaacttagttggtagactgcttgcctagtgttcatgatgccctaggttccatctctaatgctgcataaatgtggttgtggtggcatccacttgtaacccctgcaattatgaggtagacacagaggatggcgagctcaaggttgagcccagcctgggacacataggactttgtcttcaaataaaaggatcgttggggctagagaaatggctcagaggttgggaggttaggtgctgctcttacagagtatctgagttccgttcccagcacctatggaactggtgggtgggtcacaaccccttgtaactcagggcttcaggaaagccaccatctctgacctctgtgtgcactgtcatttatgcggacgtattccccccaacacacacatattcacatgcaaataaaatcaccttttagaagtgcaaaggctttaaggtaaggtaaacaagttaaggtaagcaagatggggacctgccctctccttggggagaaagttcagaacaagtaacagtgtaacttggctctagttacgcttgaatgtagtcagggtgtaaggtctgagatatgtgaatactaatagggacactagtaggggacattagaattagctccgtaagctgaggatatggctaagtagtagagtagctggctcaaggccctgggttcaagttttaacaaaggagcaaaacaacccattgagcccggcattatggcgcagtacctgggaagtggaagcaggatcatgcagagttgcatagcgtcctcagttacacatggatttgaagccatcctggactatgtgagatcccttatcaaaagctcaaaatgctgcggttatctctgtgttaccaagggaaggagctaacttgtcttacacacacacacacacacacacacacacacacacacacacacacacc

SEQ ID NO: 932 - DNA, 2179 bp, Mus musculus
ggcaggggaagggctccggtggggcggagccgcaaacccagggcggccagcgggacagactggcggtggagcgattgacaggcggcagggcagctctggggcccccggcagagttggcggcgcgcgaggacgcggctacggcggagacgctgggatgtggagcggtcccctggaaaaacctaggccccagcaaaagtaacagggagtcctcaggaggcctggtagaagcctccacttcctgggaggaggcccagggtgaagaacacccggcacctgctccactggatgtgtcacgcctgcgcagttcctccatggagatccgagagaagggctccgagttcctaaaggaggagctatacaaagcccagaaggagctgaagctaaaggatgaagagtgtgaacggctttgcaaagtacgtgcacagctggagcaggagcttgaggagctgacagccagcctgtttgaggaagctcacaagatggttcgggaagccaacatgaagcaggcgacatcggaaaagcagttgaaggaggcttggggcaagatcgacatgctacaggcagaggtgacagccttgaagacattggtcatcacatccacaccagcctctcccaaccgtgagctccacccacagctgctgagccccaccaaagctggaccccgaaagggccactcacgtcaaaagagcaccagcagctccctctgccctgttgtgtgccccactgcagggcatatccctacccctgacaaagaaggcaaggaggtggatacgacgctgtttgcagagttccaagcttggagagcttcacctaccctggataagagctgccccttcctagaaagggtgtaccgggaggacgtgggcccttgccttgacttcacagtgcaggagctctcagctctggttcggactgctgtggaggacaacacactcaccattgagcctgtggcttcacagacactgcccgctgtgaaggtgcccactgttgagtgtaacaacaccaacacatgtgccctgagtggcctggcacgtacctgccaccatcgaatccgcctgggggactctgacagccactattacatctcaccgtcctcccgggccaggatcaccgcagtatgcaacttcttcacctatattcgctacatccagcaaggtctggttcggcaggatgctgagccgatgttctgggagatcatgaggcttcggaagggcatgtcactagccaagcttggcttcttcccccaggaggcctagggcatggccccaggcctgaagtaagctctgagctagagcaaacagctgccttgggacagacagacaagaaatcctggagccagctctgagccagaagctgaaaggacagataaacaaccaggctgtagagacagttctgagcccgtaccacccatccgtcctgagacagacaaaaggacagcctggcctggacttcatcagatgaccctcttgcccactgagctctgtagccaacaagagaatctcaagaaagcaccaaagaccaaggtgctcggagcaaggagctcagccctggggagaggacccttgagtagccagtaccctcacacaatcccctgctgcttaccaatgctctcttgctgccacatcttcagaaaggggctgctctagggtggctggatttccagccctgggacaccagcacccccttgtggccatttctcactctgtttccaagtggcctcattagactgccccagtggtagggcaaatgtctccaatctgaacaaggtggagagataactgccccgaagtgctctgaaggtgagtccaagatccctcctccattcttctgcatggaggcctccctctccccttcctctccacttcaacaccatctccaggaggccctgttcctgaagttgccaggaagtctgggccctttcttcctaaagtgtgccaccaggggagcctcaggacgtaaccctgggcagccatccagacttcaggggccctggatgtaggacgggatggagaggctgggccaagcaggacatggaccctgccttatccatcatagcccactgggaactgggctcggggggaatccaacctggacatatccttcaccacgcccctatttccttccaatggaatgtaacgcgatctctatttaataaaggaaggctttgttggtaggggct

SEQ ID NO: 933 - protein, 417 aa, Mus musculus
QGKGSGGAEPQTQGGQRDRLAVERLTGGRAALGPPAELAAREDAATAETLGCGAVPWKNLGPSKSNRESSGGLVEASTSWEEAQGEEHPAPAPLDVSRLRSSSMEIREKGSEFLKEELYKAQKELKLKDEECERLCKVRAQLEQELEELTASLFEEAHKMVREANMKQATSEKQLKEAWGKIDMLQAEVTALKTLVITSTPASPNRELHPQLLSPTKAGPRKGHSRQKSTSSSLCPVVCPTAGHIPTPDKEGKEVDTTLFAEFQAWRASPTLDKSCPFLERVYREDVGPCLDFTVQELSALVRTAVEDNTLTIEPVASQTLPAVKVPTVECNNTNTCALSGLARTCHHRIRLGDSDSHYYISPSSRARITAVCNFFTYIRYIQQGLVRQDAEPMFWEIMRLRKGMSLAKLGFFPQEA

SEQ ID NO: 934 - DNA, 42954 bp, Homo sapiens
tattcttgatttcatagaccttataagtctatgcttggctgggagtggtggctcatgcctgtaatcccagcacttcaggaggctgaggcaggtgtatcactctaacccaggagtttgagaccagcctgggcaacgtggcaaaaccctgcctctactaaaaccacaaagattagccgggcatggtggtggcattcgcctgtagtcccagctacttaggaggccgaggcaggggaatcacttgaacctgggaggcaaaggttgcagcgagccgagactgcaccactgcacaccagcctgggcaacaacggagtgagaccttgtcaaaaaaaaaaaaaaaaaaaaaaaaaagccgggcgcggtggctcatgcccatagtcccagcactttgggaggccgaggcagacagatcacttaaggtcaggagatcgagaccatcttggccaacgtggtgaaaccccgtctctactaaaatacaaaaaattagctgggtgtgttggtgcacacctgtagtcccagctactcaggaggctgaggcaggggaatcgcttgaacccaggaggcagagtttgcagtgagctaagatcacaccactgcactccagcctggcgacagagcaagactctgtcacaaaaaaaaaaaaaatctgcttggttctccttgataatctcttgttgtttattcatgttcagatcatacatttttttttaaatttttttaaagctttttgagaccaagtctcactctgtcacccaggctggagtgtagtggtgcgatctcggcgctcactgcacctctgccttctgggttgaatcgattcttgtgtctcagcctcccaagtagctgggacaataggcgcatgccaccacacccagctaatttttgtgtttgtagcagagacagggtttcaccattttgcccaggctggtctcaaactcctgggctcaagcgatccacctgcctcagcctcccaaagtgctgggaagccaccatgcctgcccatatgtatatattaacaataacttatcatatatgtcaaaatagctacaagagatgatttgtaatgttctcaacacaaagaaatgataaatgtttgaggtgatgaatatcccagttacccagatttgatcattatacattgtatgcttgtgtcaaaaggtcacatataccccacaaatatgtacaactataatgtagccataattaaaaataatttttttttgttttttgtaaattttgtgtgtgttctttttctttaaaaacagattctaaaaattcatgtgttaacctttctatatcatatataggagaccactacctggagttctgtagcatctaaatctgttgtgtgttgtttctgttgattcttacttatagtggctagcatctttatgtgctggtgatctctgattgtgagctcactgcttgatattgagcaataggaatccttcatatctaaatttggacacattcctccaaagaggatttgaatctgcttctgcctggagccaggggtgtcaccaacatgaaacacttcagccctctttgagggtcctagctccatgtattttgagggttctcacttcatgtagttggagggtcctagctccatgtatttggagggtcttagctccatgtattttgagggtcctcgcttcatgtagttggagggtcctagctccatgtagttggagggtcctagctccatgtatttggagggtcttagctccatgtattttgagggtcctagcttcatgtattttgagggtcctagctctgtgtattctgagggtcctagttccgtgtattttgagggtcctagctctgtgtattttgagggtcctagctccatatattttgagggtcctagcttcatgtattttgagggtcctagctccatgtatttggagggtcctagcaccatgtagatgcccacattcatgtccccaacctccctcctggccaaagctcccagctttggctgcactttcctttgtgggtaaggaagtggctttggcagacaaggcctagagcttgatagacaacacatcctcaaagaattatagcctctttttctagaatttttttttttttttctgtagcaggaaggctcctctctgcttcaagtccaccacatcactaaggagcagaaattctccaagccattccacacttatccatagtagccatctttttgatatgtgaatccgttcacatcacactcctgcgtaaatccttcaatgactcctcttagtctttaagtataaagtttgaactccttacctagcatactgtattagttcattctcacactgctataagaactactcaacgctgggtaatttataaagaaaagaggtttaataggctcactgttctgcaggctgtacaggaggcatggctggggaggcctcaggaaacttacgatcatggctgaaggtgaaggggaagcaggcacatcttacatggccagagcaagtggaagagagcaaagggggaggtgctacagactcttaaacaaccagatcttgtgagaactgactcactagcacaagaacagcaggggggaaatatattaccatgacccagtcaactcccaccaggcccctccttcaacactggaaattacaattcaacatgagatttgggcagggatgcagagccaaaccataccacatacaaagccccacaagatctagcccctgactctcttgccagccccaactctttcaatggtctccctttccactcccaaactcctgcctcaggaaatttttccagactcctaaccttaagtctaggttgggagttcctggatgtgctcccagacgactttgcacttcccctatccttgtacctgacctgtggtcctgtgtgttagtctgttttgcattgctatagggaatacctgagtctgggcaatttgtatagaagagttttctctggctcgctgttctgccaactgtacgggaagcatggcaccagcatctccttctgataagggcctcagaaagcttccaatcatggcagaaggttaaggggggggcatgcatgtcaagtggtgagagagagaaaaagagagagatggagggaggtcccagactctttttaagaatcagatctggctgggtgcgttggctcatgcctatagtcctagcactttgggaggccaaggtgggtggatcatctgaggtcaggagtttgagagcagcctcgccaacatgctgaaaccccgtctctactaaaaatacaaaaattagcggggcatagtgcctgtagtcccagctactcaggaggctgaggcaggagaatcgcttgaacctgggagttgaaggttgcagtgaaccaagattgtggcattgcatgggcctggcaccaggcaagaaagagtgatgaaataaaagttttctgtatctcggccaggtgtggctcacatctacaattccagcactttgggaggccgaggcgggcagatcacagggtcaggagtttgagaccagcccggccaacatggtgaaacccccatctctactaaaaatacaaaatttagccaggcatggtggcgtgcacctttaatcccagctactctggaggctgaggcaggagaatcacttgaacccaggaggcagaggttgcagtgagctgagatggcggcactacactccagcctgggcgacagagtgagactccatctcaaaaaaagaatcagatcctgcagcaactcattaccacagggagggcaccaagccattcatgagggaaccaagctcccatgacccaaacacctcccacaaggcccacctccaacattggggatcatatttcaatgtgaaatttggagggacaaatacccaaaccatatcatgctgtaattagatgtctgaatcccccgctacacataatcccctcctaaactgtatacttcatgagtgcagaaacattgtctgtctggttcactaatatgccatcagcacttggcatgtgtgttcttaaaaatctgatgaatgagtgaacacctctattgagctcccagtgttttttcttattgattttcgcaaattctttatgtgttaactatattaacgcattgccattgcctgggaatattttcgccaagttatttgccttttaattttggcttttttttttttttttttttttttttggcaggaaggagcataaagcagctttacatttgaatgcggacagatctattgatctttttctgttaagatctcttcaaaatgtttccaagtttagaaagtctttcccttgctagatgtgtaataagtgttcacttctattttttatgcacacagctgtccatttaatcttcccaaagcagggctctgatcatttctctcctctgctcaaaaatgtttaaccatctccttggagcctttagaataaagtccaaattctttaactcgcctccaaggcttttcaggatttaacctgaggctgcctttccagactttttttttcctgtcccccaaatgagcctgagctcctggcaaagtgaagggtttgcctctctctgtctgtgttctgcccttcccacctccaggccttttacctgttggtccctctgcagggaatgtccatccttcatttctatatggatttttttttttttgagacacagtcttgctctgttgcctaggctagagtgcagtggtgtgatgttggctcactgcagcctccacctcccgggttcaagcaattttcctgcctcagcctcccaagtagctgggattacatgtgtgtgccaccatgcctggctaattcgtgtatttttagtagagacagggtttttaccatgttggccaggctggtcttgaactcctgacgtcaagtgatccacccacctcagcctcccaaagtgctgggaattacaggtgtgaaccactgcacccggctctatatggatatttaaatcctattgattcttcaatccctactttgtttaaaaagcctcactttacccttcctcctgagagagtgactggtggagagataagaaaacaagctttggagtcagacaaacctgggttaaaatctgagttcctttacttgttagccattggccaaatcctttaacctttccaaatctgtttcctcatctttaaaatgggaacagaaagcaatgaaggaccaccaaggactgtcgggccgctgcaaggatgaacagaatctgagattgcgcgtaaagatcctagcacagtctccagttcaccccacattctgccaccttggaagggagtcatcagctctctgggggtcacaccctcctccactagtcatgttttccccccgaaggtttctgatggattctctgttctctaataattccacaaggtggctgagctttccttctgaggagttgagagcgggtgaacaggtttcatctctaggaattcagctcaggccccaggcaccttggtcagactcccacacccatctgggcccaaaggaatcccctccttccttcctcccttcttcgtctgaggtcagtttcattaccgggaactgttgatatttccaaaggggttcaccagcacttcccggccctcaccatcagcaccccacaatatgatgataagtcaagtggagcaaagataatcctcccaggtttaaggtgggtaaactgaggctcaaactagcttccatatatttgtgtctagaacttatgggtcttcgcagccagagaagggattcgtttcttgggggcgctgaggggcctgggcagctgtggtggagaactgggggagctctggccccagagcaggagatgggccaggaatcctgtctctcagggcctctgccttgtcctcgagtaggttaattcgaatctctcagaggctggcctggagcttagtgtctgtgcttgctttgtgaactgactttctgagtagattcttttgcctgcatcttttggggaagaagcaaagatgacgacttactggcaggggctgtatctctggggctgagagtgaggatgggaacttcctggacagtgaaaagagcaagtttagcttccggaggcctggctgctagccccgctctgtacccagcatgctgtaccacctgggacaagtgcctgccctctctggaccccaactgccctccctaaaaaatggagatggtggtcgaaggaggtctgttgtgaatcttagtgttctcaaagtgctgtcctgggctgagcccctccctgagcccagactgtccccggggcctggcttcaccaggttggcctgagcaaagctgtgaccccattcggccgcctccacacgctctgtcctgcccttccctgaggggcctgggcctggtcttggtcaggcctggggacagagcagggagcctccaggcccaagtttgacctcctgagtcgcttcccctctccctggagccagaaccagcgtcctctttccctcctgcttgaaatctgagctcagagatccagggaggactttggctgcaaaacattccatccgcgctgtccaaacaccctgcacagctggcggagggaggggcagccagaactggctttcaggaaccctggggctgttgttttcatggaaatgggggagccctcactctgaggaccagcactggctgacctgaggaagttcacagggtcaagtggaccaaggaagggcccacctgcacacatgtttttggggcttacccagggcccctctgctgagcgcccagccctgcaggggaaaaatccagttgcttcaaagtctgcccagccaggtgtgcgtggctgccttgagcctgccagctgggaggtgtctgcaccacaggcaggcggatggtggccttgtgagcctcccctcgtgactgagctctatgcagaggcaggggaagggcaggcaggaatgacgctgagatagcaagaaggggaggcgacttcaggcagcggcttttactgacaagacgtcccagacctggctgcttcttgctgtgactcacaagtgaccctggatgagtctctgagcctcagtttcctcatctgcaagaagagacaatcgggccttttctggctctgccttttttctaagaagttacaaccaaagacaagatcctcaaagcttcccatccagtccaagctgtgtctaaatgtccagaaacataacaggtttttccataaagtctccagcaactctgactcagtttcccctctcccgcccccggccaagaggctggtggggtcttggcagggagggaccaactcccacatatgatgccaccagccaggccaagccctttcccctcttgccatgttggggtgatggggagacccccacccttcacatatcctgttttccattaattgtttccaggtaagcccagaggttgcccagcagaggaaggtgggggcacaggagaattgagcagggggatcagagaggagcaaaaacaggaagcgggtgggagcaggccatggaaaattcattgccaggaaagggaggacagcatctggtttgcattaggctgagagagcttcgcagcccaaagcccaagtgggagatactgttatccgctgggcggggtggggcagggtggggtgtgaggaactggcagcttctccccagcagggactcagaggctaaccagaaagaagagggaagtacaggcaggaggacggggcaggaaaactgaaggaaggaaacacttctttcagtctacactgtggcagacacttcacaaatgttatcttcttcttcttttttttttttccaagacggagtttggctcttgttgcccaggctggagtgcaatggtgggatctcagctcaccgcaacctctgcctcctgggttcaagcgattctcctgcctcagcctcccaagtagctgggattacaggcatgcgccaccacccccggctaattttgtatttttagtagagatggggtttctccatgttggtcaggctggtctcaaactcccaacctcagagatgatccactcgcctcggcctcctaaagtgctgggattacaggcgtgagccaacgcccccagctgtcttctttttttaaactttttttttttttgagacggagtctcgctttgccacccaggctggaatgcagtggcgtgatctcggctcactgcaagctctgcctcccagattcacgccattctcctgcctcagcctcccgagtagctgggactacaggcgcccgccaccacgcctggctaattttttgtatttttagtagagacggatttttttttaaataatagagatgaggtctcggtttgttgcctagggtggtctcctgggctcaagcgatcctcccacctcggcctcccaaagtgctgggattacaggcatgagccaccgcacctggccacaaatgttatctgctttaatactcactatttcacaggggagaacttcccattttatatagatgaggaaactgagtcccagagaggttaagtgacttgcctaaggccacacagtcagcgagtggcagaactaggatgagaatttgggccaaatgaagacagggtggcacattcacaccatcccacaggtggatggagtctgtgtaccaggcaaggtgacactgagaagggtgacgaggatggcccagcctctgcccagagggccactcagttcttgtgggagtgtccaacagttccagggggtgtttgtcatgacgcagggctaaccatgtgtctgagggctctggtgcctgcagaggaaaaaagtaacccacaggggagggcttcctagaggagggggtatgaacaaaagagaaacttactagcagaggcaggatgcagtggagatagcagtcaggggggatagtatgtggaaagaagaggaatgggcacatctgggcaatggcaactggcctggtgtgctttggagggtgagaatccatttcatagttggagaaactgaggcacggagaggctaacgtgctcaaaggcacaccgtctgaaagtggggttgaatccagcccgtctgaccccgggcctgtgttcccagctgctaccgctgagttgttcctgggcggtggtggtgagaagttttaagggtagtgagaccccatctctccaaaaaataaaaaaaatttaaaaattagccaagcatggtgacacatgcctggagtcccagctgctcaggaggctgaggtgggaggatggcttgagctgggcagtttgaggctgccctccagcctgggtgacggagcgagaccctgccttgaaaaattaaaaacaaacaaaaaacaaaactgggaatctcaaatctaagaaaaagaatttaaaaataaagaaaaaaaataaaaaataacagttttttgtttgtttgttttgttttttgagacggagttttgctcttgttgcccaggctggagtgcaatggcccagtctcagctcaccgcaacctccgcctcccgggttcaagcaattctcctgcctcaggctcccgagtagctgagattacaggcatgcgccaccatgcccggctaattttgtatttttagtagagacagggtttcaccatgttggtcaggctggtcttgaactgctgacttcaggtgatccgcccgcctcagcctcccaaagtgctgggattacaggcgtgagcctccgcgccccaccaataacaaagttttaaggggatattcaggtttgtggtcacaggcaggagggcctgtctagggctacacagccagctatgacagctatgacaggatcaaggctggacgggctctttccaacaccccagcctgcgtggtgaggggacaagcggaccatctgggagcctggctgaaacacggggcctcccctagatagaggtgtctcacctcccctggcccagagcccaggaaggagggcccagtgtcttctgctgcctgaggagccacaggagttaataattacggggttgaaggagatagcggctgtcctgggaggtggtgcctccctcccaggctgctgctctggggagatagcaaaggttagtgtgaggctcagcctggtggggggaagaaggctcctgctacctcccttcccggcaccctccagagggaccctcagtctggccttgcaagcatggactcttctgaggagcacgctgggtgccccgcccgagggacatgtcccgtgttcctggccatgagtgcagggactgtccgctacgccccatcaggcctgtgccctgtacttgaggggaacttgagagaagagccctggggcacagacaggtgagctcaggacctggggcatggaggggagggggagtcttggcaagcttcagggcagccagtgtgagaagctgggctcagagagtcctaggcaatggctctgattgtcttgtccaatttggtggctgtacagaggtggagactgaagctcagagagggcaagacactcatcctgggtcacacagtgagctgaggacacacctgtaagtccagaatcagggcctgggttgtccaggctgactgtctcctgctcctcagctgccttcagccaagggtctgtggtcaaggctgccaggcttgggatggagcaggcagagggagatagagggagggaggctgaggagggcagtggcttgtaggcagaggacacaacttttatttatcccttccctgccactggccagacacctagcatgtgctcaggaacctcttgctgcctggctgcacacagctgcagctgccagtgagcctctagtttccgggtggtctttttggaaaacgggtgtaagaggactcagccccactgcccctggctggtgtgatatcaggcaggttccttaacttctccgagcccatccttttcaactgaggagcaagttcagctgagcaggagggtcctccctactgggggaggcagtgagccctaggagtccatggtagcaggaagcatggatgacaggctatttttggttagaaattgagtgtggatgcttccagagtggtgaccacagacttgtccttcaagacctcgctcaagggcctccccggtccaccagacctcccaggctgaggactcttcctccagggacatagccctgagctgacgcctcctccaccctttatctcccactggtctgggttgccatgacttatctcctgccggggcttgtgaagacttggagggcaagggccctgtgctgggttccttttgtgtcattttctcctccttctctaaatagtgaacaaaataagggccaggaagacaacagttgctcaagaccaactgatgagggattcaagccagcaaacacatgtggacatctgctttgggtgggccagaccctgagctgggctgggggtggggtaggggaacatagctccaagaaagagagaatccctgccctctggaagccgtggccatggaaacaactgccctgctgagtgatggctatgggatgcctgggctgaatgattctagaaagttggaagggatgctatggagaactgcctaggttgttcactgcacaaagtgctggccaagggagcaagcaaggcatagaatccagcctcgcctccactctccagattccataccttgctgtgcgctgtgcccagcggggaaagagcattgtctatttgtgccctggacgtggaggtcttagagaatacgtcccccatcctccatcctccaccaacgtggagccccaggagggcagaacctatgtctgtacagtttcctgctgggtccccagccccttgcatgccccatagtctatgctcagatggagtggctgaatgtatgagtgagtagaatgaatgaataaaatgtgtcctcaaacgaagatctgactaacttgagcctgcggcctgagtcagtgggcctggaggggtagcactgggacctctggtagcacctagaaggggaagtacctcccaccacgctcccagtcctcccctagacagggaaggtgggagccatggtacctggcgggagagaagacgggttctgctcttactggtccagtcccaggctgaagttgagacgaatgatcaggactcagaatgggtgggacagaggaactgagggacaggtagaccagtcgtctgggattcagggaaggtttcacggaggatgtgggaccagacaggtgtgtgtatgtgtgtgtgtcggtgggggtggggtggggaatactatccagagggcagatggtgagtaaaggcagggatgggcagagcgtgttaagtggcaggaggctgagtgaggagagttggaccagaagtggaaactccttcgggataaaactcagagagtaggactcagaaaacttgtttcgggtttgtcccctccccttcccagcaggcaggatgttgcacagggacaggcactaagcagacagcctagggaaggagggccgggtgaggaggggggagggtgtctgctggccttaagtgacaatctgtgtgagaatcgaagagctgagagctcgggagccattgtaggttcttgagcaggggtggcccaaagtgggtggtgcggagggcgactggagaggaggagtcagctggggagtctgagcgcggcgcggcccgcgggatgttgggggccgggttccctccgagcgccgtggtctccctgtcccggcgcggcgggccgggtggggccaggccttgggagcgcgcgccggatcccagcgccgggccggcggaggggcggggccgggcacgtgtcctcgggccgctcccccctccgccacgtgacccgcccagggcagggtcggggctgggctgggggccgcgagcccaggcgtctgagacctactgactggccgcgggcagggctgacaggcggtggggcggctcggcccctggcggagtcggcggcgggcggggacgcggcgctgggaggacgcggcggcgctgggaacggacgcctgggcgccccgaggcgccgggatgtggagcgggtaggtccgcgcgcgctcgcggtcccgcgctgggtctgggccgcggtcgcctcccgggacgggaggatttcgggggtccccgccgggtctgcgccgccacccggaggtgctgtgcgcccccgccctgcctgcaggcgagccgacttgcagccaggagactccgggggaggggtcgggggtgtctctcggggtgcagggtgcgaagggtgggcagccgaccgtcccggggtgacagcgtcaactcctcttagctcatcaggagcgcaagtgagaagagtcggggtgtggggaagagtgtgcacgactctggggcatgcacctagaggaaggacccccagcccaccctcccaacctgtccctcaaccccttcgctggatgaactcttggaaagcagtgtagctgggaaagaggggctgggtctttgccagggtggctcccaagttgagggcagaacctccttgtggggctctggaagtacggaggctctcagaggtgtggagtgggaaccccccccgccccggccccgcagcctggagtggggtagcagagactctgggtcctggattagtggccccagtggctgtgtctgttcaggccactggttctcaggggcagttgcagttcctggcccatctgatgtgggacccctgccctgtatgtgcagaaaggttgtggtgtttttgtggagttgggcaaacacttcctcttccccgtggccgggaaagaccaggtcgtggaggaaatgtggccagaatgggggacaggttgtactcctgtgccccctgggccagatgagtggtcccaggagagggctactgcccagctacagctggggagtgagggaagcccccctggaaaggcaggcaggatccacttcactccatggcacctagcaaaggttgagctgcgatgctaggggagggatggcctttcatccccagcagggggtgtggagagagtgggctcctgttaggggtgaggtgtggagaggcttgggactttttttttttttgagacggagtcttgctctgtcacccaggctggagtgcagtggcgagatctcagctcactgcaacctccgctgcctgagtacaagcaattcgcctgtctcagcctcctgagtagctgcgactacaggcacacaccaccacacccggctaatttttgtatttttagtagagacggggtttcacaatattgatcaggctggtctcgaactcctgacctcaggtgatccaccagcctcagcctcccaaagtgctaggattacaggcttttaccaccacgccctgccctaagacttgagactcttttttttttttttttgagacagagtgtcactctgtcgcccaggctggagtgcagtggcgcggctcagtgcaagctccacctcccaggttcacaccagtctcctgccttagcttcccgagtagctgggactacaggcgcccgccaccacgcccagctaatttttttgtgtttttagtagagacagggtttcaccatgttagcaaggatggtctcgatctcctgaccttgtgatccgcccgcctcagcctcccaaagtgctgggattacaggtgtgagccactgcacccggcctgggcttgagactcttaaagggagagagttgaaggccactagtgtatttgttggcattgtgcttggaggaaggaggctggcttaggagaaagtgcttgaggtgggtttgtggtacctggagaggttagggcagtcctgcccggggtgaattgtgtttggggagcagcctcgtctgccggaagcctgtgtcttgtgccggctgggtggactcaggcaacacagcccctgagttagttgctgtgtgaccttgagagtgtggacttccttctctgggcctctaggtaaaataaatggtttctggggtgggagtgatcgcaggtcagagaatgtccttccctggaggcacccaggccaaggccagacacagctgagagccaccagtagatggatggttgcttcaaggagagtcagagagccttatatcctgggcagggacccctccccaccatccagcccccctgccatattcccagcaacactctggatgagccagctgccaggctgacccccacagaatcctcagtatggctcacttcctgcatgcacccctgcacccccaggggcctagctgggtgctgagctcatatcataatgggtgcttcataaatgcagatggaaaggatgaggggcagtgagaagctggcggaaggggtgaggcagagcttgggggttaccttgagctctgtatttttatggccccccatttgggtgaggaaacagggatttagagtcaggggccaagctgctagcccccactgggtgcctggtgtcctaggagctcacccagaccccagcagcagttgggaggtgtcctgttcagagtcatacttgccaggttactctgaccaagtctgatgacagctctggcaggtgtatatttgggactgttgatcctagaacaggaggagctgggattaggagttggtgaccccagcggggccagtgatgtttctgggcttcgtttcctcacctgtgaaatgaactgagatctttctcttggtggctgtgctttgttaatggccaggtcctggtcatggctccagccctgggctactcttctggggtgggcggcagtggctggactctgccacagcctgggtgggtcctcttctttgggactcctgagcatgggccctgaactccaaacccagaggcagctccagtctgactttaggtgcccctccaaactgggttgtcccccttccgattccccacagtttcacacattcatagttttgggtgccaagcctgctccaaggtgacgaggtgaggacagcgtcttgagtacttctgtatctaacatggtgctggacacttgggacttggtcagcagaagccagcgttcaagtttctgcatgacactgttccagccccctggtctcagtttccccagagacggggctcatcatacctatggctagagagggccaggcattgatggatggcccaggaatgagatgagaccactccaacctcccaggggttggggagcatgtttttgcggcaggcagggctgtaggggccatcaactggctgtgtgatcctgagcaagtcacttcactgccctgggccttggctattctaagggcatggatctgtgggctcctgcctgtaaggcccaagtcacaggggactagaggccgtgagacaagagtctgaagtatggcccgagggctccaggtcaggcacacaggcctcttcattgggaaggggttgtataaccctcactgttgctgctccctggaagccctccgtgatctaactgcctactctacccctcaacaggtggagatctttcctgctgttccttaatcaggacatgggtgttgggggcagacatcctcattagaatcctgcttgtcctagaccctccgagctctgcacatgatttatgcccaataggtctttggaaatgaggtagcgggagggagatgcaaatcaaaataggatatggtaagaagggggctgcctggtcgtgcagattggatggatcatggctggtggggtgcctggcacataatgggtgctcagtatacacactagctattggaggtcttcggtgtcaattcttggactgaatgggcagggtcgccacaggcgcatttgaggatgtactgcgtgcccagccctgtagaagagtagtgagatgcgccccctcctaggccctgtgctggctcccatggagagacagggctggattcccccgccaggggtgggctggactggcctggtggcctggggctatggccggcggaggcgtggcctgactcacctgctttaggtgttctgatctgcttcccatccccagctgttcctgaccttctcccccactcctcctccatggtctctactaggacgtgctgttgtgcccttctccctactctggctccccttcccctgtggcccaggcccaccttggttcccacctgtccctttgtcccctccttgacttgagctcattggttcctggcccaattcagtgagactcatgacgatctctttcatccccgggtcccagacactcttcggctctggtgtccaacactctcgtcctttctggctctcaagcccttgtcctccctgacagcccctcatccaggctcaggctgcagctgctccccgaaaccagtgccactcgacagcgtcaccccatcctgcctattccccctcagctgcctacgggacgtgccacttcccagatgcctcagccacccactttcctgtccctgaaagaccccctcccagttcctcactcccagcatgggtaccgctgttctcagctttcaccttttccttagttttgaattatcttaattattgttattgctttttcctgcccccccatccagcccctgttcctcccacaattcccccttcccatctttgtttctgtgtgtcccctctgctgtcccctcttagcccaggtcctgcctggctgtacagcattcttgggtggcacctccagtacttgggcgctgtctcagacttcctcaaaccccatctgcctcttgcctcacttctccaaaaccgccattcatcccctttcctctgggtgacaggccacgtgatacgctatgcctgtactctgcattcagttcccatcctgccacttccttgctgtgcattctggccaggtcaccatccctctctgaacctcaggggcctcatctggaaaccaggtggaggagcgcatctccctgcaattgtcccgagcttccaggccatgacacctgtggagtggtgggctggcgtggatgtggcctagcgcttgggaacctgacatgcttgtgggtttggggctgaagacttggccgctctctaggggagccaagctttgctgggcttgcaggctggcctgagagctggcccaccaaccctttcctgggactcccttggtccctggatgttaatcacatggctgtgagcctccgtcccctcagtgtcaccgcaaaggctgagcgtgaatctgaacaggcccctgtgccaaggcaccgccccggggagccaggccctgggtcggggtttctgcagcctccctagaggcctgggccctggcagcccgctgagtggtcccagtgtgccctcccagccgtctccttcgtccagtttcagaaccacccttgctgtcccctcccctgcttattgaatgaatccattgtgcccatgaccaacaggggtctttagttccaggaggtaactggacagggtcatcttgggcactggttgaggaataggctggtctggccactggccaggccctgctggcttggggacactgagagaccgagggccacggagtctaggtctccttcttattttgtgggtcggggcaagagccctgctggccctcctagggtgggcctggtggggtgaggattgtggttactgcattttcttttggttgtgtgtttcctggggaagtgacccgtggggcctttcctgtatgaactgcctgggcctctcggcagtgggagctggctttgggatgggggatgttggctgggtgccccatctacctctgaccttgactcctaccctctgaacaggctcctttccagaggcatctgtggctcatctcagatgctgggctctgtttctgcagggaacggggactgaggaggtttgtacagagagcggtggacccggactgaggagggtagggacgctgggcagcagaacattaagtggtccctgcttgccccacgactgagttcaccactgacttgggtgttcacagccaggttttcaggcctctggtctgggaggctaaagtgtgtgtgagattggagattctggcttgggctggacccgaggagcccagggtcccttctttgaaatttctgagtctcaggagttggccttgcagcctggaaatgaggaggaagagggtctgcagattctggctaccctccaagggcaggtcaggcccttcttccctcctgctcctgccacctttggcgttggggagttggtggctactgggtggtcccactgttcccatgttcccacacttcttgccattgggatttggccttgggctcttctactgggggtgatgggaaggatgtcacagactctgtcacaggcctcctggaccactgtttcctctggctacaaaattgggccctgtccccactctgccccacaaggcaaaaatgagagcctgttgggaaaatggtgaggtcagccagccacacctccagcctatgtgcttgggaccagcaggagagagagttagtctttcactgtggccagaggcccagaccacactggtggatgaagctcggcccccatgggagggccggcagcctggttctcctcggtcagggcataggcaattgcaagagtcctctgtcctgtcctgtgctgtcacctcttgcccttggcctgcagtgagcagcccccagcccagcctgagtgactatggccatcctgtcctacctgaggacttgggccatgatgattaaggtggggacacatatccatcactccatcaacagtgtctgtgccagacagggctctcaatacccttgttcggggaagtcttcttggcaagggtccacaggcctccagtttaagctgtgggacccagagcccaggcaggcttcgtgagtgtctcagccaaacatggctgtggattgaacatgattcacccagcaccaggtcaggactgctcttagagctcttgattcttagagcacctcctgcaggatttcagctcctatccctcaggtgcagaagcaggttcagaaaatttcagtagcattctcaggggctcatgtgtaccccaggtcagaggctgacatggaccccaggcttgccccatctggcctgttctctctgccacagctccccctgcccaggccctgccttctggaaagggggtttctgggcctgcgcagagtctgagaagccagttcgggccagaattgggtcagatttccctactgcagccaaagaggagcctccgagtctccctgggcccagcagcgctttatcttgaagcagatgcgccgattccaacactcacactccgcacccacctgcccttcccctgcagcggggaagctttgggcctgggcttgaagacctggccacctgtcccagcactgtcactgaccagctgcgtgacccctgacaagtcccttcactctgtgagcctccgtcccctcatctgtagaatgggacaataccacgagtgctgttgagagagttttatgtttgtttgtttgttttgagacagagtttcgctctgtcacccaggctggagtgcagtggcacaatcttggcccggctaatttttgtatttttagcagagatggggtttcaccatgttgaccaggctggtctcgaactcttgacctcaggtgatccacctgcctcagcctcccaaagtgctgggattacaggcgtgagccactgcacccagctgctgttgagagaattttaaaggagacagcgtggtcagagacctgtggaagagtctggcagagtgagtccccagggcacagaccccagcccagggctccgccatagctctcaggctgcggggaacccttgccaacaagacttccccaaacaggagtattaggagagagccctgtctggcatagacactgttgatggagtgatggatatgtgtccccaccttaatcctcaagacccacatccctgccaggcaggacccagcttgaggagccttgaggccacactctgggccggttccagagcagagggcaggtggggctgggcagctggaccgggctgtgtgaagggactcattgctggaagtgggctccttgcaggagtctctgggggcccattttctgtgtgttaaccaagggagaaactgaggctcaggggctgcttggtgaccttcccaaggtcctgaggacagggaggggagactggtccacagacttgcctctcactcctccctctgcctcagccgtcctgagtcccactttctccttggccttgccttccccctctggtgcagcctccctgagcccctccccccaacttccctcactgatatcagtggcccgcccagccccccatccccagccctggttgctgcggctcagaagctgctggctcaggagcctccagcttttgctgagtgagcgagtccagaggtgctgtcttggcacaaaacaccgctggccgggccctcgccctcccttccctctccagggtccactttggagtggagagtgtgggtgggggcggaatgaggcctcacaccacctccagggtcttcagcttcagggaagggagggtcctgaggcccagagaagggggtgtttgcctgaggtcacaaggcaggccaggggagagctgggactgctccccaccaagtccagggggacaggaagtgggtctgtcttgtccaagctgtttgcagaatcttcctgcctcagccctgcctgccctggcctcatccttcctctctggtccaccctgaaaggggcagaattcgcattaactgtatcagtgaaggcagctcctgcttgagtgcatccgaggtgtcaaggttttacccacacctcctctgatcattcagtgacctttgaggtagggccattggaataggcttcacttaatacaagtgggactcaaccctgatgcatttacagtcacctgttagacaaagacgctgaccacctactgtgtgctgagcacctactgcatgtgccaaacacagccctcagccctgggctggaaggggtggttgacaaagagtaataagcctcttgccccaagagactttgtgcttggacatttgcccttgtaacaacactgatgatagctggtagggtcccagttttcagatggaaaggctgaggctcaagtggcaggcacattgccccggggcggtttctggactcagctctccaggcctcaggaccccaccctgaacctgctgatacccttgtttgtctccagcccaccccagccagaccagggcctcccgccgccccttgcagctgtcccggtcccctggaagagcacggacccctgccaaggccacagggagtccccaggagccctggtggagacctctgcaggggaggaggcccaaggccaggagggccccgcagccgcccagctggacgtgttgcgcctgcgcagctcttccatggagatccgagagaagggctccgagttcctgaaggaggagctgcacagagcgcagaaggtgggtgcctgcagtaggctggggggtcttcggtggggagaagtcaggttgggagagctgtgggctctcatcaggtgcccagagatgtgcccaagggagagggatgtgccctcaccgaggccagctgctggccaggcctgtactgggcgcaccgatggtcacccgtcttgactgcaaacgtgccctgagctctgatgaactggcaggcagggcttcagcttcatgctgtggctaaacggaaaaagcatcacaaactgtcaggcaccagaggaaataaactctgagccccacataaaatgacgaggggatggaacctggtccggtgggcctggtccctcccgtgccaggcctggggatgctgaggtgctcaagtgcctgcctcttttcctccaggagctgaagctaaaggacgaggaatgtgagcggctgtccaaggtgcgggagcagctagaacaggagctggaagagctgacggccagcctgtttgaggtacaccggctgggcgcgggaacaacttggggaatgggtcatctgggcgtccgttggctcctcaccactcacgcagggactgccttcttcctaggaagctcacaagatggttcgagaagccaacatgaagcaggcggcatcagaaaagcagctgaaggaggctcggggcaaggtgaggcccatccccgcctgcccaggccagcccaggcaccccccctgcctcccggctcagcgagcactgagctttgctgcccgagtggacgctcacctggcccggtggggccagcaggaatgggtgaacctaggcccagggagggaagggaagggtgggggtctgagatcacagggcccagtgtcccggggctccatcagtgattctgctgcatggcagagccttttctgggatagtgctggggctgggaggaccctgtgattattgtaccttcttccctctcctcccagccccactttacaaagcagaaacctcactcagtatggctgtctgagcctgggcaagtcgcttcctctctccaagcctggttgcccatctgcaaaatgtgaggcctgggcctttcctggctcctgggggcggtcccagaactctcatgggaggcccagccagctcccagacacttgttcctaacagaatcctgctcacagagtgaccttgggcaggccatgtcgcctctgtgagcctcagtttccctatgtgtaaaacgagtgtctgggtctctgcctcgaaggctgttctgagggcgtcgggtgggactaagtgcctgtcactgcaggggtgcattgtcctgagttaggctgataggcggtggcagccaggatggcatccagtctgggtgagggttgacagccatcccatcccatgcagatcgacatgctgcaggcagaggtgacagccttgaagacgctggtcatcacgtccacaccagcctctcccaaccgcgagcttcacccccagctgctgagccccaccaaggccgggccccgaaagggccactctcgccacaagagcaccagcagcaccctctgccccgccgtgtgtcccgctgcgggacacaccctcaccccagacagagagggcaaggaggtgagggtgggaagcgggctctgggcacggggaagggtggcagtgcctgcggtaggcagggtccgagcccagtgaggaccagcctgccccatgctgtgtgacctggagcctgtcctgcgcctctctgggatgtgagggctgggcaggtcctttctctccaacctcctgtgatctgaggcacttggcctgcagcctccagggtataccatctggggacctgaggccccctccctgccccactgactccaagcagtaggtagtggtctctgcacctgaggctggctttggccctgaggatctggggcctccactgagacacacacttccttggccttaagaggccaagcagcagccactgggcctcaggggagaggctgcctggaccccgtgtggccacagcctcgagccccaggaccacctggtgacagccctgtgctcaaggggtttctggcaccctctgactgtggggctgagacaagcgtggcctttggagaggtgtctccgtcccacctcagctggccacaccagttgctgggcccaggctgggctgacactcatggtcatgggtctgtaggcaaatgaggccacctgtcagcacctcagctttctcacctgataaatggggcctcccggggctgctggaggaaccagagacagggacatcaagagctgagttcaaggctgcacccaggtagtgcctcagagggctgtggtgccttcagcttcctgggtccctggcgccagcccactcgactccatcctggcttccacctctgtctccagggcctccagggaagacgagcaggccctcatccacctcctgagctctgagcttctgaatgtacattaacttctccccttcctcctgttctgtctctgtgcacctgtctacctgtctgtctgtctgtctgtctgtccatccggcccagcccgggctggccccgctgctctccctgctcctctgcgtggtccccagcaaggcggttcacctcacctacgagccggcctggccgctcccacctggggagcccccagcccctgcctccactccctctccctccttttcccgacaggtaaatggctccaaagaggggcctcccactttgccccctcccagcctccctcattctgcatgtggcctggagcaggccagcagtcacctctgaggtgtgggcccagggcagcctgtgtgtgtcccctcctgtgtgcacgtgcttgtgtgtgcttgtgtacctgctggtacctgtggcctcctgctagttgctctttgacttttcctcctcaaggaggcactgagggtcttcaggacaaagccctgcaccccactctaaaatccagtagcgccaagaaatttaacaccggcctggaaacaaaacttttagttctaaattctttggtgcaaagggcagaagggagctctgctgctgctggacttggcttccctgcacggctgctggggatcgacctgctggcttgctgggcctgccccacgtcctccctcgctccccttcagctcagcctgcatcttctatgctggccccagtaccctgaccgcccccaccctcgcttgccctcccccacaggtggacacaatcctgtttgcagagttccaggcctggagggaatcccccaccctggacaagacctgccccttcctggaaagggtgtaccgagaggacgtgggcccctgcctggacttcacaatgcaggaggtgaggcatggcaggggcggggccagctgggggacacacccctccgccagggcccagccccttaccaccctgcctgcctccctggtctgccacagctctcggtgctggtacgggccgccgtggaggacaacacgctcaccattgagccggtggcttcgcagacgctgcccacagtgaaggtggccgaggttgactgtagcagcaccaagtaagctgagggtcttagctccttcctgcccatgtgggaaagccccgccaagccgtgtgttcactgtgccgaggggtggtcaggatgcagcagcgccgacaggacagggacagttgctgcccccacagggcaaggaggcagtttggcaggtttcctgtggacccccaggctttccagagaggccgggagctagggtctgcctcttcctgactggtctgctctgtgccctccccttcttttcttgaaccatgattatcagttgctggctgtgcccctgccaataaataacgacgcagtagccctggcatttgtcctccagctactcacctggcattgagcaggggagcagcagaacaaaatagccagggtggagcaaggggcagaaattggggaggatttcaccttggcagccaagagcctggctggggatggctggtgccctggtgggaggctcatcacggagagggagcatttgagccaggttttgaaggatgaatagaagtttgccaagcagggaagggcatttcaggcagagggaacggaatgtgcaaaggtgtgagaagctggagtattaacggaagcaccactggggcatctggctaagcagtggggggacagggaattggggtggaggctgcagaggctgttggggccagagtataaagagccttcacaggtttgggctttaacccaccagccagtgcggcaaaagtcatcaataggccgggtgcagtggctcacacctgtaatcccagcactctgggaggttgaggcgggtggatcacttgaggtcaggagtttgagaccaacctggccaacatggagaaaaccccatctctactaaagatataaaagttagccgggtgtggtggcacacgcctgtaatctcagctgctcgggaggctgagtcaggagaattgcttgagcctgggagacggaggttgtggtgagctgagattgcaccactgcactccagtctgggtgacagagtgagaccctgtctcaaaaaaaaaaaaaagtcatcaatagctgccacctgaaaagaggctctctggtccatcagagagtcccagtgaaccaggaggcaacaaatgctctgataagtccgcagccaaggagctttttaaaccttcatttatttgggattctccccatttcttgggaattaggaaagcaagagagaaagatgatgggttagatgtgggtttttggaggagccctggctctgatgtggagaagaaagagagcgatgaggcagagagctggccagaaggagccaaggggatgcaggccaaaagtcctgctgctgtgccctggcctggggacttggtgaccaagcagagggtgaggaggagagagccgagcagatgatggccagtgaagagcaggtttggggagtggggcccagatgggggttgctcagggcctgtggagacccttcatgtgggtggctgaagatgctgagcgacgtcatgcaggactggggggaggagagaagagggcatgggagaaggctcttagacggggttggttggcatgcggctgagaaccatgggggttagtggggtcagaaggcctgcatggatgaagcaggggagctgctggatgttgggaagcgggaggcagccagacctcaactctggcctagttgggggaggagtgcctggtctgagtccccagaagtagagggagaggcatatgcagagcctgcagagggtgggactttgtacacctggcatgagattaaccaagctctcttgcccagtaggggcaaaacaagggttctaggggtacagctcagcttagttcgaggtctgtcccagggatggctggggccagctcccttctctgcctggctctgggttcctttggaagccgggtgggggaagggaggcctgcccctccccatgcatcctctcagctgctgcatcttccctgtatgcaggggtgagggagaggggcaagccccagccagcccccgtgacccattttgctttcccctagcacatgtgccctgagcgggctgacccgcacctgccgccaccgaatccggctcggggactccaaaagccattactacatctcgccatcttcccgggccagggtgagtcagcctttgcaagcgttacttgactcctttggggccacctgggtgctgggacactgggccctgggcctgggagtatgaatagcactacaccttgatttacttattttatttatttattttttgagacagagtctttgtcacccaggctggagtgcagtggcacaatctcagttcactgcaatgtctgcctcccaggcagacattagcaattctcctgcctcagcttcccaagtagctgggattacaggcatgtgccaccacgcccagctaattttgtatttttagtagagatggggtttcaccacgttggccaggctgaactcgaactcctggccttaagtgatctgcctgcctcggcctcccaaagtgctgggattataggtgtgagccaccacgcccagccttacatcttgatttacagagcagggtacaggctcagagaggcgcagagactgactcgggccacacagccaagccaagggcagtggtttgctattacggtgtaacaaattactatcaacctggtagcttaaaatagcgcagttccccatgttggagtctaagcactacttacttactggattctctgctcagggacttgcaaggtcgcagtaagctgtcagcagactgtgttcctttctggaagtcagggtcctcctcaaaactcacattgttggcagcattcagttccttgtgtttgaaggactgaggcccctattttcttgctggctgctggcaaggggacaccctcagcttctagaggacacccgcagtcccctgccacagggccttgttgcacagggcagctgacttcagagccatcaggagggccactctccagtcggctgagatgcagccttatgtatgaaatgtcatgggatgacatcgcccccctctgtcattcaatgtcacctaatccaggagtgatgctagagttccagttagagtgcggggctcctgacgcccagactcaggtgctggccgaagctttggaaaaggttcagcggtgcgtctggtgcaccagccttaagtcggccgtgagtgccaaggggcctctaggaatcccagctcccaccctcccctgccgagtgacccagaccaggacaggggttctcaccaagctggggattgaggacagggattcctcttcctctgtccctctgttgactcttaagaggattgaggggaacaagagaacatgtttggaaacacgtttccagtgacacagcttgaggaaccatctcaggcctgctagaggctcctcgcgggggagcaggtctaaaggggacaaatggtccctttgctggcagcagactatactgtccttgatgaactccacaaggcatccgagcgtgagtcctcccagcggtgtgctgagcacccatttaccaaaagggaggctgagccttggcagaggaaaggggtgtgttcagggccacacaccgagacctgggatcctggctctgagtccactgcagcccctaccctgtggatttgtgcccactgagccttgttcagtggccacttatctccatcaccgctttccaggcccaaccatggctcaacagcaggccccacaaaagatgttcccgtgctcaacaatgtcacctctagcactttaagtccctggcctgggtgtcctgctgcactggatgaagctgggggtgggagatgaggtgaggagggtctgaagttttaggatgtggtccctgccctgaaagaccaagacatgtggggtccacagggagaagtgttttctccctagcacactccctggagagggaaagccccctccctgctactccctgctcatgagcctctgtgggcatccactgtccctgctcctgtcctgagctctgccctgccccaccctcctgccgcagcctctcctcaaccctccctgtgcagcggtgtccctgccacgacgggctggtcccccgacctcgccccgctctctcgcacctccctatctttgccaggccaccaccgtcccgcccctccccgaagcttctccactccccagcctgcgggtgcccctctcacttgatgtccctccccaggagtgttggacattcagtaggggctgttgcgggcgggcacagccgccggctaccttccaccctgtcttaggctgggttccgaagaggcagagcctcacctggagattgtgtgcagctcccaggagaatgagggaagggacgggggagtccagccaggatgtggccttagctacagcccagcttcagccccatccaccgggctcttagcagagttgattccaccctgaggcaaggggactgtcctttctatctccacacaagtcagtcatcggctgaggtctacaggaggagtgagtacagaggggggcacctctgagccattagtgcccccactctcagcagctgggagatggggcccgggcctgggaaggggccctgggccaggcaccaacagtaccctctccgtggtgtgagtcctcatagcagtgtctgagccaacacagggtccccggggcctggcatggagcaggcctgaggccccaggggccccgggcagcccaggtgagcggcttctgaccccctttcctttcccagtgttatcagtagcactggactgaggcctggctggcccaaaactccagcatctggagcaagccggcctgtgagagggcgagtgtagactccgggacagcctgcccggttcatctcacagctctgctgcatgctggttcattagctccgccatctccgtgatggatgtcagcggctttccccgggtggctccgctttcccccatgtaagatggaataataagcgcgtctgctccgttcgctgcaggcgcttgatgaaatggctgctgctgctgctgctgctattacagcagggctagtcatgctgttgttgattactacttgaaagcccagtcccagctgagtcagggagcactgcctggctctgcagggacctggggcctcctgctctggactcagatccgcctgtcaggggacccccagcgtggggctggcaggtcacaccgtccccacctctgcccacagatcaccgcagtgtgcaacttcttcacctacatccgctacatccagcaaggcctggtgcggcaggacggtgagcgccccctggtggccggtgcagggatcgcacacgggagtggggctggatggggaagtgccctctgggcccacctgcccctagtggaggcaagactcagctaggaggctggggagcggggagggttgtggtttagtaaagcgttcacaaacttcctgggtgctgagctctgtacctgagtccgtccggctggtctttctcctgtccccaaacctctcccggccccgcacaagggggccacccctgtgaatctctccctggccctggaggtggtggcccctcctcctggtcacctgaacacagggtcacccacctccagcctttgctcccactccactccatgctggacagggcctccctccaccccctccccccacagcccattctgcaaggcctggctccccgctcctccaccaacctttgctcgctgctgagtcttctcctgaaccagtctggcccgaccctctgagtaaggagctatctcctctccatcctgggggtcaagtcctcttggaggccaaggccaaggcatgctgggtgttgacacctgctaggtccctggatggccgctgtggtccccgcctcactgcgcagggtccttgtgagaccccagggaggcatctgtgccttgtctaatgtagttcccaggtctggaccaccgctgtggcatgtgacagcgtgtacctgcttgtctgcgtcgggctgtgggggtggccgtcagtgtagtgcaaacagatccctcgggtgtggtcggcactcagcagtttccaaggctcaagagtggagcctcagagaggtccagccactcactgaggtcatctgttttgggggccggggaccctagggtgctgtgccagctgctctgtccaaagccacaggaggggacctggccatctgcccgaggtgaccctgagctgtccccgacctgttcaccctctctctgcctgcagcagagcccatgttctgggagatcatgaggttgcggaaggagatgtcactggccaagctcggcttcttcccccaggaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgccaagccctgggccagcagcacccccttgtggccatcctgtgccttgttcccggtggcctccctattggactactaggaggggctggcagggcctccatagcacagaattgccccaaagccttgttaagatgagtcaagacccctcccccgcttcctcccttcctttcccccttcctccctcccccttcacaaaggcctcccttgtcaccttccctcccaccccgtctcagccctgtgctcctggaggccctgctcccaaaaccgctggaaggactggggcactttctgccacagtagaacacagacagggcttcagatcgcccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggtacaggctgggtggccacgcgccctcactcctgcaccctggggctctggccaaggcttgggcatctgaaggaatgaaaccaaatcctttccctgcccgccctcgtgcttgggattaaacccaaatcctgaagccaccccacctccgccatcaccacttacttgctgtggggaggactatttgagtcctcccttagtattcagagggctgtgggttactgggggatgagccaggcctccctctccccgtggctggtggcctgctgttgggaagaacggcaccaaggctggctctcccactgcctcactgtggcaccttggccaggtcctcccctgggtctccttgcatccagcaatggttacctccagtctcacagaagcctgcagctcagaggcaaagcatcgaggctgcctgttgctcagtgggacagtggcaggattgattggtgatgtctgctggaagcacaggcggggaccatggaagcccaggtcttagacgagctctcagcaaggggcagcagtcacagttggaagaggtgggggtggccaggacctctgaggacccagagtggggctgggaaggtgtcttgtggtggctgagcccctccccacctgtagggatgtgggcccaggccaatagatgccttcttggggtggtggagagcatagcagcttctgagtcgggtcagtatctactgggctggtgacaccttgtggggacttccgtattggcctgaggccttggtgccactcagctggtaggtcaggctagctgtggactggccaggaccacaggaagccctccacccatgctggggacacctgtgcttgagctgagaatgtccagggggaagactggcaatcaaaaacataccaggaacacgcacagggcatcagatggaagagaggaaagcaggcaggcaaaggaggatgtcagaaaagggcgcaagaggctgtgttcactgctgtgatccccacagcctctcttgcgtggcagtcgctttctctcctctctgtcagtcctgggtcagctggggggccaaaggaagttggaggtctgggccctggagctgtccaccctacccccagcttctgtgctcctggcccagcaacactgaagacctaggagacaccagaccacactccaggggccaggcagagggtcccataccccagacccgcgctgcctgcccctgcaatggcatagcctgctgtcagaccccaagtggggtcataaacagagaactgaaatgcctggaggatggacatacactctcagtatctcccaacgagagataatagctgagcactgactgtgccaggcatgattctaaaccctttaaatgatctaattcatttcatcctcacagcaaccttatagagtactattctcccattttgcagatgagtagaatgaggcacacagaagtgccacagaggaaatgatggccccgggataggaatcatgaggccagccctggagcccacagtatgaaccagcatcctggattccctttcctagacacctgcaatgtgcttaaaggtggctggggagggttagccgacatcagccacgagggagttgttcctcttaaatggattttctagataacccacttgggcctctctgagtacccctggcacatgtgaacattttaaccctctttggccccctcttcaaacctagcaacgactctggcctctgagggtggaggcgctgagccgagaccagctgcgcactggcgtgcttcactcctgcaggatgctttccagtctgccaagactgtcctgatggaactcctgccggggctgtgcacctgggcaaagtcgctcctctctgggcttcagtttcctcatctgtgagttggaaatataggactaaatggctttcgcagcctccttgcctttttcattttattacggtaaaaaacccataacttgtactaccttaactctttttttttaattgttgtttttgttttgttttgttttgagatggagtctcactctgtcacccaggctggagtgcggtggcgcaatctaggcttactgcaatctccgcctcccgggttgaagcaattctcctgccccagcctctcaagtagctgggtctacaggcatgagcccctatgcccagctaattttttgtgtgtgaatttttttttttttttcagtagagacggggttttaccatgttggccaggctggtcttgaactcctgacctcaagtgatccgcccgcctcagcctcccacagtgctgggattacaggtgtgagccactgtgcctggccctcccttaaccatttttaagtgtatagttcagtagtgctaagtccatttacagtgttccgaaacatctccagaacattttcatttcacaaaactgagactctgtacccattaatcaaccctctatttccacctcctcccagccccaggcaacccccattctactttctatgaatttcactgcacgagggccctcatttaagtggatgatgcagtatttgtcctctcattactggcttctttcacttcatgtcctcagtgtccatctgttgtagcatgtgacaggatttccttcctttttaagactgaataatattccattgtatgcatagaccacgttttattttttatttttaattttattatattataattaattattactccaggctggagtgcaatggtgcgatctcggctcaccgcaacctccacctcctgggttcaagcctttctcctgcctcagcctcctgagtagctgggattacaggcatgcgccaccatgcctggctaatttttgtatttttagtagagacagggtttctccatgttggccatgatggtctcaaactcctgatctcaggtgatccgcccgcctcagcctcccaaagtgctgggattacaggtgtgagccaccgcgcctggcctgaccacgttttgtttatccagtgtctgtggatggacagttgtgctgcctcacaatgacctcttggccattgtgaataatgctgctaagaaaatagatgtacaaatatctcctcaagactctgctttcggttcttttgggtatatgcccagaaatggaattgctgaatcataggcattttaaagccattttcatactcttttctatagttggctatagcacttcacattcttacccacaatgcacaagggttctgcatcattgccaacacgtgtgatttgattttttgagaccaggtctccctctgtagcccaggctggagtacaatggcatgatcttggggcactacaacctctgcttcccaggctcaagcgatcctcctacctcagcctcctaagtagctgggactacaggcgcacgcaccaccacgccctgctagttttttttttttttttttttgtagaaatagggttttgtcatgttgcccaggctggtctcgaacccctaggctcaagagatcctcccaaagtgctgggattacaggcgtgaaccaccatgcctggcatgattttttcatttatgtatttatttattaaagacggggttcctgctatgttgccgaggctggtcttgaactccagggctcaagcaatcctcctgcctcggcctcccaaagtggtgggattccaggcctttttcttttttataggagccctcctaacaagtgtgaggcagtatttcattgtggtttcatttgcagctctctgatgattagcaatgctgagcaccttttcgtgtgtgtgttgcccatttgtgtgcagcccctctttcctgaggagcattctgaggagctccgcctggcctccacagtgatcccttcgaggaggacttggccaatagggctgtgatccctgccctcactcacggctcttgcatgattctgtggcccccccttcatcttccccatctcttctgggggcagctggggaaagtggaggttctaacctatcacaacccccaaccacctcacacacaggggctgagaccaggccagggctggctccaaggaagaagcccctaggatggccacatctgaccactcagggctgctgaaggtggggccagggccaggtccatgccttcagtggattttggtgcaggggatgcattccttcaagaatctgccttctccattcctgtgctgtgtgaacatggtacggggtaggggtgcctgcagcccccttgggccagggccaccagccatgctcttgcacccccacacacatgtgccaggttggggttccaggatatggtcagtgggtgcctcagtggagagggcccaggcagccccggtgcctgatgacatcatgggccttgctggatgtcctgacaagcaaaggcaggagctcctggtaccagggagaactcgccccctctgcccttctggggatactggtcctctttagaccaagacaaaatattagcatatcagagaaatatacttagggttttctaagtgcatttccccaaccagccggtcagcatcacctgtgaactggccatgtaagtctctgcctccacaccagacccaccgaataaccctcctgggtggttctgatggaagcctttcaggtggttctgatggaagattgacgaccagcgctctggaagtaactttagcctgatttgaattccttgctgctgtgaacgcttaacttttaggaacaggtatatttatcacaaagaaatccgaagcaattaggggagctacctacactttcaaaaggacttgaatgtatttaaattaaaaaaagcggatggggcccgggtgcagtggctcatgcctgtaatcccagcattttgggaggcgggagggtcacttgagtccaggagttcaagaccagcctgggcaacatggcaagacccatttctacaaaaataaaataacaccaaaaattagccgggtatgatggggcgcgcctgtagtcccagctggggactcccgagactgaggtgggggtatctcctgagcttaggatgttgaggctgcagtgagccgacatcatgccactacactgcagcctgggcgacagagtgagactcctgtctcaaaacaaaaaagaggggcggggaagcagtaacaagcacaggtgtcctcagcccatggatggcagcgcccgcctccacgcgccagtgccctcctgctcccctacctcccccttggccacccctgggcatccccagccctgcagcgccgagggcggaggggaggccacccgcccccagcagagggctccgagagagctgcagcggcggtgggggccccgcagagattggggcccatggtttgaaggctgttcacaggcaccccgagacagcgtcccccctctgggcgcactggatttgacgttgcaggacgcgcggctggaagccccccaggccccgctgctcacagaccgggactccgcctccggttcccgagggcgtggcgaggcgctgcgggacgcccaacaggtgcgtgttgtgtccccaggccccgcgctccgggcggagtcaagagcctggaagccggcagcccgggaaaagggggcgggacggtgccccggggcagggctgggtggcggccgctgtcctcccgggaggggcgggccgcctcgacgccgccctccctggcggccaatggagaccgaggccccgcgcctggattggagcggacgcggggggtcagccagccttgggggccggggcctggccgggggcgggggggcaggcgaggcgaggcgggcgccgtccgcgcggttataaggcggggagttccctgcgccgcgagccgggaggcgcacgctcgctcgtacggcggccgcggcggcagggcggggccggagcagcgggcggcggcggaggcggcgcccgggagcgctcttcgcttccctcggggtcttgctcggacctcggccaccgcctgggatccccaggactcgtgcgtgcagcatgggcggcgtcggggagccgggaccgcgggagggacccgcgcagccgggggcaccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggtaaggaagccataaggaagccacccaccggcgggtggagcctggagctcggtcgtgggcgtgatgtcccgctccacctgtggggccttagcatcctccctcccctcgctgacctttgacctccacgccgggacccagagttggggtggactagccagggccagatgtggggtagggagggcagttccctgcgtggaggacccgcagctgtccacggagcaggtctgcgggggaggagggggcctcagaggtgggtgtgtcatgctgcagagcctgccctgggtgaggggctgccctgttgctcccaggtccctgtttcagttctgggtccccatgctgggtgcttgctgagtgctaggggtagggcagggcagggtccccaggggccggtaaggacatgccattagaggctgggggctgggccggcctgaggtctgtggctttcccaagagcttctgtaaagggctcagggacagtgactcacctctccgggctagcagctgcacgtgggagggctttgccagccaggctgggtgggcctctcctggaagcacagtcaccccaggaacaggctggcccctggggaccccaacttcccaatcccagcccctgtctagacaggcagggatgtagcctggccccagggtactgtctggctggagtccagtggtggagcagcccgaccagccccttttccttagttacccacctgcacaataggggttggggccacgatgccctgtccttgaccctccaaatttctaggttggccacactgggtatcaggaaggtcttcaagacctgaggacatgaatcctgaatgctggctttttgggcagcagcggaggttctgtccagtcccaggactgtcggcgtccctcttgccagggccacctgctctctgccgattgccatctccagcatgttggacaatcttcactggactctttgaggaagaaagcccctcttttccccttccaccccatgaagctgaggagtgagaataagaatcctcctgaaattctaaaaaaagaaaaaaaaaaaaaaagaacgccttgtccgtggctgttcaggcgccagacgctggcccgaggggacagcacagccgtgggatgaagcagcctgggggcagtatttgagcgtgcaggtgtttgcatgtctgggtgagtgtggtgtgtgtgcctgcctttctgccagggcgtggcgaggtgaggggcacggcttctccccaaaggcctggctgagccctggcctcccttcaaggagtcttgtggatgcctgctctggtctttttttaaaaaagtatctattttatttattattatttgtttaaaaatagagacagggtctcactatgttgctcgggctggtctcaaagtcctgggttcaagcattcctcctgcctcagcctccgaaagttctgggattacaggcatgagccaccactcccggcctgctctagtcttttgtaacctagaggacagtatggatacagaaaactttactccccaccaaccgccggagacagaatcttgctctgccacccagactggagtgcaatggcgccatcttggctcactgcaacctccacctcccaggttcaagcgattctcctgcctcagcctcccgagtagctgggattacaggcacgcgccaccacgcccggcatattgtatttttagtagagacggggtttcaccatgttggccaagctggtctcgaactcctgacctcgtgatccacccacctcggcctcccaaagtgctgggattacaggcgtgagccaccacgcccggctgggatacagaaagcttttatttcatcactgtttcctgcctggtgccaggcccatgctggggttcctcccaagtggaattactgacttaacatttagcttgggatcctgagacttccatcacacagttttctcattgattcgcagccaataatatctgttttaaaaacatctcaggccgagcgcggtggctcacacctgtaatcccagcactttgggaggctgaggtgggcagatcacctgaggtcgggagtttgaggccagcctgaccaacatggagaaaccctgtctcttctaaaaaaaatacaaaattagccaggcgtggtggcgcatgcctgtaatcccagcactttgggaggctgaggcaggagaatcgcttgaacccaggagacggaggttccggtgagccgagatcgcgccattgcactccagcctgggcaacaagagcaaaactccgtctcaaacaaacaaacaaaaaacatctctctgctccttggggccgggtgccagctctgctattggaggcactgagcgaccttgaagcaggcatgtcactcctctgtgccccagtttactcatctgtaaagtggggagagctggggcagacagtgagctggctgagggcaggactgtgtctcctcaagcccatggcccagggctgccatgtagtagtttgtattcggtaaatgctgctggcccctaagtgtgagcgtgccctgcaaactgcagtgtatggtgggacagccctgcacggctacccctttcctgggtgaccttatttggttacggtcctatctgaagtaggaaagggacactttaggctgtctcttagctccctcaaggccccacagcctggactagagttgccagaaatacttggtccattcaggccaaagggactgtgaggttgctgggatggtgcaatcagtctttgtccatgatgaacccacagggtagaccaggggttgggccagcccagtgccctgtgtagttgagcccaggccccaggcatcccatcccgggcggtggcctcaggtggaggtggggcagccagttgccagggatgtgttccagcggtcacctctcaccagccccggctgcccatcagctgttctcaagtccaggcaatgaagccttcctgccaggaaattcccagagtttctgtgccatgaagtcagcctgtggccatcttgggacacaaggccgggtgccctggggagagtactctgggcccttggccaggtttgtctgagagtcataggcagcctgatactagtggagccagccagggagggatgaggcccagccgctgctggccataagtatataagggccatgtgctgagtgcctactatgtgccaggttttgaaatcagtacttgatttattgaaaccctctcttttaatcctcaaggtgcccctatgaggcacgtaccatttattgttattgccacttgacagatgagaaaacagaggctcagagaggcaaagtggcttgaaattcagtgattggtctgggatttgaatccacagccatgttctcaagggcatgctatgctgccacctatcctgtttatttccggcactcattgattcttcaatgtttgactcattaaatccatcagtgagcatcttctctgtgtcatgcatggttctcacctctgaagatgtagctgtgagcaaaacttctacagggaatgagttcacagcagagggatcagctagagcaaaggctcagaggtgggaccgtgcgtcctgtgttccaggaatacagtatggctgcagcagagagcagtggagagagggcctggcagtgaggtctagaggcggccgggctggctcatgctggatgtttgtgtcctcggaaggactttggctttattttaaagaggatggggagccccagagagcacagcagggaagcctggggagtctgatggacatttaaaaggatccttaatggagagagtgaaggcagagccttccagaagggtaagagaagggaggatggagacctgccctcccccaagggaggccactcagaagaggtagagtg

SEQ ID NO: 935 - DNA, 2328 bp, Homo sapiens
cctggtggggggaagaaggctcctgctacctcccttcccggcaccctccagagggaccctcagtctggccttgcaagcatggactcttctgaggagcacgctgggtgccccgcccgagggacatgtcccgtgttcctggccatgagtgcagggactgtccgctacgccccatcaggcctgtgccctgtacttgaggggaacttgagagaagagccctggggcacagacagcccaccccagccagaccagggcctcccgccgccccttgcagctgtcccggtcccctggaagagcacggacccctgccaaggccacagggagtccccaggagccctggtggagacctctgcaggggaggaggcccaaggccaggagggccccgcagccgcccagctggacgtgttgcgcctgcgcagctcttccatggagatccgagagaagggctccgagttcctgaaggaggagctgcacagagcgcagaaggagctgaagctaaaggacgaggaatgtgagcggctgtccaaggtgcgggagcagctagaacaggagctggaagagctgacggccagcctgtttgaggaagctcacaagatggttcgagaagccaacatgaagcaggcggcatcagaaaagcagctgaaggaggctcggggcaagatcgacatgctgcaggcagaggtgacagccttgaagacgctggtcatcacgtccacaccagcctctcccaaccgcgagcttcacccccagctgctgagccccaccaaggccgggccccgaaagggccactctcgccacaagagcaccagcagcaccctctgccccgccgtgtgtcccgctgcgggacacaccctcaccccagacagagagggcaaggaggtggacacaatcctgtttgcagagttccaggcctggagggaatcccccaccctggacaagacctgccccttcctggaaagggtgtaccgagaggacgtgggcccctgcctggacttcacaatgcaggagctctcggtgctggtacgggccgccgtggaggacaacacgctcaccattgagccggtggcttcgcagacgctgcccacagtgaaggtggccgaggttgactgtagcagcaccaacacatgtgccctgagcgggctgacccgcacctgccgccaccgaatccggctcggggactccaaaagccattactacatctcgccatcttcccgggccaggatcaccgcagtgtgcaacttcttcacctacatccgctacatccagcaaggcctggtgcggcaggacgcagagcccatgttctgggagatcatgaggttgcggaaggagatgtcactggccaagctcggcttcttcccccaggaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgccaagccctgggccagcagcacccccttgtggccatcctgtgccttgttcccggtggcctccctattggactactaggaggggctggcagggcctccatagcacagaattgccccaaagccttgttaagatgagtcaagacccctcccccgcttcctcccttcctttcccccttcctccctcccccttcacaaaggcctcccttgtcaccttccctcccaccccgtctcagccctgtgctcctggaggccctgctcccaaaaccgctggaaggactggggcactttctgccacagtagaacacagacagggcttcagatcgcccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaa

SEQ ID NO: 936 - protein, 429 aa, Homo sapiens
MDSSEEHAGCPARGTCPVFLAMSAGTVRYAPSGLCPVLEGNLREEPWGTDSPPQPDQGLPPPLAAVPVPWKSTDPCQGHRESPGALVETSAGEEAQGQEGPAAAQLDVLRLRSSSMEIREKGSEFLKEELHRAQKELKLKDEECERLSKVREQLEQELEELTASLFEEAHKMVREANMKQAASEKQLKEARGKIDMLQAEVTALKTLVITSTPASPNRELHPQLLSPTKAGPRKGHSRHKSTSSTLCPAVCPAAGHTLTPDREGKEVDTILFAEFQAWRESPTLDKTCPFLERVYREDVGPCLDFTMQELSVLVRAAVEDNTLTIEPVASQTLPTVKVAEVDCSSTNTCALSGLTRTCRHRIRLGDSKSHYYISPSSRARITAVCNFFTYIRYIQQGLVRQDAEPMFWEIMRLRKEMSLAKLGFFPQEA

SEQ ID NO: 937 - DNA, 27299 bp, Mus musculus
  misc_feature (1)...(27299): n = A,T,C or G
cacctcagccctccccatatctcctcatctttgtgaccacaaatatttattgagtgcctgcctgcagcctacttccaggagccggcccctcccctgccagcaccttctgcctgttatgtcccccaccctgcctggcctgggatgagaaagaactgacaaactgaaggagagatgaggctaagggaaggagctatcccaaggcttgaaacggaggtgaacaagtgagcaacttcacttattccaagtggtgcctcgtaagaatgagagaaggccgagtttggggatcaaactaatgggctaagtcaggatcacatcaggatcggtgaccttgttgacttgccttggcctcttggtctcagtttcctgtgtgtaaaatggggataatacctgtccctgccccaagacagattaagcctccaggaggctgcagacgacctctaaggaggttctgacgcattcagctccagtaagtgacccttaccgtgtccattatatggggacagttttacctttccagagcaggacttcccaacctttgttaatccatgacacatctttggacatgacaggctacctgagagagcctccaccctcagcgtgtgaccaatcccagccatccataattgcccacattcctgaggctgtgctcactcgaatttaccctccttcaaaccctccgagagagcttacactccttgaaggcagaccaactccgagtttttattgtgctaatcacggtgtgttgctatatttgttcacacgcctacccctcctaccttgttgtagcttttcccgtctccaggacctattcaagtacctggccctccataaagctcgctgaattagcacaatcctcttctgctgggtgcctggcaccgtctggcttgacggacgttttcaatgtgtggcatagctgagtgcggacgaaatggtatgtgtgtacaaacacccagccctgcccgcctctcttcaccatggtaacagtgcagtttccagacccaaactggcaaagagcattgatgaaacccaaaacttcagaacacagcaaagcccttaaaggtcagagacctgggcaggcgggtagggcagctgagtggtgatcccctgcacaggtcagcaggagacttcggggacagctgacgatggacctcttttccattccactctcctactcttcatcccattcccatggtgcctactccccagcacagcaaatatcccctctgcacaaagatcttatccacctctatagcacctgcaaggccttgacctctcagctctctggcctcacagctccatgaccacttttgtttgctctccggcttgcttgcttttgtgctgctgagtgtagaactcggggccctgtgcacgctaaacccatgcactagcattgagccacccctctctctgcgactgacctgtaaggattaagggtgcacacagtgacggcagggaagaccagcttgtccgaattgaggttgatgttgagactcacggggtagctgaagtattcctcgaacagcaaagcaaactgccagtacatcatgccgaaggtgcagagccacagcaccgcccagaaggccgtcttcatgcggttgtgcttggagcacaccaggcggatggcaccgtggatggtggtattgttgcagaagaactggaagagctcccggtaggagcggtggaactcgatcagtgcctcctcctcctcggtgggctgccggggctctgagggttccgggcccagcgcctgttcttcacgcttgtcccccttgcccagtccttgcatgggcagaggaggacaaaggtcttgctccttgaaattgttgcccttcatggatcccttcggtgagttggagacgtcaaggtctaggtcaaggttgagctcaggggctctggtgtggtccagcatcattagtatggaggcagaatggggccgtccgtgacggtgcccgcatcccacgctgagttccctcttcctcagtcctcccaccctcctccacctctccaggagccagctgaccttctggagttggggccaaccaggcagcacggagcttcactggagtggccacagagcgaagtggtcacagcgaaggccaccttcgtttgcccgctagcgcctccctgggtctccacagcaggcaccctgtctggcttagcgtctctccctcttgcccctttttcctcccggactgtttgactctccggctttcacgccctcttggcccagctgactcccgcttctctttgggtctccctctctgtgccaggctctctgatcctgcctcacttcctttcctgccttccctatctcctcctgggtcctcttctctaggctctctagccctggcctccagctccctgctacctccttctctgcctcggggaccgtgggttgcaggaggccggagctgcctcctgctcccggctccaggtgtggctgggctgtgactggttcctttccagttaaatctggcagccgagcctctccaccctctcacctgacaggtgcagtgcctggctccagagaccgcccgtcggccacgggcaaggatgggagcgacagaagcctcattagcatctcaattaaaggtgagcagggcagagggaggatcggaggaggagtctggtctgggagctctccagggaggagggctcttgggggacaggtgaaccaggtacctgctgaagagtttcggccagggattgatggcgaactgactgaaaaagagactaggggcagaagacaggtgaggctcagagaaccggagaagagaggaaggattctacacgcaaaagccaggaaggcagaagcggaaggaggatcgccgagagtaggtggggaaaccaggagaacagggaaggcagaaaagagagacagactgaggaggactgggcaaagagctgagggaagatgaaggaggaggaagaggagggagccagctccaaagggactctcctgtcaggcaagatggctaggggaaaggaaacctaggtgaaatttcagaaaccagggtcccttctgattgaggtccctcaaggtcatcccaggtcagcctcacacccagggtcctggaggaaaaagagaatgggtccccccaaaactgggagcacctgctggcccccaccatcttcttccccatccccttccctctgaacttctcaccccatctacctggccctgtccaggcctgggagggaggggcccaggtgaagtagggggctgggccaggtcctaggacattctgttctttttgacactattggctgataggccaggaatgtgtaatgtcccctgttgtggtcacagggttgcaggaatgtgggcaccagaggtaacatgtacatgggggccaggcagagctctgtgggcacagaccaagagccctgggacaggcagggatggcagaccctggaagagaacacaagctgtgtctatactggtatctagggcaaggagggtgggcacgctgtcctagaaagaagtggaagctctttcatccaggctgtgtttttctccaaactctccctcaagctaccctagctagaggagacagatgcaagcagggaccacacaggtgtgacagcctcaaaggctcacacccccaaaagaaagagtgaagagtcatgggagagccatccacatagcccaggtcctgcagagcttgctagtgatagtgccacttgagccctggagagggcagccacccagtgctccagtgtgctcactggctcttcctaccctctctccagcagcaggaacaacagacaggggtgttctctgtgctccagacctacagacacagaccaaagcagccacagaggtttatggaaagcaacaggtagttgacatacagggagatgaggggtctggaggcagggataggaaccaagtgctgggggacagtgggggaagcaacaggagggacccatttcaagtgacaccctggagggactcatttcaagcgacaccctgaagactggcattgcggctgaagcttgcagaataaaccagacaaataagagggtcctctgagctagtctcattcttgaaatggtcaacctgggtgccgcctgttagctaggctgtttgacagacgccttgacacacatccacgaaacctttctgtaagaagagggaggcaggctccttctccacttctcacacacggaaaccgaccctccaaaccaataagccagttttctgacatcacaaagcggaccagcagctgttgtagacagaatgcaaacaaaacatcttttcctctgacgttgcctctcgtcatttccctcctgagacagaccagtcataactcctggggaaccagcccagcaggaggggtttggtccctcccacacaaagcctatggattcaccctctccaggtaatgtctccttggctgtgtgcctctgagctgtttctacctctccatttccccagccacccctatgctcccttgaatcaagcaagtccttaaagcagtgtcctacaggcaaggtgcccgcttcccctgactgtttagtctgtgaggttccgagaagagaagctggctcctccctgcctcttctgtttgctagctgggcctgaaacccaagtactggcttaaggcagcatgacaaatagttttcatctcaaggactccgtgagaatgcctggcccaaagagtgtggtgactctggcatgtcctgacagagtatgagagagtggcttggcttggcttggcgtggtgaccacggcactagagatctggaatgggccagtgcaagcatgatgtaagaatagatattggtactttggtcagagtcccatttgaatcacactcacaaatacacatgcatacacatagatattcaaatacagacagacagacagacagacagacattcaaatacatgcacacacacacacacacacatacacacacacacacacaaacacaaacacaccaaaaccaggggatccttctgtagcccaggctagcctggaactcacagtagtcctcctgcctcagctttgcaactggatacatttttgtggtagtatagtttcccagcaatcccgaaacatgaagcaacacaagcttcccattgtccccttttctccttcccctcagcccagaaagagcaccacgatgctgatgacatgttcatcagtgcatctctgccatgacatgttcatcagtgcatctctgccggtgacatgttcatcagtgcatctcttccttggtgtctctctgacttacgtgttttgttgtgctgtatgctgagaaaaggtttcaatgtctaactaaccttaaacttgcttcctaaccaaggctgaccttgaactcgtgatccacctgccttggcctcccaagtattgcgattacagatatgtatggcatgccagcttacattcatttccaaaaagaaataatcctaagtgtgactacttcatacgtatcactctatgacttccattattttcaaaccatttgtcttcaagaaagcacgttcaagccggacatagtggtgcagcctttaccccctacttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctacccagggcgtcctgttgcctctcccagaaccccaagccatctcttaaataaggggctgccttctctgtcccattccagccacccattgaacctttagtacatccataaaccatgcagtggctctagggaaagaagccaacctttagggttgcagtgggtgcgcattaggactgacaagtcctccggcctcttcattccagagatgagtgacaggaaggatccgtttctgctccacacctccaaggaaagcctgcctcatcacctcctgctgttcactgttaacgatgtggcccacgcatgcacctgtgttcccttccacaggcctacatgtatgcagaccattttatgaaaactctgatgacaagcaccaggcttgtttatcttggcgggtgactcgtggctaccatttctgttttgtttctgagacactcactctgtggcccaagctgttctcaaattcccagtcccccaagtgctgaagttacaaatgtatgccactatgtccaacttaatggtcgttgcccgttggcccactccgcagacaaaagaatctcacatcttggctaggatccaaggtttatcatttttttgacagtggagtgcacacgggaaaaacttcaaacatctcggcttcctccaacagcatactgatttggggggctgttaatttatcaaaatttcttacacctttcccctttcagcttttatgctttctagggtaaaaatgagtcacacaattaatcatacccctttacttttacacttagcactaactatggggcagcctactgtggcaaagagcatccttttatcattctttatgtagtataaatctaatgaggtagaccagaaaatttctctctcccatcctcattctagcgacctgtgaagatgcttaggagtccccattaagacttattcctttgcttagttacagggcttgacaaggtccttgctgctggcaatcccaaccaggcaattccttactgtctgagcctgtcttacactgcgggacacagcaacatccctggcctctgcgctaggtgacagtgggaattccaagcagttgcaacctaaagtgtctttaagatatttccaagtgtcttctggggagcaaggttaccaagatggagagtaactggacaaatctttgctcccactgaaactccaaacactcatctgatctgtccatttctctctgtctaccagcccagctgggctggctaacggaatcagttggctaagggaaatataaggaagaagacaggagtggtttagagtgatccactcacaccaattctctttgggaattactcataggctgtggggaaaagggtgtttccgcaaccccttcggagggaggcctgggagaagagcccttcacaccttctgggagtctgagggcactcagttctggtctggtattgcccagtggacattgatgaaagtttctggaagctggtaaaaagtccaagtaacaaagacaatgctgtgctcactaagaatttgaagatttctcatccggagtctccatcccccagaagaaggttggagaggtattatagtaaccattttgtattgtctgcccgaagtctccgtaggctgccaggaggtgggtcgggtctccccacctttctgagtcctgtcacagaacgtgcccacactcctatactcactgcataaatagacaaataaacaggtgaaaaaagtcaatgagaccccactaatctacatgtgaaaactcacaaactttaaaatccacactaaaggtagccaacacctttaatagcagagcttgggaggcagaggaaggcagatctctgagttcaagcccagcccagactacagagggagttccaggttagccagagctacacagagaaaccttgtcttggggggagaatgatgtgaaaaaaaaagacaggtcacaagtgaaagctaagtaagacaacatggaggctcctaattctctctctctctctctctctctctctctctttctctctctctgaatagtacatgtgaattttccctaataaaacattaaaaaaaaaaaaaagaaatagtgaaatgtatctagggccgctccccacccacccgttcctttatgctgttaagagatccaagtgagtcaagcccctgccccaactccctgagcccagaaggaagagaaatcagaggtctgctattcagtatctctaccactgccagggaacctgggacaattgagacagacaggtaccagcagagtggagctgctgggccagcacccagggaggggacagcacagagtgactatcaagagcccaggcagcagttaagagcatcaactgctcttctgaaggtcctgagttcaattcccagcaaccacgtggtggctcacaaccaccactaaggagatctgactccctcttctggagtgtctgatgatagctacagtgtacttacatataataataaataaatcttttttttaaaaaaagtatacacttaaaaaaaaaaagcccaggcaagttcccccccaccccgccccgctctgttcccccctctccccaggtcttctctaaaactcaatcccttgccagcatttcgaggctccaccgaaagcctgtctggatatctgatccaccatggaaaaggtcagttctcaggtgagctattgcaagagaaggctttccctcattccaaatgagagtccaaccccaccccccacccccgagtcacaagggaggcaggacagatgttgccatgggctgggatctgaaaatcagatctggactgcagttaagttcttccagagtggctaagcggtgtggacagccttcatttacacaacgaatatgtacctggccagtggcataagccagatcatgctagactccgtgagcctagactaaatagccaaaccaggccacgggccagccaatagcctagtaaggagcacagggcagacattagggttccttgggggctccatggctgttttcttaatagaaatttagaggggtgtgtgtgtgaagggggctgggggggggttgggaatcagtagacgtgggaaaaaagggtgtcacatacttccagcagctctgggctattaatggcaggaagaaaaggcccaccaggcttaacgatcttggaaccctgtgcaccgctgcctggcaccctgggcaggtcttctctagaaagtaaggtacctacactggctgggctctcaggtccctcggtttaagagagttataggcctatgtgcacacacgctggaactaggctacccagccccagcccagaagcccccactcaccaggacctgggtttacacacgcccacccttccgtgagagaggtcccagaggagaggacagattcagggccagctgaactctctccagtgtcttgtggtgtgcgccctggtgtgtggcgtgggtgggcttgttactgtggaagcttctttttaaaaagtcacagagtggagcaggccctcagtctctgccaagtgggatgcctggccagacgctggctgcatctgctaaccacctctgggtatcctggctgggtgcactgtcaatccctggcgcctcctctttgcaaatctgacacccagctgtccacagctctctgcctcaacgtccacggcaggtcaaccaagtcagctctgcctcgggctctcggaggtgggcctgactgatggctagccactgtctctgctgcccccctttcggccagcaagcgatcctaatccgcaatcccctctgagagccaggcttccgaagaaaggtggaggccgggttccgggcctgcagctctcacgtgctttcccggccaccccctcccgccctgcgtcgaggcggccaagcctgttcctcttcccccccgtcgcgattgcgacaggccggcctctgctcccagggctccctgcccccgcccccggccggctcgctccactcccacttcctgagcccggcgctggagccctggaggccaggcccggccgctcccggcccccgggggcacgtcggcccagccgccaggcttgggaagtcgtggccaacgctgctcaggacgtccgggcttcccaccttcctcctaggactccacccggtctggtcagccgagccgaaaggccgccatgcgcctgccccgggcctcctctccctgcggcctggcctgggggccactcctgctgggactcagcgggcttctggtggcctctcagccccagctggtgagggaggggctaggtgggatggacctggtttctctctagcccttctgccctccagagctgaccctgcctcattcttctctttctccgcctcccctggaaggtgcccccttatcgcatagaaaaccagacttgctgggaccaggacaaggaatactacgagcccatgcacgacgtctgctgctcccgctgtcccccaggtgagaacagtggctccaagtggcttgggtggtagaggtgagccagaatgagccagcactgctaaaactagccaggaaggagagtctacgaagcattagcattgtcccacggacactgagatttgaagaggtagcggcatgtagccatgaagacaggatggggacaaagagaccaaggagaggctccgaggcatgcagcaagcagaggcagcggacgcagagatggacttcttgtctcctgataaccctctttccccattcgcctcataggcgagtttgtctttgcggtatgcagccgcagccaagacacggtttgcaagacttgcccccataattcctataatgaacactggaaccatctctccacctgccagctgtgccgcccctgtgacattggtaagtggggactcatctggatctgcatgatgggtacgactgggagggccagctcctctctgactcttccctctccctgacagtgctgggctttgaggaggttgccccttgcaccagcgatcggaaagccgagtgccgctgtcagccggggatgtcctgtgtgtatctggacaatgagtgtgtgcactgtgaggaggagcggcttgtactctgccagcctggcacagaagccgaggtcacaggtcagaggtcactgagggcagccagtaaagggaggctgggcatcaagggcaaggaacgtgatactgtgcgcatggtgcttctccccactggtactgtgagtgtggtacctctgcccactgggagaaccataaagaatctatcagtccttgaaaaaggctcacaggagggggtctgccaagacatgaactggtatgaggagcttagaaggtagctccctcctgtcagccctggggaagcttgggcaaaacggcaggctgcaaagccaagcttgggaaaggtagcaactacagagcagaatggttggcaaagaggggacgtaaaggaaggccaccgagtcctcacacttacccactcacccccactggcctgcctttcttttgccagatgaaattatggatactgacgtcaactgtgtcccctgtaagccgggacacttccagaacacttcctcccctcgagcccgctgtcaaccccataccaggtgagagggcccttcccccactcacctccaggaaacccaagggttgtcatctcctccatccttgacttccggccatcccgaccatgtgttcctggagccagtcaccaaggggagcagggagaagctcacagtcttgtttctccacagatgtgagatccagggcctggtggaggcagctccaggtacctcctactcggataccatctgtaaaaatcccccagagccaggtaagacaccgggctgaggaacacaaggcagggtcggtctgggaagatgcctcagcccccctcatccacagaaacagggaacagtgcatctttcttcccagggttagacaaagtcagaaacatttcttctgaagaaatcagaaggaggtagcgtgtagttccatggttagaacgcttgcttgggatacataagaccctgagtttggaccaaaagaaaaaaaacgaaaacttggaaaggcaggtgtggtggtgcacccttgtaatccccagcgcttgaaaggctgcggcagaagaatcaagagtttgaggctagccttggctacagagtgagcctgtctccatagagggcctggagattagaacatccctagactcttttcttacactttcaaaattatacatattatgccaggaaacattcctgtgctgtgacgtaattctaaccggcttcatcactatgcttggatgtgattccgtcatagccttccttcactaattgaatacctcgttgttcacttacacacatctgttggagacatgctcccccactgggctctttctaggttttcttgtttcttggtttctgtcttcgaggaaacccactagtttcccagcctggtggttgactataagttcttctgatgactctaatcgctactaattggcagaatgtagtaacatttttgagtgaccagacttttgtaattatagcttccacatcctgagaacaactctgaacctctcagtgattccacttaagctgcctaatgattctataaactgggattattcattctcactgatggggggagaaagctgagatgttaaatgacttgctggagatcgtgtgtgtgtgtgtgtgtgtgtgtgtgtgtgtgtgtatgtatgtatgtatgtgtgtgtgtatgtgtgtgtatgtatgtgtgtatatgtgtgtgtgtttgtgtatgtgtgtgtgtgtgtgtgtgtgtgtctgtatgtgtgtgtgtaaatcacgttattactgtctatatctaggtcttccttacttggggctcatttataaggtacacaagctataaaatgtcctaagccttcacaccagttgtggaagcacacgcctgtcacccctacatttgggaggtgtagccaggacccaggctgggctgcataagaccctgtctctgagagaaggaggagagaaagagggaatgaatgaaaattcagctaaaattcccccactgaacatagaacatttccactcttactaccttggtctatcccttccaacacattccccgtgcatttctattcatataatcttctagactaaaagtggggtgatagaagtgttttatacttgacttttttgataaggagaaattggcagtagatgctgaaccactgggatgatatacaagcttcccttacacacacacacacacacacacacacacacacacacacacacacattcccttatatactagtatattcccttatagactataacatataactagtatatattatataatatattcccttatagactagttaacaatgtgtcataaatattttcccatcctctctcagaaactttcagctatgcatccaaaatcaactatgcatcaaatatcactggagcatcagagctaggatttaaaagtctgttagcctgcttgttttatgtatgacgaactgatgcttggataggtgaactgacttaaagacagggacctagccgggcatggtggcgcacgcctttaatcccagcactcgggaggcagaggcaggcagatttctgagtttgaggccagcctggtctacaaagtgagttccaggacagccaggcctatacagagaaaccctgtctcaaaaaaccaaaacaaacaaacaaaaaaagacagggacctaggagtccagacacctggtccagtttctctccatgccctgcattctgtatttccttaggccacaagtgtggtcgaatcaccaggggcaagcttagggacccaaactcccatctctctgcctctgtctttgccctgttatgagcaagggggtgagcagtttgcaactcctactctccctgagtgccgtaggccaggctcggaactgaatcaagttctcacaggcacagagaggcaatctcaggcccagtggcccctctgtaagatagccaggtcacggacatggggctctccccttaggcccaagtaccacctcccctcccctgccaccccacaccccacccccgcctttcaccaatttccagcattgaaagccagcttcccactcactgctcacccactgacttccagagatctagacaccaacactcaggacagagtctctcgtgtggtcaaaagatctttcccaagaccagctcagccctttgtccccagtccaagggacagggctccaaaagagggacttctgagaggagctcctcccccttgtcctttggtgccatctgtctgtctgctgtcctggcaggagcaatgctactgctggccatcctgctgtcgctggtcctctttctgctcttcaccactgtcctggcctgtgcctggatgaggcacccgtctctctgcagaaagctgggtaagaaggagccgccatccccgccctccaatccccacaagggaggtggtggttgactggagggatgttcaagggcaaaccctccctacctgacaccattctctctgatcctagggttaagggtaactctatcatcctccgctgggacactagggttggcagccccacatggtgtcaggatagaagttagaaggttgggaaccgcaggcctctctcaacccattctgtttttcattttaggtactctgctcaagcggcacccagaggtaaaggaatggaagaagacatccaggaggggcggggctgtgaggtcagggaaggcccacttagcttccattcattcctctgattggttgccgagtgtgccgcggtccagcccccacccccacccccacccccgttctaggcaccagacgtacagcctgagaaagtgcctcctgccctggggtttgcacacgagcgagcagaacaagaaaagaatacagtgccaaggccgggaatcttagagcccttagctagcatgtatctggactccattgccagtgccatgcggggagggggcagggagtgcccagggtggtggctcagtcctgtaatccaagcacttgggaggctgagacagaaggctcaccatgagtttagggctagcccgggctgtttagtgcaattcagtgtagcctgggctaaagtaagaaagcctgcatcaaacaaaacaaaactaccacaacagtaattacacacacacacacacacacacacacacacacacacaccttaaacagcaaccataataaaaatgagatggacagagagtgacagcaaaggatttggggtacattctttttttttttaagattttatttattttatgtatatgagttcactgtagctgtcttcagacacaccaaaagagggcatggtatctcattaaagatggctgtgagtcaccatgtgattgctgagaattgaactcaggacctcaggaagaagagtcagtgctcttaaccgctgagccatctctccaaccccaagggtacattcttttagacaaagtggacagggcttctttgatacactgatgatttgagcagtgagttgaaaaaatgaggaagccaaacagggaactcttgaagaaaatgatctaggaattggaggagcgggaggtgcaaaggccctggggcaggaagcacggtgaggaacaaagacagacaatgagtcaccaaaatacaaggggtaggccatggaaacgaaggtatgatggagtcttggtctctttgatgctggatggttctctctgtacctcttctacagggagaagaatctcccccttgccccgctccaagagccgacccacatttccctgacctggcagagccactcctacccatgtctggagacttgtccccatcccctgctggacccccaacggccccctccttggaggaagtggtgctacaacagcagagtcccctggtccaggccagagagctggaggctgaacctggggaacatggccaggtggcccacggtgagctgggcaggccagagccgggggaggagtagggggaggaaggaagggatggtagctgagttgtcggggaggaagaataaggtccagacggaataaaaagatgtggaggcaagacagaagggaagtctgaaagaagcagaggagtgtgtgcagaaacctatagcagggctgaggctgggactggggctggggctggggctggggctgggctggggctggggctggggctggggctggggctggggctggggctggggctggggctggggctggggctggggctggggctggggcacagctgtaatcccagcactaaaaaaggatttcagagctatcctgcactacccagcctaggccatgtgagactgtgactcaaagaaaggaatgacaaatggcaggagaggctaggaagaaaggagaagagagttctggaagcatcctctctcatcccaccttccctcccacaggtgcgaatggcattcatgtgaccgggggctctgtgactgtcaccggcaacatctacatatacaatgggccagtgctggggggaacacggggccctggagaccctccagctccccctgagcctccataccccactcctgaagagggagctcctggccccttctgagctgtctacaccctaccaggaggatggcaaagcttggcatctggccgagacagagacactaggatgccaagacctctgacagggccaaggaacctattttgccacccgtgcctgagggcacctgggaaaggcaaggagcagagggtccagcaccttctttctgaggctgctctactcaccaggactcacagggtctggggaggctctgagaaatagagccctaagggacttagcctcagacacctcttcagagcagaaccggacactagcaggccacagtgcctgcccaggactctgactaccgcctgagcaagcctgagacctagtttcagacccaccggctcccagaggcttcggccattgagcctcggacacaaggaaggctcgtgacccccgccctgcctctctgtgttctaaacatggcagaggagggagctggtcccagggtcactcgcaaggatatcccagggacctcgcaaagctttgtggtgctcatccctaccttcagaggccttgagagctcatattgcgtggaccaagatagaccctgggggaaggtgaagtcgcgcggaggagcaacccctcccttgctcctgggggagaggatagagagaaggggaggatggggccttgggtagcgttagcatgtgtggaggagagtttgggaacaggagaaaaatgacaagtgtatttatgagttgtaatcacacacgaataaaaacaagatggaggtcctttatttccttgggttttatgtggaaacacactaggccgttaggacaaaaccaaaggcagaggtgaaagcacaaagccctcaaaggcgcttccgggagggtcccggcttccaggttcagacagcaccccacttaagcagcagtggctgggggcttgcctggaagtattctacacacctgcaataacaaccggagtcagtcctcccaccacccatgaggcaggcactctccacaagtgagacagaggcacagacagaggaagtcatttgttcaagccagttagcccagcataaacgactcttcttccacgggtgccatctcagggctttcccagacatcccactgcccctgcgcaatggaaagggttgtctggaaggggtcgtgggtgctcagtagctaccctatgagaggccagcttccgtgctactggtgaagagaaatctaggctggcctcatcctttcagctcagaaggagcagtcaggactctgtgtgtgtgctatcttattttatctttatccaaaaacaaacaaaaagagtctttaatgtctcttgcccccagccgggtgattgtggcatacgcctttaatcccagcacttgagaggcagaggcaggcagatctccccgttcgaggccagcctggtctacagagtgagttccagtgcagccaaggttaatgacacagcacagtcagtgcagagtgagaccctgtctcaggggaaaaaccaaaaacaagaaaccaaacctctcttgtccctttcttagtaaatgcctgctgctcgcacattgatcctccatactgaccagcagagacaaccagagcttgagggattactcagtgcagcttgttcctgccataaaaggcagtcggtatgatccaagtgttaggagctcagtcgctggccttcatcaagccggtatggcaggaaaacacataccccaggagtctgctgggccaacggagtggatgggttatttaaggctgactatgaaaatcacatccaacttccttctgcacacagtgagagcgggctgcatcttcacagacataaatcttctttgtcatgctagagccaaagagcaaggatccttaataattattccaatgtgtttagattttttaaattactacattctgctcaacaaaataaaggaggaggcagagaagatcaaagaaatggccttccagggacatcaggaaggcttggcaggtaagagttggatgccaaacctgatgatgaccaggtctgatctgcagagccatttgactcctgaaaggtgcccgctaatcatgagcacacgcacacgcgcacacacacacacacacacacacacacacacacacagagcaagacagagacagagacagagagaaacagacagagagacagagacagagacagagaacaagaaatgctatccaggcacagccctgtgtgacaatgactgttcaaactgaacattaagcctgcctgcctgcctgcctgcctgtctgcctgcctgcctgcctgcctgtctgcctgcctgtctgcctgcctgtctgcctgcctgtctgcccgcctgtctgcccgcctgtctgcccgcctgtctgcccgcctgtctgcccgcctgtctgcccgcctgtctgcccgcctgtctgcccgcctgtctgcctgcctgtctgcctgcctgtctgcctgcctgtctgcccgcccgcccgcctgcctgtactgtactagtcccaagcaagctccattctcgtctgcattgagtacacagactagttagaaaaagctggcgtcttcctggttagtgcatcatgtgttggcagcacatctgagcgttggaacgttactgtttgtgtccaacaagagcacctcaatgtcttctcaccttttcttgtcaagtcgattcctaggtgtttatcttcactatacaatcagaccactcagcttaattttttgtttcgttttctcttgctttttaaaagacaagatctcactatgcagccctggccggcctagaactcctatgtagaccaaactgcccccttgaacttgtggagatctacgtgcccctcttccagagagctggggtaaaagatggccagcaccaggcccagctgaggacagctcatatttttaactcaacaactatttgattcttttatcatttataatgatttccagttagttctctgagattgtcacctctaagtaataagaagtttatctctgctgtttatttattttttgatagggtctcatgtatcctattccaggctggccttgaactcggtatgtagagaaggatggatgaccctgatgccctgattctccaacctctacctcccaactgctaggctgtgcacctgccttccactgttgagtttttagccttctggtagcctcactatcgaaagcattgtccaaaccttccaaaagagtataaaacagcacggcacatttctatttcagtcttaattttgggcaatttttttggacacgttctctttttaaactttttgaacctgttcttttaatttacatacaaagcaatgggttgcattgtgtcatcttagtacaaatggccaggtacaatgacacagggcagtattgccagcactcaggaggcagacagaagaggatcacctcaagttcaaggtcagctaatcagttccaagccatcaaggactacaaaagtcctgtgttaaaaaaaaataataactagagaacccaccacaactacaatgtgctgcttggtcctatcattgtcccaaacctgggcatgcctggggagagggaactgtaatggagaaacgcttccataagattggccagtaggcatgtctgtgagttattctcttaattagtgattgatgtgggagggcccagcctactgtggacagtgccgcccttgggcagatggtcctgtggagcaggctgcatgagccatggaaataagccagaaagcagcactcgcccctggcctctgcttcagatcctgcctctatgttcctgccctggcttccctcagtgatggatttatgagccgtaagctgaaatacagtcataatgttttatcacagcaacagaaaccctaaccaagacaaataacaaggaaacagcaaaaccaacaaacaaaaagtatatattttggggtccagagtggttcgctgctaagaacactagtggctcttacaaaagatggagggttaattcccaacatgtccaccggcagctcacaaatgcctgtgacccttgctctagtggatcggattccttctttggccttcatgcatacacatggtgcacgcacagacaagcaagagctcaggcatgtacataaataaaaataggttgttttttttttttaaatgtaagcacacatgtaacatcatagcaggaccatccctgcccttaagccttttcttgttcaacgggaatttaaatagatgtatctatctgtctatattaaggaaggatccacgcctaagcatttcgtgcaaatcagatggacagagattagatctaatggagagactgggcagagcgcctgcagctggaagacggaagacggggaaagtgggtgatctgggatggactgtgcagagtgccagccgatcagcacaacacaacaggatgtgctgatccgccggcagcccggctctcattctgtggacttggcctgatggtttattaaattaatctgagccacactttcgaagttcacatttggaaaacattaagtacgtattttctatgtagcagtcatgttcagataaaacagcctctaaacaaacttggctgagaacttcctggagtttatgtagtaatcaccgagagatgagcgctgaaaagcacggaactggggtctggtggaggctggaaggaaggtcaggaaatgcttcctcagaggagttctcgagcgagtgacctaagggacgtgaaggttatcccgggtggagagccttgaagatgcgcgagtgctctgcgcagaggccctaagatggacccattggcctggtgctagggagcttggtccccgggagcggaagcaggagaggtaaacaggaagtgggttgttcagtagaacaaacttacaaactctaagtttgcaaaaaccttgtaaagttggaacttcaccgggggatcagtaagaaaccactaaactttttcccagtgcagtaaaatgtgtaaagtcagagaccaaaaggctggtgacagttccagggactctagccagccccagcgtggcaaacggctcaggcaggccttgcccttctcctccattccctctgccttgcttgttacattgcattcctaaagccagcccccaaggtctagtcccttatttggccacctcctcctcctgaggccaaacactgaggtccagctttcaaagtattaaggtccagaaatcaaaagccccctttggctcatcaatgaaactgtcaaatcaagattaaacaccttatccataacacgggggaaatacttttggtcttttgttatgttttataaaaagaacgaaagaaccaggaatatgtttggtagagtcatggaatggtgaggcagaagggggtgcctctatgggcccatgctgagacatcccttccccctgagggacaagccacaggacggtatagtatagaatagagtttatttaggccatggagaggggaattgagggagtagagacagagaaaggcggaggtgaaggggagaagtagagactggccaggaacacatggaaagggggtggggggggatgggaagagaaggggcagagagggaaggaagagaggaagagagtgacagccccttttataatgagtcaggcatacctggctgtcaccaggtaactgtgaggcagagtctacaaggaatgctaacacctttccctttataaactgccattttcctaagggccatgtctgtctcctctctatccagaggagtattttgtccttcccccgccctattctgagacaaagacctctttcccttcttccttgttctctgttttcccctgccaccccatctctctcttacacacacacacacacacacacacacacacacacacacacacacacacacaaacctctgtgtaggctgtcccggaactcactctgtagaccagagatccacctctacctgagtgctaggattaaaggcttatgccaatctcttatttcctgcccttttctcctctggggcaaagaactctcctttgttctgagaacttggtcttggagctcctgatcctacactggtccctttcaacaatggcttagggagtttaaccccttgccacactgtgtactcttaactgctgagccatttgtccagccccttgcaaaataaaaaatttaaatgttaaaaattatgaagtccgttgcacccttatactcttataagtatcctaggatatatgatttcatgggtctttaagatttaaaaaattttattgttttcaattatgtgtagactatgtgtctgcatgtgcctatgagcatgtaagggcaggtgtccacttaggccagaggcaacagattccctggagctggagctacaggtgactgcgagatgcctgaggtgagtgctgagaacagaatggggcccctgagaaagcagccagtgcttttaactgctgagccaactctccagtgccatcgctcagtcattctcgttgctggaatcccaggagacaccaggatgtggaattagggtatactatggagacatccactttttctcttcatctgatactgaggatggaatccaggttgcatgctaaacaaacattctactactgagttacaaccccagaaccatagtgattttcaaaatttctaatattgtcattcatctgcccagactagcttcaaatttgtggtcctcctgcctcagcctcctgaggagctagaattcaaggtgtgccaccacttcgagcgttcacaacttatcttatttatggattattatctctgcacttggtgtctgatgtggttgtcatcagacaactctatggagctggtcctctcctgttcttccttatgtgggtccgaggcgtggaactcaggttggcaggcaccaggcttacacagccagtgccttagcctgctgagccatcctgctggacctttctttttatttttcactacttaaaaaaaaatgtatgaattaagggacaggtagatggcttagtgactaatggcacttgccaccaaggctgacaccatgagtttggtctttccagagagaagcaacttctataggttacattctcaccatacatgcacatacacgtgcacacacatacatcaaacaagcaaacagatatgcactgtgaatcttgagcatgccagaaagcaatctcactagctttgcttacacataaggtacagattattttatttttcagttttagttttagacaggccctaagcctcacatgtatagctattctttttgcctctccctcctgactgctgggactataggtttgtgtgtttcaccatggtgtgtgtgtgtgtgtgtgtgtgtgtgtgtgtgtgtgtgtgtgagatgttgaaattacacacaggtctcaaacatgcgaagcaaactatcactgaactacactgcacttctacatattttattttatgaacttttactatctatctatctatctactcattctgggggtgtttgttgtgtgacaagattcttcctggggagacagaacacacacaggtctactcaccccaaacaggaagcccatcacacatagaagtatagatatcaccaaagtccaacttggcgaaccaatgagttttattggggttacttataggaataaaggctttattagggttattaagttaatactaggttaattaaaaccctataagttagggttttattgctgagaaaagatatgaccatggcaactcttataaaagaaaacatttaattgtggctggcttacagcttcagaggttcagtccattatcatcacggcaggacatggtggcacgtaggcagacatggtgctagagaaggagctaagagttctgcatcttgaaccacaggcagcagcagaagactgtatgtcacactgggcatagcttgatcataggaacatcaaagcctgcccacacagtgacacacgtccttcaacaaggccacacctcctaatagtgtcacttcctatgggccaagcattcaaacccgtgggtctatagcctatcccagcacaggtagcaggtaacgctcacagagccaggaacttggagcacgctgcacatctgcaggcaactcagcagctgggagggttgtgtgagaatggcttccagcaggcttcattgtttactctgggaaggagggacctagtgaatttgctcagcttcagggacatccagaagctgttttgcgttgtttgccttccggtttatggagcttctcggaaggatggaatgtttcagtcgcagagtgtcttgtgcgcacatcacagtgcacacatggaagtcagccaacaactcgtgggactcatctctctccttccgccatgtagatcccagggataaacagatcctcctcaggcatggcaggaagctcctttgtctgctgagccaacacaccgactcagcctttatatttttaagatttgttttatgtgtatgactacttggcttgtatgtatgtctgtgcgctgtgtgcatgcctggtggcctcaggtcagaagagggcactggccggacagtggtggcgcacgcctttaatcccagcacttgggaggcagaggcaggcagatttctgagttcgcggccagcctggtctacagagtgagttccaggacagccagggctacacagagataccctgtctcaaaaaaaaaaaaaaaaaaaaaaaaaaggcactggattccctgtatctggagttacaggtctgtgtgagctaccatgtgagtactgggcatcaaatctgtgtcataaaaagaacagtgagtgctcttaactgttgggccacccctccaggccctgttattgttattattataattttatgggtgtttttttttgagacagtggtgtttatatttcaggggtactaggacaaaaccaagagatatacatacactaggcaagttctctaccactgggcaacactcccagcatttcttcttacttccctcccttgcatgcacatatatgcacatatatattatatatgcaatacatcatacaaactatatctatatccatattgatatagatatgatcttgctgtgtacctcaaactggtctcagactcttgatgttgcagcctccgtctcctaagtgctgggatgaaagccctgtcccactaagcctaggtttttgttcctcttaggcgagtttaacctttgtaccctggttagagagccagattaaaagaaacagacttggttttttttctccttatagaaagaagacagaaaagaaaacatacagcatagttccattcataaagtttaaaaaacctagactacaccgtttagaggcacatatgtaagtagtggagtgattctaacaacatgcacacacagagacacacacacacacacataccagggaatgagaatcactcaggtctcgcggcttcaggaaggaggaagctagttatgattacagaggggtgtgtgggtgacttctgaacttcaaataatgctcctttctttggctaggtagtaattacagttatttcacttttattcagtagacaacaataatcagctaggatacatatttcttaccataaaacaaaaggcagacttgaaccatgtagagagagatctgaattagtcacttctgagcatcttgagatgaaggtattcaagatttaccttcagcatcttagccatttagatgataactgaagaggaccatagacctacgcacagaatgagggtaagaagagaaagatctgagccaagaccacatggaccccacgttcaacagacagtcagatgacaaactaacaaaccatcccaagaagcaaaagccaaagatggaggagggaaagctagtttctggggagaaaaaaatgctttatgcagaagggcgtggtcaacatcccaaatttctgtgtgacattgctgaggagaagtgtttcctcaatgcaagtgttgaagctctgaagggaaaggtatccaggcagtcaggagccaaagaataccacaaaatcacacagcacagcaccataaacacagatttattgggaaagacacaagtggctgcctcagctctggggagaagctgcagactgagtagaaggcaggatgatatagggatgggggtgtccggggcagagattggtgggatttcaagtcctggggttaggtaggctcagtaattggtaggtttttaagctcaggcattggtaggtttttgagctcagggattggtaagttttcaagacctggaagtgagctcagactctttattattaataaatatccagaggttgggaaaagggccagcattatcgttaaactacttcctgcagtatagggacatcgaagtccatggggcaagtttgatcttcaccatcaaggtgtaattggggttatagacctctggtcccatagttagggcctgataatcctgtaatagcaactgattcaaggtctaggcatcttttgagtttgaattgaaaagaactagacaagaattttataagacagggtgccattagtaggactgggaaaaagaaggatgaaggagcttaagaaagacagtatccaatcccatactggactgccaatgatccaccggccagaggcattgagctatttcttatatttttggaaatccatccagagttgtcagatcttagcttttactatagccatctagttgacacaaagtgacattccttctccctgaggaagagacaaaggccacttctctctgctgttagtacatctaacccttgtcagttttgaaggggtagtcagcaagtcagtttgtccctggagggtgaggacagtctgagcc

SEQ ID NO: 938 - DNA, 2078 bp, Mus musculus
ccggcgctggagccctggaggccaggcccggccgctcccggcccccgggggcacgtcggcccagccgccaggcttgggaagtcgtggccaacgctgctcaggacgtccgggcttcccaccttcctcctaggactccacccggtctggtcagccgagccgaaaggccgccatgcgcctgccccgggcctcctctccctgcggcctggcctgggggccactcctgctgggactcagcgggcttctggtggcctctcagccccagctggtgcccccttatcgcatagaaaaccagacttgctgggaccaggacaaggaatactacgagcccatgcacgacgtctgctgctcccgctgtcccccaggcgagtttgtctttgcggtatgcagccgcagccaagacacggtttgcaagacttgcccccataattcctataatgaacactggaaccatctctccacctgccagctgtgccgcccctgtgacattgtgctgggctttgaggaggttgccccttgcaccagcgatcggaaagccgagtgccgctgtcagccggggatgtcctgtgtgtatctggacaatgagtgtgtgcactgtgaggaggagcggcttgtactctgccagcctggcacagaagccgaggtcacagatgaaattatggatactgacgtcaactgtgtcccctgtaagccgggacacttccagaacacttcctcccctcgagcccgctgtcaaccccataccagatgtgagatccagggcctggtggaggcagctccaggtacctcctactcggataccatctgtaaaaatcccccagagccaggagcaatgctactgctggccatcctgctgtcgctggtcctctttctgctcttcaccactgtcctggcctgtgcctggatgaggcacccgtctctctgcagaaagctgggtactctgctcaagcggcacccagagggagaagaatctcccccttgccccgctccaagagccgacccacatttccctgacctggcagagccactcctacccatgtctggagacttgtccccatcccctgctggacccccaacggccccctccttggaggaagtggtgctacaacagcagagtcccctggtccaggccagagagctggaggctgaacctggggaacatggccaggtggcccacggtgcgaatggcattcatgtgaccgggggctctgtgactgtcaccggcaacatctacatatacaatgggccagtgctggggggaacacggggccctggagaccctccagctccccctgagcctccataccccactcctgaagagggagctcctggccccttctgagctgtctacaccctaccaggaggatggcaaagcttggcatctggccgagacagagacactaggatgccaagacctctgacagggccaaggaacctattttgccacccgtgcctgagggcacctgggaaaggcaaggagcagagggtccagcaccttctttctgaggctgctctactcaccaggactcacagggtctggggaggctctgagaaatagagccctaagggacttagcctcagacacctcttcagagcagaaccggacactagcaggccacagtgcctgcccaggactctgactaccgcctgagcaagcctgagacctagtttcagacccaccggctcccagaggcttcggccattgagcctcggacacaaggaaggctcgtgacccccgccctgcctctctgtgttctaaacatggcagaggagggagctggtcccagggtcactcgcaaggatatcccagggacctcgcaaagctttgtggtgctcatccctaccttcagaggccttgagagctcatattgcgtggaccaagatagaccctgggggaaggtgaagtcgcgcggaggagcaacccctcccttgctcctgggggagaggatagagagaaggggaggatggggccttgggtagcgttagcatgtgtggaggagagtttgggaacaggagaaaaatgacaagtgtatttatgagttgtaatcacacacgaataaaaacaagatggaggtccttta

SEQ ID NO: 939 - protein, 402 aa, Mus musculus
DSTRSGQPSRKAAMRLPRASSPCGLAWGPLLLGLSGLLVASQPQLVPPYRIENQTCWDQDKEYYEPMHDVCCSRCPPGEFVFAVCSRSQDTVCKTCPHNSYNEHWNHLSTCQLCRPCDIVLGFEEVAPCTSDRKAECRCQPGMSCVYLDNECVHCEEERLVLCQPGTEAEVTDEIMDTDVNCVPCKPGHFQNTSSPRARCQPHTRCEIQGLVEAAPGTSYSDTICKNPPEPGAMLLLAILLSLVLFLLFTTVLACAWMRHPSLCRKLGTLLKRHPEGEESPPCPAPRADPHFPDLAEPLLPMSGDLSPSPAGPPTAPSLEEVVLQQQSPLVQARELEAEPGEHGQVAHGANGIHVTGGSVTVTGNIYIYNGPVLGGTRGPGDPPAPPEPPYPTPEEGAPGPF

SEQ ID NO: 940 - DNA, 27411 bp, Homo sapiens
ggggtgctaggatggctccactgggcagggacgccagtccagtaagctggaggctcctcattttgccagcagtgagctctacctgggacaggggtgtcagttcccaccctcaggtctgaggctctgcctgcccagcgagcacctcagcaccctggaccacccttccaggcgcaggcaccagggaaggggcagagggactaaccgacctgtagggattgagggtgcagatggtcactgcggggaagacgagcttgtccgagttgaggttgatgttgaggctgacggggtagctgaagtactctccgaaaagcaggccgaattgccagtacatcatgccaaaggtgcagagccacagcactgcccagaaggccgtcttcatgcggttgtgctgggagcacaccaggcggatggcgccgtggatggtggtgttgttgcagaagaactcgaagagctctcggtaggagcggtggaactcgatcagggcctcctcctccgccgtgggctgctggggcgccgcaggttcggggcccagcccctgctcctcacgcttgttccccttcatgagccctggagtggactgtggagggctagagtcctgctcctccagcttgttcccctccatgagacctggtatgggctgcagaggtctagggtcctgctcctccagcttgttccccttcatgagccccggagtggattggggagagcaagggtcagggtcaaggctgagctctgggccctgagtgccctctcccatcacccctggaacccgagtgaggctgcccctggccatgcccatgtcccaccctgcgcccacattctcccactcctccctccctcctccacctttcctggagccagcagacctgcgggagttggggccaaaagtgccggagctgggcttccctagaacggcctctcctctgcttccctgatagggccacctttcgagttttgtcctagcacctccctttctgtctctgcccccttcctttggtcttcttcctccaggatctgtgtctcagctcctgcctctcactccctctctatctgccttctgtttctctttgggtctctcctgctctcctctttctggcctgcctcctctctctaatcctgcctctcttcctctcccccccttgccttgccccctctcactctaggccctcagctccagcctctggccctgacctcgagctgtgtcctgattctgtctctgccccaggactgcagggctccaggaggtctgggctgcctccagcttcccactcccaggttgcggctggactgggactggttcctttccagttgaatctggcagccaaacctctcctccccctcacctgacaggtgcagcggcctggctggggagcccgcccgctggccggccagggatggaagcgacaggaatctcattagcatctcaattaaaggtgagcagggcggggggaggggctgaggaggagtcagagccgggagttttccgaaggaaggagggctcccgagggcaggtgaactgggagtactggacctgagaaggcggactctgggcaggggctttagacgcagacaggcaaggaggctgggggacaggatggcaggtgaggggcaaagatctgaacaagtagaaggatcctgagcccacagctaggagggcaacacaaggagaaggggccagccaggctgagagggcctgggtggggaaccgggaggacaggagggcagaaagagggagacaatagagagggacagcgaaggacagagagatagggatggaggaggggcactgagtgagtagaggcaggtggggggcagtggtgggggcaaatagaaggagccagcaccaaagggagtctgtctccaggaaggagagcaaggggggagtcccaagtgtgcttccaggagctagaggctcagcaagtgggcagccctccaagggcacccacaggtcagcctcaccctcaggccctgcagagaagagagaagaggtctctgcaggtctcctccccgctcactaagtgggagcagcgcactcaggtgggatgcgtctgcctcctcctggtccctcctctttcctgctgattcctcgccaccccctccaaccttgtccagacccgggaggggcccaggtgaagctgggggctaggcggggccctaggacattctgttcttttttacactgttggctgccaggccaggaatgtgtaatcgcccctgctgtggtcacagagttgcaggaatgtgggcaaccagaggcagcgcgagggccacgcaggacactgtggacacagacccggagcccaggaagaggcagggaaagcaggcactgaaggtgcagggaggatgtggccagcgctggaaaggaagagggtgggcatggcacacgcctagacaggccctgggaggaggagaaattcgttgatgggctatattttctccaaaatctctttccaaacttaatgcagcaaaaggataaggagtggagtgccaagtggtgagcaaggagagagaggagggtcagagaatcagacccaaaaagggctggaggagactcgggagagccacccacacaacccaggccctgcacgcggcagggaaggctgccgcttcctcacgggccccacaggaggcagcccagagtgcaggaatgtggtcactggcttgtcctgcctccctccacaagccagcagacaaaggcccagcctgagcattgatacacaccgggggaggagataggcctgcaatacaataagataaggtttctatttgtacactttaaaagattgtctttaaaacggacttctaacaaaagtgcagatctcagatttctcagagataagacataagagccaagggctaggggagcctaggggctcactgcaggagactcaggaagccttcccagagaaggtgtcatctctgctgaatcttgacaagcaaggagtttagcaggcaaagaagagaaaaggcagtactccaggctcagggtccaacctggtctgtggcttcctctcttgcggcagtctcttgcgacttcttaaagtgaaagccggtgtcaaccaggattccaaaccaggttcccttgcttaccttgatactgctcatgatacctccccttggaagggacagctggatttttcttcattgtcctaatgaagaaactgacccttcccaaggataaatcagttttctgaggttagaaaacaaaataggagcagagctataaacagaattcagaattctcctcctcctctggggctatctacttagcgcttttgccatttacttcctgagacagactcatgggggatcggggctcaggtgcacccggatgtgaaagccgggaaggcctccctcactcccacacagagcccgtggattcgtctgctctctgggtgctgggttatctccttggctctgtgaaaaggtctctgcactgtccccactgccccacatatcccagagacccctagaaactccagtctcccttgagccaggtccttacattgggcatggtcctccctgcaataaggtgctcagcaccctggctgtttgatctcaaaggttctgaaaagcacctccctgccttttctatttgccagctcatgcctgaaatccaaccactagcttaaggcagcatggcaaatagttttcatatcaagggctctgtgagaagaattgcaatgcctggtctgggctgagccaaagggtggtgaccctgccacgtcctgccgggtatgggagtggcaatgcgagcctagtgctgcagcattctagacctggagcgggctagaacaggcttggtgttgtgaggaaaatagaaatctgagacctggactttggtcagaagtccattttaaagatgatcttttaaagtgtacaaataatacacaaatatgtttttgtcacagtacaatttttcagcaatacagaagtatatagagcttcccttagtccccttcctttccctccccaaaggggagccaccataatttgtatatctgtctatatctttttgtgtgcctttataaacttacatgtatttttaaaaaacaaaatatatagttcttttttatgacagagaccatgctataggtatgtttctacaacttccatttttgcttttattttcttatttatcttagagacaggatcatgcactatcctctaggctggagtacagcagcatgatcatggctcactgcagcctccaactcctaggctcaagcagtcctcctgcctcagcctcccaaagtgctgggattacaagtgtgagccaccatactcagcccctatttttgcttttaaactatgtgactttgagaaaggcacttgacctctatgggccccggtgatcttacctgagaaaatgaaagggcaagaaggggtgggtaaggcaacccagatgggcacaaagactttttccagctgaccttgcatctagccccctgcttcatgcatgaggggactgaggcccacagaagcaaagtgacttggccacagtcacccaggagttaggggtggggtcagactgaaaaccaggccactcctttccaagcccagttctccttctctgactttgagagaagtacagttttgttctataagaagtcaagagctttgtagactctgtcttggaaggaccccctgccttcccaggactacccccagactcccccagagccccagcccttcccgccaacccagggctgccttcccctcccaacaccagctatcctctaaccctgtggtgtggccataaaatatgcacggctgcagggagagaagtgaaaccagaggggctgccatgggatgagggttatgagtgcaaagggtcttcctgcctcttgttctccgcggacaggagatgacggaagtaatcactccaccctcctagggagagcctatctctgcacttaccactgtttactattatttattattattatttactattatcctgatgtatgtgtgtttgtacgtatacatccgtttggggtccctgacttcccgcaacacaaggacagagaccaggcgtattcatcttggtgacctcagtgtctagcggtcactgtttgctgacccagtctgcagaagacagcagaactggcgtctttcctagtttatctttgacagagcgggatatgctacgaaaaagcatctgcaaaacttcaaacatcctaacttcctctgacaacccatttatttgtggtctattaatttatctaaattttcttcacttttccctgttcacttctatcctttccaggataagaatcagttacttagttaaatgcaactctttattcttactacttggagctaattagccacttcacactgggggctgcccactgtggaagacaacagtcctttcagctgcccttatgtggtacagatttctctttcatttaaaatgatggaccagaaaaatgccactcttcatctagtcccctggcagtttacttagaagttcactactagaagttggccgggcatggtggctcacgcctgtaatcccagcactttgggaggccgaggcgggtggatcatgaggtcaggggatcgaggccatcctggctaacatggtgaaaccccgtctctactaaaattacaaaaaaaattagctgggcataagtggtgcacgcctgtagtcccagctactcgggaggctgaggcaggagaatggcataaaaccggggaggtggagcttggagtgagccaagatcgtgccactgcactccagcctgggagacaaagcaagactctgtctcaaaaaaaaaaaaaacaaaaaaaaaaacaaaaaaagaagttcactactagaagtttatcactttgattgaagacagggtttatcaaccttggcactattgacattttcggctgtatcattctttgtggtgggacaggatgattctgtcctatctacaatcctgtgcaggatgttcagcagcatccctggcttccatctattagatgctagtagcacctcctgagtcattgtgaccaaaacatctccaaatattgccaaatgacttctggggggcaaagtcacccccgttgaaaagactgggttaaggcattgtcaccactgaaaatgcaaatactctggaaaaggacaaccctcatctgttatgcacttctgggtgtttgccagaccatttccaagagcactagtcagctaagagcagagtggagaagaagagagaaagaaaaagtatttagaagaatccattcctggccgggtacagtggctcgtgcctgtaatcccagtactttgggaggctaaggtgggcgaaatgacttgagaccaggaattcaaaaccagcctgtggccaacatggcaaaacaccatctctactaaaaatacaaaaattagccgggcctgttggcgcatgcctgtagtcccagctactcaacttgggaggctgaggccaggaaaatcacttgaacctgggaggcggaggttgcagtgagctgagattgcaccattgcactccagcctgggcgacagactgagactctgtctcaaaaaaaaaaaaaaaagaagaagaagaagaagaagaatccatttccatcagccccctttctggatgcctaatgggcctgtggaaagaaggctctctcagcagctccttcggaagaaggcctgggagaagagtcccaccctcacacaccttctaggcgtcctggggtgctcggtctgggtctggtgttgcccagtggaaatcagtctcaggaggctctggtgaaaaacacaaaaggacaggagtaaagacaatgccctgcccgcggtgaacctgtggatttctcacccctggagtctccctttatcctcctggggatggctgggcattatagtagccatttattggtaagatttgtctttcgtgatccagctgggaaacaagaaacactctaagtctttcaaacagaagaagtttaacacagagaactaactggtacatgggtgatggaggagctgagaagacaatgggaggcagctcagaaaacagcagagcgggaagcagctaccatctctaggcctggaaagatggcagggtgatgtagcatcaaagaccaagaagcctccagagccatttggcaggaactaaatagtgtggactactggtaggagatgggattatggaagtggggaaggaaggaagacaaccaactgcaggtgaagccagaaagcagagaggagagaaatagcctggctgcttcactcctcccatcccacctccatcccacagacctgcaagcaaaccagtagctgactgacacaataaagaggcacacagagataaagtgatggggccaggatcaaaacccagatctcagggctcgttccttagggtgtagagagtccatgagggctgaagcgccagcttacggctggcagcagaaagaaacatacagtccagccagctggggttaaaaggggtctggacatagtggttacctgtgaagcaggaagctttgactgggaagggcatgtagcaaacatttgtagtgcaaggaacattctggggccgggtgccgtggctcacgcctgtaatcccagcactttgggaggccaaggcgggtggatcacaacatcaggagttcaagaccagcctggtcaacatggcgaaaccccatctctactaaaaatacaaaaatcagccaggcatggtggcaggcgcccgtaatcccagctactcgggaggttgaggcagagaattgtttgaacctgggaggcagaggttgtagtgagccgagattgcaccactgcactccagcctgggcgacaaagcgagactctgtatggaaaggaaaagagaaaagaagagaagagaagaggtgttctggaccagttgggggatatgcaagaatacacaaaagtgaagactctctgagctgtatctgtaagatcagtgtaccttacggtttcattgtattatatgttacacctctattaaaagaaagggtctcagcagcataagacagggtggggaaaaaaagaaaaatagaatagagaaagagtccctgtcttttagggtaaaatcctgaaatattttcaaatgaaatgatatgatgtctgggatttacttcaaaataataatgagggatttgaagagtgtgtgcgttggtgggggagggggtatacagaataaatgaaactgacagtgagttgaagctgggtaaggagtatatgggagactcccaatattactttttctcttttggtatattatcttgcatgtggaatttccacagtaaaaagtaaaaagaagagagagaaaaaaggacctagggtcgctacacacacattcctttacgcgtttaagagctcagcagggactctcatcccagcccccagcgctagggccctggaaggctcagcagccccgcgcagtgcatgctgttctgatacttctgccctttccagccatctttggcccatctgtacggtgagctgcctgcaccaggtgaggggagagagcctcacagagtgaaatgcctacagcctaggcaggtcctttcccccttttgtgacctctcctccccatgcacacttcccatcacctgcacctgtccagacatcagacctgaagttagacagaccagtgtaaggatgagtgctgaacagagtccttcagggagggggatagtgcccaagtgacctatctcaagagaagttagcccctcatcccaagggagacatccctgagccacaaggagttggcaggactgctggaatgagttgggacctagacatcaggagacccagattgtagctggctctgcggtggactggctctgtgatgtggccatcactcatttattccataaatacctattgggcacatggtatgtgccagactctgctaagcatggggaacacagacttgaagattcagcctgggccatggtggcactcacagcctggtgggaagcaaacaagacagccaggtacagagggcagtcttcacggggactgtgcaacctagggcagaggttgccttccagagcctcagtgaagcctcaaggacaggtgggagttaggaagacggaaacttggggaccagagaaccacgtgtaaaagggggcagctgcaagtaactccacgggtgggtggggtgttgggttgagggagatgggaggatgaaacagggcaggaacgagaccaggccaccctggaatcccggttcccttatgtatcacccttagcctccctctccatgcttaaggtgagggggctggactgcgtgggctctcagctttctccagttctaaggggtttgaaggttcatgggcaaagaagccagagcagagggcctgagtgcccaggtccagcctgctggccccaggactcccctccgcatatcctccccctctctttgggagggaggttccctgaggacagggagcagggcaagctgcacagctctcaagggtctcctaggtgacctgtgcccactcctgtgcggattgggctgggttggtagcgtggggggctggctgatttgctagtcccttgtaatttgtctgaaaaactcccacagtagggcaggacaacgggggaggaacccgggcatctgccagccggttctcctcggtctcagagctgcttctgcggccttgcagtccccgcgccctgccctctccatgactgcccgtcctgggcccctcgctttccagatcccgcacccagctgtcccttgcgctctctggaactccctctgctctccctgcgaggcttgtccaagggctgaccccgggcccgccgcccttccctcggctgggccagggctgtccgcagtccgctctcccgatcgggcttccgaagaagggaggaggccggttccggccccgcggccctcacgtgctttcccggccgcccctcccgccccgcatcgaggcagacaagcctgttcctcttccctgggctgcgattgcgacaggccggcctggctcccagcgctccctgtccccgccccgcggccagctcgctccactcccacttcctgagctccgccatgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgaggaaggggcctggtaggagtgggcgagggtgggcaagagggatctgggcagccgtcgctccattccctctgccctcccaagctgacccctgactaattcttctctcctcttctccatctccctttgaaggtgcctccatatgcgtcggagaaccagacctgcagggaccaggaaaaggaatactatgagccccagcaccgcatctgctgctcccgctgcccgccaggtgagaggcaatggcaggacgaacctgggcctcggaagtgggtcacgggggctccagccccctcgcggcctcagagggaaggtgggcactgtcccccaggaaaactggctgctggagacgagcgtgggaaaccctggacatcacgtggaggagatgggactggccctccccactgggcctcctctttccttacctcactgagagggagccggagggccactggcaggatgatggggggccagagagaccgagggaaaggccagggtcacactacaggcagcggaggtgagggtggagcctcgtctcctgaggctctactgctccactcacgttctaggcacctatgtctcagctaaatgtagccgcatccgggacacagtttgtgccacatgtgccgagaattcctacaacgagcactggaactacctgaccatctgccagctgtgccgcccctgtgacccaggtgagtggggatgtgcctgcgggggggctggatcccctggagcttggcccctccctgagccctcccgtctccccgccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaaggtcagaggtccctgaggggctggatgtgaaaaggaggctgggtgccagggatctcaagtgggagcagggaatatggtactgtgtccacggcgaccccccagatccttggcttaaaattcctcttctcattccatgcagaggctcacagaagggttctggagggacatggaactgggacaggtgcaggggacacaggaggtggttcttctcagtactgggaagcttgggcaaaatggtaggcagtaggccgggtgtggtggcccacgcctgtaatcccagcactttgggaggccgaggtgggcggatcacgaggtcaggagatcgagaccatcctggctaacacagtgaaaccccgtctctactaaaaatacaaaaaattagccgggcgtggtggtgggcgcctgtagtcccagctactcgggaggctgaggcaggagaatggcgtgaacttgggaggcggagcttgcagtgagccgagatcgcgccactgcactccagcctgggcgacagagcaagactccgtctcaaaaaaaaaaaaaaaaaaaaggcagcaaagcagagcttgggaaaggtgagagctacgcaatggggtggatgggcatcctgaggcttaaaggaaactcacaggccggcaaagggcccctcccttttgcccattcaccctggctggcctgcctttctcttgccagatgaagttgggaagggtaacaaccactgcgtcccctgcaaggcagggcacttccagaatacctcctcccccagcgcccgctgccagccccacaccaggtgagtgcagccccacccaagctccttccaccctctgagaagcctcagctgctaacaacccccagcgcctatccttgacaccacggactcgactcaccactttcagcctccccgcctgcccagtggagtcgggacactggtgggccagggcgtgaaaaggtcatcatctttttttcctctgcaggtgtgagaaccaaggtctggtggaggcagctccaggcactgcccagtccgacacaacctgcaaaaatccattagagccactgcccccagagatgtcaggtgagggaccagggctgagggacacaggggggggcgcctctgaaaatgccttaatgctccacatcttaaaaaaaatggggaaaagatgaacacttccctcccagaattgggcaagaagaaagttccttacagaaaaaattggagtatctctaggctagtttacacacacacacacacacacacacacacacacttttaaaattatatatactgtaatactatgtcaaggaacacatcccacactgagatgtaatgataactactattgtcatcattttgggcttaccaacattacacaatccgtttttttttttcacacaatccattaactagaccaaacacctctttattagactatatacttttattattagacagaagattcccatttgactctttcttgactgtttcctgtggactgattggcttgctagcctagtagatgactattgtttctaatgactgtaacatcactaattggcagaaggttcactgtgtgtgttgggcactctgtaaccactttacatttactaactcatttaatcttcttaatgatgctatgaagtagattctattatcatcctcatggactgaaggaagaaaccgaggctcaaagaggttaagtgatatactcaagatcacccacacaggtggtcactggtgttattagaacctgtactcaggttttcttactccagagcccatgtcataatgcatgcactatagaaaattagagacttcagataagcaaaactaaaaactcacccacagagccactacctagaatatccactcgttacattgtggtatatatcctcccggacattttctatgcatgtttatacatactgggttttgttgttgtttactaaaagtgaagtaattttaatatttcgtaacctgattttttcattccacaatctaagtatttttctgtgccctgttaatttttaactatgtatcaaatacaactggcattttagagctggaattttagagagtatgtaagctaacctcatcctatatatgaaaaactgatgcccaaagaagtgaaatgacttaaaagtcacacagccgggcaggaaaccgtggcccagactcccagtccagtttctccccaggcctcccatcccatattcccttaggctacagatttacatgaatgagaagaggcaaaatgcccagcatagaaatgcgggagtcctcccgcccttccccaggcgtagctgacggacactggaggctccatgctattgctggcagcactggtacccagagaaagagaaattacccactgctacagatcacagctggagaagccgaactccagcctctctttctcttcccctcctagaacctgccctgagcaagggggtggagaacttgcaagccctgctctaccaggcggccacaggcagttccgaagcaagtttccctactctctcacccctgtaaacacccccacaggtacaggtacagcagggcaaccctagctcctctacagcagcccctctgtacaatggctgaggccacagaaatgtggctctagcctgtgtctgtttacaactccaagtcccacccttccctactgtctcccaatcccacttccagaccttgaaaatcaactgcctaagctcccatcctgcacacgcaagcctgcccaatcctggtctctgagcaggagggcacccacaccacccccaaacatgcccatccatgatacagtctctcctggctgccaagaggtcctcaagtccaacttagttccccttctctataacccaagggaagtttctctcattctgcctttaggagctgcattgtgtctagaaggaaaaaagctgctcccttttctctgtctgggttgcccagggatctggaaagctcttccttctcctcctcccctctgcccttcttggggctgtgatcaccctcctgtctgctgtcctggcaggaaccatgctgatgctggccgttctgctgccactggccttctttctgctccttgccaccgtcttctcctgcatctggaagagccacccttctctctgcaggaaactgggtaggaaagggttggatgcagtggatggttggcaatgggagccggagggaggaatattcaacttccccggtgcaaccctccacaccctcaagactcccaatgcctacccccaacatagacatccttatcttcatccagctgcttattctgaggctggagatgagagtgacagtggcttgttcctctgggcccccgggtggtcaagttgctacacattgtgctgggatgtggaggctgaaaggctaggtctgaggcctgccggggagcctacacccatttcattctccattgcaggatcgctgctcaagaggcgtccgcaggtaatggcgggggctgagaaggcagcaagaaggggaagaggtgatgagggtacaaggtggagcagacaggaagagagtatgcaggctgactccacactcattcattcattcaactgatgatttactgaacatgccacgtaccaggcactgtcctaggcactgggcgtacagcagtgagcaaaacacagtacctcatttcctggagttcacatgcccatggagcaagaataagttaaactatatatcaggtggtataattgctaaacaaagcagggaaggggtcaatgagtgacagtggcaaaggatgggggtattttagacagagtggagagtgaaggcctctctgagaacctgatatttgagcggagagctgaagaagcaaggagccagccatggggttatctggggagaaagtgctccaggaagagggagcaaccagtgcaaagaccctgaggcagggggcatggggaggagcagaggcaagtggtgagttgccaaagcatgcggtggggtgtgggaactaaagaaagatgagccagcctgggcaacacagccagaccccatctctacccaaaatgttgttccaagttagccaggcagggccaggtgcagtggctcacgcccaagctcccatcctgcacgcacaagcctgcccaatcctggtctctgagcaggagggcacccgcaccacccccaaacatgccgatccatgatacatgtaatcccagtactttgggaggccgaggcgggtggatcacctgaggtcaggggtttgagaccagcccggccaacatggcaaaaccccatctctactaaaaatacaaaaattagctgggcgtggtggcaggcacctgtaatcccagctactcaggaggctgaggcaggagaattgcttgaaccgtggaggcggaagttgcagttgaactgagattatgccactgcactccagcctgggtgacagagtgagactctgtctcaaaaaaaaaaaaaaaaaaagttagccagacagtcccagctactcaggaggctgaggctagaggatcacttgagtccaagagttcatgagcctgcagtgagctatgattgcaccactgcactgtagcctgggtgacagaccctgaccctgtctggaaagaaagaaagagagagagagaaagagagagagagagagaaaggaaggaaggaaagaaagaaagagaaagagagaaagaagagggagggagggagagagaaaaaagggtctggggccctcatcattgtttgggtctccatctctttcctgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtgagcctggggcagggagaagagaggaaggatggggagggagggatggctggcagggagagactgtgggccagatgaaataaaaagaccaaaacagaggcagacagagactccgctgccagtcagtgtcacaactagagaagagggaagagactggaaaacccagaagcagagaaatgaacacagaagctcaataaaccagcagcaagcaggagaggggcggggccaggggaaaggcgagaagaaggcaagaattcaagaagcagcgggcctgaactgggggccttccttcctcaacactctgcctcccttcctacaggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacctagataatttattttcttgggatttatacagaaacactattccatggagacaatctcaaagacaaagtcaagacactaaaatataatcccataaagatatttcagtgaggaactggtgagtatagtccaggtaataacagtctcgtcagtgatggctgacaacgtgccaggcagtgttctcaatgctttacagtactaacttacttaatcttcacaataactccctaaggtagatatgattcccatttaacaaatgaggaaactgaggcacagagcggtaactttcccaattcagctgcaaatgacaaagctgggatttgcacctagttcgtctggcttttagaggcctcttggggaaaaaaaagccttcatataccacgcccttccagaatttctttgaacgggtagaatggtctggccttctcaaataatcagatctcttgcatgttccgcaggtgttacttttcagtcaactctcaaacatctagccacacgcgaagtgaaaaatgttctccaaggttgattgaagggaaatgtgtgcaattttttttttttttttgagacaggatctaattctgtcactcaggctgttgtgcagtggcactattatggctcatggcaaccttgaactcctggctcaagggatccgcccacctcagcctcccaagtagctggggctataggtgtgtgccacgacgcccagctaattttttgtatttttagtagagatcaggtctccctgtgttgcccaggctggtctcgaactcctgggctcaagcaatcctcctgccttggcctctgaacatgcagtgattacaggcgtgagagccaccgtgcctgacctgaggtgtgcactttagacataaaatgagagaggccaagttcacattttgttggtgaacagaaatctaggctggcctccttttggttcagaaagagtatttatgatttttacttttttggtttctttttgtcttcttttatttttacccccaaaaaggactttaaatcttctcaagccctcttattagtaaatgtttgcccctccctgcccctgaattctctcctgtgctcggtcgagaggatcttagcttgcaggattgttagggagctgctgccagccggctgctccttccataaaaggccactctcatgggtctgatatgaggaactctgtcgctggagctcatcagggtggggcggctgcaaaacacacacctcagaaggcgtctgatccaatggagtggatgggtcatttaaggttgactgtgaaaatatcacatccaacttccttttttgaaaagtaaataatggtgagctgtatctttaaataaagttaaatcctcctgcccctgcaatatgctggggccagacctcatgaattcttaataattgttctaatgtgtttagataaaaaacaaattttatacatttttttcaacaaaataaaaggaggaaaatattttgaaagaaatgatgctgaagcacagccctttgtgacaccattcaaatttataattatacctgcctgtatttttttagagacagggtcttactgtgtcgccctggcttgagtgcagtggtataatcgtggctcatatagcctcagctcctagactcaaatgatcctcctacctcagcctcccacgtagctagagctacagatgcgtgccaccacacctggctaatttttttttaatttcttttttaagaagtggggtcttgctatgttgtccaggctggtctcaaactcctgggatcaagtgatcctcccacctcagcctcccaaagagctgagattgcaggcatgagccactgcacctgggctgcctaaattaattttctagggccgccataacaaagtactgcagactcgatagcttaagctgcagagatttatcttctcacagctctggaggctggaagtcagaggtcaacgtgttggcaaggttggtgtcctctgaggcctctgtccttggcctgctaatggtggccttcctgccacctatgtcttcacatggtcttgcctttgtgcatgagtgtgtcctaatcttctcttagtggattagggcccatcctgatgacctcattttaacttagtcacctctttaaagcccctgtctccaaataaggccccattctgaggtcctgggagttagggcttcagcacgtggattttggagggagacacagttccacccacagcattacccatgtctattttgccagtgtggagtcagtacaggctccaggacacatccacagagcacaggccacgtagaggggagctcctgtctacaaggaaaagctggcagaaaaccaacaaagacagcctcttgatggtggtcttcaaaagatgcaacaggatgcaatggcagttgacaatggggtaactgttggttgtgagaaccctaatcctctaccacagggaggagaaagctaacaccaagtccaacccacatcaacacgggggtgggacacccgtgagggggccaaggctgtagtccagaagaaaggtggatggaactggggacagagcagtagcacagggagatgggggaggatggggtaattcagaatttccctttttgagagtggcatcaacacaatgtcaaagtaggagttctccggcttctctcctccccaacagaatttcaactagcaacaatcctgtggcaagtttaccaccctgaatatcccagaacttggagtgaagctttgcatcccctgggatggcagagccaagaaaaaccatgaggacggtaaggggatggctgctttctgaccacgccactcctccccaagcccgcacagtgccacacgcagaggagtccctggatgctcggtttctccagtggacacagtggatgggaggtgggcgttcggcttccccaccagtctgagacttcacaggagactcactctagtcttttcccgcaggaagcactgtgagtaccggcagggtcagcccaacaagggtcagtaagaacttcccttttcaaaagataaagcggttcacatagacagctgtggtggactctttctgctgcctgcccaacagacttctgcacatttcctaaggacagaaccgcatttttgtactagagcagagattccgtgacatcaggagaagaggcccttcccccaatcccaggagccaataaactcattcttctttgcaattgtacaatgacatgcacagggaagtcttcctttccagggtataaagcaccattaggagaaagtttttggtttgccttggcccttattttttgttttggggattttgcgtgtgacaacatcactcctgagctgtggcagccatcttaccatcatgaggaaaccgccacggggataaaaagccaatcctctgaggacctggaagaaaggacagaacctggctcccaaggcatcactgagacccaaatcaacagtaagtaagcacagcacctactcctgggcttctttttatgagagaaaaaaaaagttcccatttgtgtaaatcatagtgtttggtgttccttttcttttttagttttaattgtatttatttcctctctttcggatggttgatttattcacatgggtcaaaattcaaaaagtatcaaagagtaaacagtgaaatgtctctctttcactcctatcccccaaccaccaaggtccctgctctggaagcaaccaatgttactgtttctgatgcttttccagaggtaatttatgcatattcaaacaaatatatataaatagattcctttgcttttttatttctacagatggtactacagtagtccccccttgtttgttattttttttttcttgtttgtgattttgctttccatggtttcagttatctgctgtcaactgtggtccaaaaatattaaatggaaaattccggaaagaaacaattcatctgttttaaattgtgcactgttctgaacagcatgatgaaacctcaagctgtcctactgagacagagtagggatgggactcgggccccactcgtgccctaccaagaacctctattgtaagctggggtgggggggtgtggccagtgaggaccccaaccagactgtccagaccttgcaccatgaatcttgctcaaggtactatacccactcatcgcagacccttagagagactaagatgaacaacgtcccaccataaatcttactccaggtgccaaacccactagttgtagaaattaaaataagcagctcccaccttgaatcttactcaaaggagttaaccctatctcccgtatgtataccacaggaccagaagaatgagcgctcctttgccttatcttcattataatactaaaaatcacaccggggtggagacttaacatgctaatgagacacacgatgcataaagaagcatgttatcaaactgaacaggtgccaaaatttcctcatctctacctgctcaaactcactcccttcccactttagttcctttaattctcctttagttcctttagttctcttgagtctcttccaggagccagccagagaattctctctctcgtgctgcctcccttatgccctgcataagctctaataaagccttgtctgggaaaactcttttggcctcatgttaacttctattgcattaacaacccccaaggccctgtggttggtaacactactcctgtcccttcaagacatgaattctccctttgtccagcatctcctccctgcagacgctccctaccccttagtcacttacaagccttcccagtgatcagaccaactgttgagatattgcatgcttgtgttcaagtcacccttattttacttcataatggcctcaaagtgcaagagtggtgatactggtcattcagatatgccaaagagaagccataatatgcttcctttgatgactttgctaagatctgcataacaatgcaccttctattcatgaagttgtgaagcagaaaaaaagaaattcaaactagttttgctgtcacaccttaaactgcaaaagtcatggtgcatgataagtgcttagttaagttggaaaaggcatcaaatttctgggtggaagacatgaacagaaacgtgttttgactgacagcaatcgggttcagtgctatccacggtttcaggcatccactgggggccttggaatgtatcccccttggaggagggtggactactgtacacgatgttctgtaagttcttccccttgcctttttcatttattaaaagagcttggccataataccatattagtaccaaaaaaagttctcattcatttttctatctgtgtggtattctatcacctggctgtaccatttaactggatcccttttgagaatttttaattcatctccaacctttactattacagacaacactacagtaataacctatgtcattttgcacatgtggaagtactgctacaaaaaaaattgctggaaataaaatttcctggttaaaaggtacatacatttcgttttgataaatgttgctaatttgtcttccatagagatggaatatcggaatttttttttttttgagatggagtctcactctgtcacccaggctggagtgcagtggcgcaatctgggctcactgcaagctccgcctcccgggttcacgccattctcctgcctcagtctcctgagtagctgggactacaggcgcctgccaccacgcccggctaatttttttgtatttttagtagagatagggtttcaccgtgttagccaggatggtgttgatctcctgaccttgtgatccgcccgtctcggcctcccaaagtgctgggattacaggcatgagccaccgtgcccggccgaacatcggaaatttttaagtgtccatttccttacataaacaccaactttgatgtgttatcaaatattttgatctttgccaaactgaaagatagaaaaaaaaaagttatctcagtgtaatttttatttggatttcttattgcgagtgaagtttttcacttcactgtgaatgagtatttcatttcatatgagtgaacatttcatatgttaaagagccagttgtaatttattttctactgactgttcatatctctatttttcttttttttttttttttttgacagggtcttgctctgtcacccaggctggagtgcagtggcccaatcacaactctctgcagcctccacctcccaggctcaagtgattctcccacctcagcctctctccagtagctgggactacagacacacaccaccacgccaggttactttttaaattttttgtagagatgaggtttcaccatgttgcccaggctggtctcaaactcctgagctccttctgcctcagtcttcaaagtgctgggattacaggtgtgagccatcacacttggcctcctatatttctattagttttcaaatgttatctttttatctccagtcatctattgaacaataattttttcttcactaatttaaaactactgttatgataagccaagtttttgtgcaagtttgaatttacttctggattttcaattctctctcattgatccgtcttttcaatttgccaacattacagtctttcaattgttttagctttatattttaatatctattagggccagtagctccttttattctctgtttttaagaatttttctaactatattttcttccttttccacatgaattttaggacctgtttatttagttcactccccctccaaaagaaaggctcctttgaggatgtgttttgagattgtattgaatttacaaatcaattagtgtgttgggtttgtttgtttgtttttaatttgagacagagtttcgctctgtcacccaggctggagtgcagtggtgcgatctcggctcactgcaacctccgcctcccgggttcaagcgattctcctgcctcagcctcctgagtagctgggattacaggtgcatgctaccatgcccgactaatttttgtatttttagtagagatggggtttcaccatattggccaagctggtctcgaactcctgacctcaagtgatccacctgcctcagccttccaaagtgctgggattacaggcatgagctaccgtgccgggccgggtcttcttttcaagaacatgatatacccttctatttgttgataccctcctctttgtgtcctcagtagcattttaatgtttccttaatatgggcatttctcattatagtcattccttggtgttttacctttataagtgctataaaaatgggattttttagttttgttttctttctttttccccagccacctactgaattccctcatgatctataatagtttttttgttttgttttgtttttgtttcttttctgagacagagtctcactctgtcacccaggctggagtgcagtggtgtgatctcagctcactgcaagctccgcctcccgggttcacgccattctcctgcctcaccctccctagtagctgagactacaggcgcccgccaccacgcccgcctaattttttgtatttttagtacagacggggtttcaccgtgttagccaggatagtctcgatctcctgaccttatgatctgcccacctcgacctcccaaagtgctgggattacaggcgtgagccaccgcgcctggcctataacagtttttcaattaattttcttaggttatcacctacaaataatgctaattttgtaataatttttctagaaacaagttattgccatgttgcccaggctggtaccgaactcctaggctcaagcaatctgcccaccttggcctcccaaagtgctgggattacaggtgtgagccaccacacctggcctataacagtttttcaattaattttcttaggttatcacctacaaataatgctaatttcatagtaatttttctagaaacaagttattgccatgttgcccaggctggtaccgaactcctaggctcaagcaatctgcccaccttggcctcccaaagtgctgggattacaggtgtgagccaccgcacctggcctataacagtttttcaattaattttcttaggttatcacctacaaataatgctaatttcataataatttttctagaaacaagttattgccatgttgcccaggctggtattgaactcctaggctcaagcaatctgcccaccttggcctcccaaagtgctgggattacaggcgtgagccaccgcgcctggccctaatatttttaaatctcatctaaatgcatctcatagtacctccagaacaatagtaaatagtaatggacagctctgtctcaatcctgattttaagggcaatacttccagtattttctcattaagcagcagttgaaatacgtatatttattttattatgctaaggaagtatccatatcttattatttcataataatccaatggataatgaataaataatagaaacggaaagaccagatcaaaggctactgcaatagggagatggagaaaggtggaaggttggagatatgccttagagatagagtcaacaggatttattggtgggcgtgggtcccagctcatattttatggccttgggtattagtttgtttaatctgagcctcacattcaaattaacatttggtaaacattaagtgagaatttactatgtactagtcatcttaagatacaacagccaacgagacagacctgatacataaacttctggagcttgtaaaataatcacaattattgcttttgtagacaagtgctacaaaagagaagcacaacatataaccagtgaccgattctaggtctggagatgaggaaattcctccctgaggaaatttaagatacaacctgaagaataaataagggctagccaaattgaaggggtgttggagaggagagctctgctggtgggttaaatggtacgtgcaaaggccctgtgataggaagaatagtttggctggaacttgggaatagagagatgaagctagagaagtaggcgggtaacacgtcattcagacttacagactacagcaattttgaactttaccctaagagcaataggaaaccagtaaaatttttttccagtgtagtaaagtatatatatataaatatatatgttatatgtgtgtgtgtgtgtatatatacacacatacatataaaatatgtgtgtatagtgtatatatacacacatatatataaaatatgtgtgtgtgtgtgtgtgtgtgtgtgtgtgtgtgtgtgtatattttttttttcactctgttgcccaggctgaagtgcagtggcataatctcggctcactgcaacctctgcctcccaggttcaagagattctcctgtctcagcttccctagtagctgggactacaggcgtgcaccaccacacctggctaatttttgtattattagtagtgatggggtttcaccatgttggccaggctggtctcgaactcctgacctcaagtgatccacctgccttggcctcccaaagtacttggattacagtcatgagccacttcacccggcctgtaaagtatataaagtatattaatcttaagtgtatagcctgaagaagtgttacataggtatatacccatgttaccatcacagaagatatgcaacattttacttccttagaagataacttcatgccactttccactcagtcatgcttactgcttgagttccagtttatattctggcagacatatgacatcccagagatatccactttcctattttgacttatatccccatcagttagtatttgtttgtttgtttgtttttaagatggagtctccctcttgtcgctcaggctggagtgcagcggtgctatcctggctcactgcaacctctgcctcccaggttcaagcgattctcctgcctcagcctcccgagtagctgggattacaggcgcccactcacctggctaatttttgtatttttagtagcgacggggtttcgccatgttggccaagctggccttgaactcctggcctcaagccatctgcccatttcggcctcccgaagtgctgggattacagacatgaaccatcacgcctggctcatttgggtttttttt

SEQ ID NO: 941 - DNA, 2137 bp, Homo sapiens
ccactcccacttcctgagctccgccatgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacctag

SEQ ID NO: 942 - protein, 435 aa, Homo sapiens
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 943 - DNA, 46677 bp, Mus musculus
  misc_feature (1)...(46677): n = A,T,C or G
ccaccgacaaggggccttcccccttgatcactaattgagaaaatgccttacagttgtatgtcatggaggcatttcctcaactaaagctcctttctctgtgataactccagctgtgtcaagttgacacaaacctagccagtatagtactttaccaactgaacgattttatcagtcctactgtttcatatagctttaaatagctatcttcttcctcctcagagagctctgctatccaataacatacctccttaaaccctttttggagtgcagaaatgttaaaaaaaaaaagtcacaagtgtcacaattgctggacagttgcctgtgcttgtaattctagcccttggaaggctgaggcaggaaggtagagaattggcggccaactttcatagcctgatcctgactcagaaacaaaggaaaaaaaaaatccctaaaaacacacatcctttaatctgaattcttcaactatgaaaaagcattcttccaagatttgctttgaggagcgactgtccagctgtacttgagagtaaagtttgattgaaatcctaaatctttattaaatcaactgtgtttgcagatcacatgcaagaaacaccagttctccattagagagccatgagaaaatcgtttatttaggccacagggtcttaaaccatgggttgaactctgtgtggaactgcctaaccaaatgtagaagttgtagaaattttggcaaaagttaaaaaaaaaaaagtctgaatgtgaaagtatcaaaaatcaatttaaaattagacacagtgtgacaaatgaaagagtctcaggctgtgcttgactgtgttaaaccatacatatccaatgtagcctggttggttgggtttggtttggttggtttgagacagggtctgtctgtgtagttttggctatctagaacttactatgtggatcaggctggcctcaaactcacagagatcctcatgcctctgccacccgagtgctgggattgaagcttgtatcactgtgcccagccagccttgtctacgtgtgcacacttcctggtatatgccaaatgagggctgccccaaacacatcagctcagaagggggaccagtgtatgttacaaagtgcagtgtcttcagtgtgcatacagcgttttctgctgttataggaatcatgctttaattgtgaaaacagaatctttcagcgttctctaccacctttcatcatcattaagtatcaaattaatgtatctttgggttgtattattagaatgcttgatgataaaacttagggactgagttttagatttgagttcataccaaaacattgagtgcattttaacatgggattaggacagaattttcaacacttctgagatggttccagctatacacctgtcaagtagtattacatacttataaaaggcagtgctctcagcaatgttgatcataaaaatcaaaaacatcagtcaactctgaaaaatgaaaatgttgaagatactctttgtaatatcaatttgcagcacattcatgtcattagtacgcaggtttgctttaatcttttaataaatcgtaaatttatatgtataccaaaaattgtcttaaaataaaattctttatattttatctgtaaatgatttgcaaacttgttttatgtgccagttgcataaaaatttgtcaggtaaaaaagggctactagtgggaaatttttaaaaagctagttaggtgaggtggtgggtctctatacatttgaggccagcctggtctacaaaccaagttccaggccagctagggctacctaatgagatcttgcctcaaaactgaaatcaaaacaaaacagaataaacaataaataaaaaaaacaaaaacagaagctgggcttcctcaaggccctttcggataagcatgcttacccatcttttcaggaacactggagattctagtaacagctgaagaaaagcagacttggagggatgaagtgggaagcaccatgagaagtgtcccctctgctcaaggcctaataaccctttctcccattgggcagttgtcatttcctgtacctgattgcctatatccttcagtagttgaagaactgcttccaaactgcctcaggtttattgtgcttctcactaaaaggtgatctgcaggcagcgtgtctaagaccagcattaccacattcatcctccactccaggaagctgcagggtgtagcctgggatctcactcaccattcaagttttatccttctcaggactgaatgggatacgttgtttggggttgcagttgacacatttgcaacaataagcgacagaaaagaagtcctgaagactttagatcttatcttaaggactctgccagtttgttggtgagtcattcatccttttatcacttggctcagccaactgtcacatgttagacaactttatggaatacaagctcccagtctcctgggaaggctgattgagcagatgcaggctgtctctagctatgccaaaaggaggacatatgtaacactgtgtggtgttgtatcagacaatgcctgggtgatacaatttccctttaccctgttgctgccacagaccctctgggtccctttgtctgcgtgaaactgggtctctagttgcaggtgggaaaggagagggggaatgacagacagatgcacaaaggaaattgtgtagaatctgaatgtattgtcacaaagtgaacatcagtcttatatcatacagaaaataaagggggtaggaagtcacagcaggcaaagtacattgaagttgcctgacacaaaacaaaggaatgacttcaaaaggacttacaagaaccaggtaaatgtttaaagtaaagattgcctagggtcagcttaatgacagataaggatttcacaccctagtcacgattagtactactcctttgagccttgtgaaagctagcaccagggggttctgctctagcagaccttctcatgaataatgcaataccacaacccccctagttcctgggccctgataaattcttgtatgagtgtaacttttaaatatctggagactgtccatttgtcagaagaattcaccaacttgcttctaatatgcaatgtagcctgtactgaagagttgcatctcagtgggattccctagctctttcatggtattcccttatttgggtaagactggctacttagtaaaccctctgtagaccagccctgagctgctggttccgtcttttgtaatgcttaattagtttcactgtctctaccaagctcctccgaaggcttagttatgtcagaagtcaatcttaaaaggcacttataataagataatactaaaagagagcacgtggatccatacaccagactaactcggggataaggtatgaatatacaggttatgagaacgccaaagttccaggaggtgtgtttctgtgaaactctttgcctcgtgagtgctcccaggcctctcggcctgccaagcaaacttcactggagtgtgtgtagcatgttgccagtgaaatttctgccttcctgaaaggctttgaaaatgccagattaggtcactggagtggtgtaatccaacattctgtagttccagagttatgcctttgaaggctacaattgcacaggatatcctctgagccaaacagctgtacccgctggccaaagatcaacctgggtttgtcgactccttacatcccctcatagagagtcacccagaccctcacctgagtatctagtaactcccaagcacttgttgattgaaactctgacctaactgcttatggcctggggggtagaggaagggcagggctagagaatacagatcagagattaggggagggctctccatctgtatagctatgggaaagtgtagcctcctctccccagcctgaaacctgcctgctcaggtttcactgtttatatcggggtggagcttgctgctcaatcgttctgccacgcccactgctggagcctgctgctttgctgttcctgagccatacacgtggtcaccctgctactggactccaggattatttggcgggaatcggcccctccccctccttcataactgcgtgtagaaatagtaaaattgagctttgatcagaatgacggtcttagctgcatcattctcttgtgccgcctagcccctcccccctcttctcttccaagtttccaagatgcctttccagactagaacccagacatgtgagcctctggtcggacacaacaggaaagccatcatctctcctaggtaaagacttttcctgatgtggccttgtggggggaggagcacaccccccccccccatggtaactccaacacctatgcccagtaaactcattgggtccccagagtgaattttggtgaactcatgccccagtttgttcttggaaccttggtgggaggggtggagcttgtttatgcatcttccctgggaaggagggagcactggctcccagacctcactgcagtacacaactgaatgaaaaaacacccttgtcagtccgtgtaggtacttggcctgggtccacgagattaactgcaaaagaagcttgtgaacggtttgcaaacctccactccccatgaaaaggaaggcgataaaatcttttggtatacctaatgaaccctttgaacacttagagatggactgcagttgtaaccttaaatgggttccagtgtgcacttgtgtgtaggttttcctgatggaggatttctcaggtaggtaagtgatgctatgttatgagctaaaattcctagaaaatgttgctgtcatgccacgttcctcctcctcccccctcctcctcccccctcctcttcttcctcctcctcctcctccttctatgaaacaatgaccagtgacaaaggaaccaacctcagtgaacaaattaaaaggcaatttagtcaggtgctatgagcacccttgaattgccatttcccctgtcacctaattcttctggactactcaagaagatttatgagtcttagaaattggaacttgggggctggagagatggctcagcggttaagagcactgactgctctttcgaaggtcctgagttcaaatcccagcaactacatgatggctcacaaacatacataatgagatctgatgccctcttctggtgtgtctgaagacagctacagtgtacttacatataacaataaataaatatgttttaaaaaattggaacttggcatgttagtgcccttgagaggctgaggcaggagggttgcaaatttgagaccagccttgacactataatgagtttgaggccaaagtcattgcatagtaaaaccgtgtttccaaataataaaattgaaattgacagttatctgaatgaatttatggtgttggtaatactgttgtttcaaatagcaagcaggtcagctcccactaaagtttgatttctgatagtctgggaatgtccgtcacttgaatagtgcattttctgctcacccaaattcggatgtataagcattgtaaggttttaggttttggttttgatttgttttttaagacaggtttgtttgtttgttgtgtagccttggctatcctggaactctgtagaccaggttatccaggaactcagggatccacctgcccctacctcccaagtgcttatagggaattaaaggcatgccaccacccggcacattacaaattttttagtacattgtgccagagtctattttcatcaagtaaaagtatttcagaatctatcaggtcatttcaggaaatgacatcagagaaagcctgcctttctatctgattgggaaggaacctgccgagttgtaagacagggcttcatgtaacacatgcttgcctgaacctagctttgtagcagatgacctttaattcctaactcttgcctccacctccaagtgctaggattataggtatgaaccaccatacacagcctgatttcaatttcttgtgcataagcagtgtgtgcctgtggaagccggagttcaacctcaagtgctgtttctcaggagcaactgatcttattttccaagacacagtctcactgggtcctggggcttatggatttgggcaaacaggcagggcagcaaggcccatatacctgctcatctccacctccccagcactgtgcaatcacaagcctgtgccaccaccccaggcttcctgacgtgtgtcgtgggggttaactcatattaccaattgcaccatctcctcggtcctcaacattaccttctgaccatttgcaactttaccatttgagacttgtagccaagtctcagatccttaaatttcatgtttatatctctcaactcaaatggattgagacactcagaactgaagtgtctatctgctgaagactttaagttaaagctaagcacatgtcttccaaagctgttgggatctactgttgtacaggatcattctccaagctaaacggccaccattttcaggaggtaagcactccctggttgccaatgatcatcactgatggtttgtgtactgctggcattccctttgggggagccattgggagggccataggaccatcatctgaatgtctagccacccttccaaccagttatgtacaattctgccccaactgaatatgaccttggtggtggtggtgggaaggatgagggtatatatagatgggggaaggaagagataggtactctatctacacagttaagattgtgtgtgtgtgtgtgtgtgtgtgtgtgtgtggtcttcatgagtgctgggtgtagactttccagggttccccagcctaataaagtcaatggttctccagcatgaactatggtggagttataattgctttgtcctgaggatgtagaagaaggtagagtgagtttacaagtcctcacgggagggaattttagcaacgcttagtaacaatttgaaggttttcttttagatttggaaactctcctgggatggctgcaagttctgcctcagagcatggagaaaagcatgtgcataggcctggttggtcagaagttttatctcataaggcaatgtctgcctattttgactgtcttcaagtggaaaaaatatataaatatatatataagtgttagtcaaatcagagcattcctatacaaaagaagggaatggtcaggtgtaaagtactgggtttgttgctcaggcttttcattgtttctccaaagaaaatttcaaggaagcattgattgatttccttttccattgtgttcattactattgtaagcatgtttttgaccttgcatgcgtggctgtgcacggaggccagacgacaactgtggggttgactctcttctttccaccttgtgggttctgtggagctaggttgtcaggctattgtcacaagcattttgaccacagagccaccttatcagctcacagcttcttcatcctaattaaaaacaagacgtatttacacagggaatctgaaaacaattatttgttgtagtgctggggatgaaatgggtattccagccaaccaggccagggccttgtgcatgctaggtagtaattgttctaggtaacagcccttccatttgtcaaggttgatgactttatttctttttttttttattccaagtatgcctttataaaaatcctcttttccattgtggccactgcttttccaaggcatttgtttaacctatgtcctcaacaaattatacatagtttgggtttatgattttagcaaatgaactttagctggtgtccaaggaaggaaagacctgggcttcttgaattggaaagaacttttgtaaaaataattattgcttcccaaattaaaaaaaaaatcaagaaaaagtatctgtcaaggctcttacatggattcattcctcttaactgtactttccagtttgactcttaaaattgttatgattttaacccagctagcaaatgggaccacttaactaatccgatttagtaaaagttgggggtaaaggaaagacaaaaaaagctggctgagattacatatggtatgtatatagtatgttaatgtaacttgttttttgtttgtttgttttttcaagacagggtttctctgtgtagccttggctgtcctggaactcactctgtagaccaggctggcctcaaactcagaaatctgcctgcttctgcctcccaagtgttgggattaaaggcgtgcgccaccacacccagcttcttaatgcaacttttactctcctgtgtaactgtcatctgggagacttactgctcctttctgccaatgtaggcctagtcgcagaagcttccagcctccatacaatctaatgtagccctagaatgttttcagcctctgagacttactgctgaataaactcaccctttctagttctttctgaactctggctggatggttcaactcagctgttctggttcaaactcctctccaagctgactgattcaatctggctcctctctgcttcttccgaattgctctgcttgacctttaactatagcaatctgttttggtttttcgcctcttctttgactcattctgtctttacttgtgtctaatttgtcctctctgcaacctgtccctttataactgtcacagtaaaactgcttcctcctcctcttctgtactgcctcttaaatagcttcccttccctctctcttttgagagctgggtataacctggcaaacctttctctgattcagtcaagccactcaattagacatcactgttaaacatgggtgcttccttctaataaactagttttacctttggaatcaaaggtgtgcacttagggtgtgcctgtattccagccagattaaaggtgtgtgctaagggccgaggcacaccacagctagttcaaagccagtggagcttgatgtccaaggggcctgcaaatgttgctttaatggtcctgagggttactggaaggtctactttgcaccctgacaattctgttgtccaaacaaaacaaaacaactctgaaattaattagattcaacaaagttttaacaaggatcaagatccagaaccaggcagcacaccaaagatggttcagaagccccacctctagtgtggtaattgcatgtagaggctgaaacacagcaaacatacaaaatatagtgcaattcagcatttgcctttataagcacattttggcagccttcagcctgagagactagttgaagcccagttgcttgggtaccagggttatcaactcttaaatttataacctgctttgcatcacaagctagaatgcggagcattatataggaaagccattctggaccacattttacctaaagcatggataccagtttagaacacatttatttgttcgaacagaaccatacaagtttaaagcagggcacacagaatcctgaggtcttcccagccccgcgcgggcaggggcaggggcagggccaggagccaagctgcagaggcaacgaggctgccaaccttcggagaggctggcgtcctcacgacttggccccgctcggccagggcgatgcacatacacctctcaaagtcccaagggcggagcttgggctccgtggcctgaagcctaaacaaccgtgctccatctcacaccgtggcgcgagagtcaggcacgtggtagcccagctgcagtttccgccttgttcctcctattcaactagaccctcagcttcgcacgtcgccgcccataccacaggagcacaagacgggtgaaatttaaaaaaaaaaaaaaaaaaaaaaaaaaaaaaaaagcgcaaaaccggaagccaagatggcagcagtccgcccttctctcgcgagaggggaacgagggggggagaggtggggttaaggaagttcaccaatgagagagcaggatccccttgactgacggcgccgtcggcctctcgcacgccccgccccggcgccggagctcgctctcctcaccccgcgctctccccgcctcccctccctcccctccctgctcttctcttcccgttgaggtggcggccggcctctcctcctcctcagctccgtttttcctctcctcgctttttccctttccccccgacccccggggcccaaagcggccggacttctcgctcccttctctacggcggcctccgagcccccgcgtgcgctcctttccccgccatgaatgaggaatacgacgtgatcgtgctgggcaccggcctgacggtgagctgcggcgggctgcggggagacgcggccggccggcctccgccgggcccgggggcgagggcgggtcccatcggtgtgcacgagcctcgcccgcgcccgaactgccggtgtctgcgcccccttgggggccgtccccactcgcccgcgttgagtctgggatagggaggtcgtggcttgttgggatgcagtgatttgaaggcgtcggtagtgtgttagggaaaaccagggatgtggaagccgggacgtgtcccgtgggaagcctgcccattgggaagttgagggcagaaccgccccagcagccggagagagacagccttcgtcctcctgcaggaaggaagaggaccgggaaaacagcttgtgctccttgcacttcccctttgggtgaatgacctctcccgcttggaagcaggcaagccctggaccgagcgggagggagtcgctgctggcgcctgcacttcctatgtaagtggcgagtagcagcagcagcagcagcagcttactcagctagtctcagggcgcagaaagccaaacagaaggatgatcgctgatcgataatttgtcctagagtttggccaacttaagtttctagagaaaatcatgaaacgagtttctttaggaaaaaaacaaaaaccctttttctaattgcttcactgccctctcatccactcgcttgaaatgggaaatgaattttctcaaaacttgtctgttaaatacttttcacgtccggcccttgcttcccttttgtttggtttattgcgtgccgccacagtttcttgagaagggggaggctaagttctctgtacttgttacacttctgggaggttagaaaataaatgcgcagtgtgaatgtactggtatgtaaatgtaaggcggtccctaatgctccagtacgttttcgtcagtatctatctgcttaaatatggggaaaatatagacaggtttttatactttgtgctttccccccggccccccactgtgacaaaagggctgatcttttgcaaaaaggagttgggaagagaaccgaccattttgaatatcaattgcggtgtgtgtgtgggggggggtattgaatgtgaaattatgggtaaattacttcatctggaacattgatgtatggatcccatatgtctatccatcaaatgtccaagtcatttaataagagccccacggctttcgactttgttgaaatgcattggcatttctttctttctttttttttttttttttcctcgagacagggtttctctaagtagccctggctgtcctggaactcactttgtagaccaggctggcctcgaactcaaaaattcgcctgtctctgcctccaccaccgcccagcttgcattggcatttcttagaatcaaattaatatctttaagataaaatactcggaaataactgttttagagaaaaccttcaagattttttattctactttttttcttttaatacttttaggaaaagcttatttttctctttgaagtgatgaatgattgctagaagagattattgaattctgacaagttctcaccttgtagctctggttgtccaggaatgcagagctctgcctatccctgccttctgggtgttgggatgaaaggcaaggccaagatgttctgctcaaggctcagtaacatgtgactgcccagagagtagactggagatagacatcattgctcacctacaaggccatctacttaactttgaatgaatgactgaatttcttttatttttttgaggcaagatctttctctgtagcctagctatactggaactccctatatagatcaggctgaccctgaatttaaaagatatttctaccttctagccttccccagtagttggtcagtgcttggattaaaaggcacatactgtcacacccagccattggaacacccaccccccaccctcaaccccgtcagttggggagacttgaatggctaaattaatcactacccagggctctctgcaggttgaccttttttagtgcctaattgggggttccgggcatagtaagtagtttgtgatggtggcctgttagtgggccctgtggctgccagcatattgtgagagccaattatttctcttttatattgtcattgctaatacttcacatttgcccattaatagggtgggttgagtgtagctaagtgagcccagaggcttcctgcaggcttccacaggcctagtttagaagcatcattttgtatcaaagatagcacagtctgtttaacaaagtaacaccctttatttaaattttcacttgaattgtgaatttcttaatgggtagtggatacataagtaactagaatttagaacagtttctgctgtcttacagctatgctaaccttgtttctcactgggccttcctagatctatactgggaaatgttttagaattgtatcagtgtagcttgtgatcatcataggaccatcattaatagacacagtaatagcagaatgatgttgacaataagaaatgacattagtagaacttgggtgaaatcttgagttaggttaaatcttgaagagactcccagtcaaagttaaaagccacaaattagatgtaactttgaatattagaatgtacatggcattaatgtttggcttgtagacatttagtgctggagatttcagaacctagtaaaagggtgtataccaaatgtatattattgttatgtcaaggactttgagtgaaggaaacttgttactttagtgttgcttggtgttggcattcttttctatcagttaacttcacattaatcctcacgcattgaaagttactttagtaaagaagacctttagttttctatgagaaatggcagattctgtgtaattatctaacattgagaattatcactttaaaggctatgaggtcatggtacacacatttaatcccagcacttggggaagaggggtgggcacagacacagatggacctctgagttggatgccagtctggttgacagaacttaaggacagccagggctacacagaggaaccctgtctggacaaagaaaaaaaaaaagtagtagtgctccacccccctccaaacctatagtttgtagacaagcctttctactgacaccagagtaaggagagtgactgtcttggtaagtagtgttttgtgatgactaatttttgtgctgtgacatttgaatgcattaagtcccagtgagctttgtggggccttcagcccctttaactaggctcaggctgctttgccttctgaattattcagtctcatttttgcttcctatcccttctttgttggttggctggcaacttctgcatttctatgctttgagcatgtgtaagcagacttttaccacataattggcacacaactcatatgggcttggtaataaatcgctgagttgtgctagaattacttatttgaaaagagctggctctacagccatttgtgtttcccaaggctttgttctttttttttttttttttttttctacacagtaagcctacacatttgagcagaaacatgtactttgacatataaacaactcattctcagcataatatgtttaaagattattttacatcccagaatatgctccctatcatttctctttattaaaacatacttatcaaatactagatttttgtgcttgatttgagaatcctaaactgtaatttaaatttgctcagacttagatttggtcttgaaaacctttgccatagcttcgagaggtataaacacaggactttgtattccttgtggtagtggtcataggaccaaggaattcaaattcttttttttttttttctttttaaagttgaatgttcctagtctaaagatgtttaatttagagtgctccaaatgaatcttttcgaagctccagtatagtaccacacatgggaatcccatcctggacattgtgttgctgggtggttgacaaggtgcaggctcactaaatgctgtattaagggaatttcaggctagcctaaggaaaatttatgtttaggcttggatcctattcccaagaaactttgctatggtttggtgacacttaatttaatttaatccgagcatgtgggtggctcaggaggttgaatcagacagaatttgagaccagcttggtctgtctacctacagagttctaggccaactaaggctacacagtgtgaccttgtctaaaaaattaaaaacaacaacaaaaaccccatatgtatcaaatttttctaaaatggaaaaaaaaaaaaaccagacatttaaaacacctgtttcaggcattttagatcagggaagcagcttgtgttcgccttagatgtgtttcaaggacttgaggttcacatatgctttttaagcatgcatacatataggtaaagttgggtatttgattcagctgtgttaatttttgtctcatttcaagtggcttctgatttgaaaggctactctgggttaatgtgggttaatgttttcaaacattcatccactcacaggacgagctgctattatctctcctcctccttcaggagactctcctgattgaagactcaacttgaagtaattatttgtcctatttcagttatttaaactatctgtgactgttgcagtctgttatggtaaatgaaaaggtaaacttaaaagcttcctgtattgcacagatgcggtaagtaataggagtgccttgaaaacctctgcgataggttggagagatgtagacaaaggactttgtattccttgcagtagtggtcacaggaccaaggctttcaaattctttaaaaaaaaaaaaaagaaaaaaagttgagtattcctttcttaaagatgtttaatttagaatgctgcaaatgaatccagacactcaagttactctgtggaagaataagagtaaatgtagacaccgaggggtatatgcatatactctcagtagtgaggagccagaggcaggaggttggtgtttgtagccagcataggctgcatagtgagactctgtctgacttaaaaaaaagaaaaggggagcatgagaagttcacatagaatcctcagaaacttcataaaaggaggttaactggcttaaaaagttttggtaagcctgttgtgatggtatactcctcagtcccagcactaaggaactctgaattcaaggccagcctggtctacgtattgagttccaagatagccaagtctacatagagagatctcatctcaaaacaaactaataaaacaagtattggtaagcttttcgagcaggaggaatgcttttctagtcaaagagaacactgtaagatgggatttataaaaaggatgtaggagctagtagaatagatggcttaatgggaaaaggtgcttggtgccgagcctcaggacttgaatttgatcactgggatccatgggttatgagaccagttctctactttcaagtttttctctgacttgcacatttgccccatggcattcatgtgtacacatacccaagtgtcaatacaaaaagtgcaggactaggaaaatcctaccagtatgctgcttgtggagagatgaggacctccagatcccacattaaaaaaaaataacaaaccaaggaggtatttgttctaaatgattcctttgaaggcagttactgtcagctgtttgacaagtttttaaattaataggccccttattttggtttttaacctacatgttttagggctatggtcatgcatatttgtaggagtgtgaagagttaggtgtagatgctattcagcaaagtttgctgtgatttttgttttagaaattgagccctgaagtcttgcttttattatatgagaatgtgatttttggtcatactctttaaatgcaagagcctgttattccactttcatatatgcgttgagcaatatattttaatatggcactaaaagaagcgagggagctgggtgaagtggcctacacatgtactcccagtgctgggaggtagagggaggcagacctctgaggccagcctggtctacatgataagatctaagacagccagggctacactgtgagatcctgccttgaaaaaaaggaaaagagaaacagagagacaaaggaattgttcttaagtgatattagggctgattattgtatttgtaaaatactttcaattctgtttatcaatatgacattaagagagtgaataggtagacacaggatggaaaatgttttgcagtacatataaaggactttacattcctaaaatatataaagacctttttataaggtgatacagaaaagacagaattctatttaagaaaatgggtaagagcttgagaggtgggtcagcagttctgaacgcttgttactcctgctgaggacctggcttttattctcagcacccacattgtggctcacaaccatctgttataaccccaggtccaggaatgcacatacgtacatgctggccaaacactcctgcacataaagttaaaaaagtaaaacaaaaataaatttaaaaatgtgtttaaaaaataagtcagtggaaccagtagctcacccagaaggctttctagtctccaggtggcttacagtgacctgcctcttcagctacaggggtcttctgggcacatgtacacagacacacataatagtatgtgtaattatagacgacatgtttaaaaattcaaataagggggggaaaggctaaaagtgtgattaaatcctagctggttctgccaatcattactcagtcataaagtgttctcagcctcatttaatcaggatcggtgaggaaaccacaccctagtcagagtgactaatgggcctgaaatagggacttatacactgtcacagctgtgagtttgcagttatagtggaaagccagtgagcacagtcactttctatgatgccgacataacaaatggtgtgctcgaagtggccacagaacagtatttttaactaataaagcactggcagtcagtgcccaccaggaggagaatggctactcacatgagccccaggtgactgtcacttgagaaatgctactctggtagacgctctttggacatcagtcctggaccagcttcttcaactatcccctaggaacttgttagaaatgcaggttttcatccccttcccttctcttcccaagcagcccaagagatggatctgtttcgttttattaaacctttgggagctgtgggttcaactcgagtacgtttcttaacaagacggcagattatggcaaaacaggagccacactgtgagatcctctgtttgcaggcttagacaggatttcagataagacatactattttaggttttgaaggccatgtgggctctgtcacaactgttgtgtcactgggaaaatagccacagtctacatacaaacaagcattgtgatacccctgtaaaattatttgcaaagcaagtgtgcctgctagattggccatgtacccaagaggccctgttctgtaacaagaacaaataaatgattccttgtaagacttcaaacaagttgtatatacctttgactctagcacttacgaagcagatggaggcggatctctgatccagtgcagcctgttttgacactgtgtcagaaggcagagcaacaacaacaataacaacaagaaagatcttattttggggtatgtgagaggaagacctaggacaaatacactgtcagcccttaagcgctgtccaccagttttgaggtaggtctctcactggcctcaagttcactgagtagagtagtctgggtagccatggaggcccaggggtctgcctgacctgacgcaccagcaccgggatcacaaacctgccaccctgcttgactttttcatgtgggcctggggctctatcacaggttcttgttcttggaaggattgtgagccaagttgtctcgtcagcctatcttctaaacacacttgtgttagacttcaaagcaggtgacagacagcacaaggggtaatttatttagctcttacttccagaggtttcagccataatggctgggaggctgtaatgaggcagagcagcccacatactgacccagagaaagaatgaatatctgtgctggaaggctattcctccttccatcctaaatgcctgcaccatcattccaaacgacaagactgctgcttttagcttaggtctacccctagttacacttaggaagtcctagtttactctaaataatacagatcttctggatgctggtatgtttcacttaatatgaaaagtctcgtcttgtagtatggtgtgttggaacatgccagcacctcaggtatatgtgccagcctggtagtaggaggactcagtcttaacataaaaatagaagaatcgggtgtaaatgtaacttatactctactgtagtcattgtcgtcttgaagccttactgctccagtctgctaacctaggcctagtcctggaagcttctagcctccatgcaatctattctaggcctagaatgttttcagcctctgagatttaactagtgagtaagctcacctcttcttgttctttctaaactctccctgactggttcaaaacaggaacccccttcagagttctctccatctgattgattcaagccggctttttctcaactattgctcttcttggccttaaactaagtctagcaatctgttgtaatcttttgagtacttctcattctcttgcttgctctgtcttcacctgtgtctagcttgttctcactctctgtaatctgtctctgaacacctgtcctggtaaaactgcctctttcctttttctctctttttctgcactgttctcttaagtaggtttcctttcctctctctcgtgagaattattgtattctattcggtcagatttttctctgatttatcactctatctgctactcagttagacctcactttcaaacatttcgaacttctttctacaaactaacatttaccttctttgtttgaggttaaaggtgtatactaagagcgtgtctatatcccagccagaggaattaaaaggtttattctgaggctgatccagaccacaacagaaaaacccctttttcaataaataatacaatctcggggtttacagtgtgatcaaatacgctgcagcagtcaggcggactaataaccctttaaaagtccctgtaggtattgggtcctagatggtagatgagctttccaacattgttttgcattcatgaattgtattttattagtaacaaatgatggggttttattatcattattgttttatgttcatcatcttttccctcagtgtatgttgtacaccctgtactggcctggtgcccgtggaggctagaaaaaggtaatcgtagctcttggagctaaagttacagcctgttgggagctgccttgtgggtgttggcaaacaacccaggttttctggaagagcagctagtgtttttaacctctaccatctctccagcactcaactgctgcatccttgctgggttccagggctagatctgagtgaggtagttggtgaaggaatgaagaaaagacagtcacacagatagggtggccggggctttctgctagagaggcttcagcaacctggagctcagtgtgtgttttatatagagttaaatagagatggccattgcatacatctgaacaaggggacctggttgttattcggataaacaaggaagcagcatttacggttattgccagaccaaggagacagggttagggaagctctgtaggagcagcctttgtggggaacagtagctggtggtgctggaaggtatggtggacattatctgcacagtcagcattacacacttagacaaggagggaaggcaaggcgttgctatttccctgagtctatctgagagggaagtcccattagcagggtcatgttcgtcaacaatacacacccactcaggactcactgtgggtttcctcatttcccgcacctaaactgttcttttttttttccaaagatttatttattagaataagttcactgtcgctgtcttcaaatgcaccagaagagggtatcagatctcattatgggtggttgtgaaccaccatgtggttgctgggatttgaactcagtacctttggaagagaagtcagtgctcttacccactgaaccatctcaccagccctaacctgttcatttttaagaggttcatttctgaaagaatttaccaaaggcaaatagtctgtttgtcaattctttcaaataaagatggtaaatcatgtaacaggttttttgttcaacactaaagatttgagctggattttgtcaatgcagtgtaaaaaaggtgggtattactagtatgctgttaagataaatttcaatgcctcataaaggccttagtgaatgtttagaaaagagaaacaggatgcaggatgcctctgcctttgctctgcctgcccagtaaataaacaatcctggtgttggaaatctcattttcgccttggagctccctggagtgcaggagaggccttttgtcatggtgaatgagtattgtgattactaagaaatgcttagtgagattaccttttttataaagaagacatttaagcatgtttcgtgtgtcttttcttcttgtaacaatgcatgtttacctttaggaatgtatcctgtcggggataatgtcagtgaatgggaagaaggttcttcatatggatcagaacccatactatggaggagaaagtgcgtctataacaccgctggaagatgtaagtctctgacgcacacgcttacatgttggctcatttgggactgtccacttttggactcgctcttggttttggcttcctattactatatttttttgtagggtaggaggagggcttgagacagaatgtctttctacctagtcctggctgtcctgtactctatacagaccatgctggcttcaagctcacagagctccccacctgcctccacttctgtcagggctgggattaaaggtgtggaacacctcccctggcagttttggcttattctgtttaataagttggcggctttctgattttttttttttaggagcttctagtttggggattgtaaaatgttaagtgaggacaaggaagcaggggtgggttgtgcccagtgtgccagaagatgccattgctgatacctggactgattattgccttagtctcctattgtcctgtattcttcatcgctgttaagtcagagctgggactccaagcttaatcctgtttgctccggtgtcttttttcttttcccttttttctcctcccccttttggatacaacatatgagtctaagtgagtttctaaatttatctggagcttgtaaacatttatatatatagggagtgacacttttttgtgagaataatgtacacttttcctggaaaaatcattgcctgattaatttaatacatgtatcaaatagttttttcttccctttaggaatatagaagagttgaaagtattttattaccagtgtagcaaaaccttccgtctgaatctagcagttaacattttggtgcagttgatttgatttgtggggtttgttgttgttagttacttattactgtattttattaatttacaaggttttgttatgtagccctagctggccttgaactcaagatctccctgcttccggtgtgctggattatgggtctgtgccacgagacattactttattgtgattttgaaacattggaagtaataaagacattgtggcacttgacctaaacatttcagtttccatctgttaaggatgatgttttctacatcataatgaaacatttatgaaaatttacactatttataatgtattcatatttccagccatcagagtggtatttcactcttcagtaaacttgtttttaaaaccaggattacggagggggtgttggttgtggggggactggagagatggctcagcggttaagggcacaggctgctcttccagaggtcctaagttcaattcccagcaaccacatggtgcctcacaaccatctgtaatggggtctggtgtgtctaatgtcagctacagtgtattcatatacataaagtaattaaatctttaaaaaaacaaaacaaaacaggattccctaaaggtttaagcatcgtatgtgtgtttcttctctgttctccgaagctacaagtctcaccacctttccttttatcgtttttttaatctggaggagttcagactatgaatctgaaaaaccttgttgctaacttcatacactattatactgggaggcattcattggaggtgaatgtgtgcatagtgttctttggtgatgtaatcattggtatgtgcttatgttcacactcaacactgcagttttatacagcagttgtgtttcagtaaaacctcagaactacaagttaacaggaattagttctaacttatcttttctagttttacaatgtgtaacatttatttttcaacttgtgtagctggagaagcaaaattagagggaattggtttaaatgagtctatagtaagtgggaaacagacttctgcggtgctattaatcttagcattagttcataaattaaatactgtgtttaattacataatatgttgagacctaaaagacttctatgactaaataaacgttttatctgactcaaactaaactgccttgtgctttaactcttggagttgtgttataccacaacctctggatctaaaaataattgataacatttgatgtaaattacattttgttacagtattggtatttttgttctgcttttagttatacaaaaggtttaaattaccaggacaaccgccagcatcaatgggaagaggaagagactggaatgttgacttaattcccaagttccttatggccaatggtaaagatactaatgtaatttatgacagtgtgctgaacctgatttgaaagtagagactattaccctaggtctgatgcccgggggcgtgtttatgtcaaaaatagtttagtaatatgttccatttaagaatggagggaagggggaatataaatagctctggaaagaaacaaaatcatgatgtgacacagtgcctaccaaaattgaagatttcgtaatatatagaaacttagcaggaaattatagacatttcacacttggtgcaagtctggtatggtgccgtacagaccaaaattctaaatacagtgtcttagggtttctattcctgcacaaacatcatgaccaaaaagcaagttggggaggaaagggtttattcggcttacacttccatgctgctgttcatcaccaaaggaagtcaggactggaactcaagcaggtcaggaagcaggagctgatgcagaggccatggagggatgttccttactggcttgcctcacctggcttgctcagcctgctctcttacagaaccaagactaccagcccagagatggtccgacccacaaggggcctttccccttgatcactaattgagaaaatgccttacagttggatctcatggaggcatctcctcaactgaagctcctttctctgtgataactccagctgtgtcaagttgacacaaaactagccagtacatacagtaacactgtaaatatttgtaacagatttccttcttaatgcttacctgataatctagatgaaactgagtctttcatgccatttaaaggttttctagtttgtaagcttttgagattaactttttgcattaacattctcagtattttaggagagtaaaatatcttgtaaaagttctgtggtatctttgtttttttcctaagatggtattgaatagtgcgccaggcatagcggtgtatacctgtaatcccagcattcaggaagttgaggcaggattgctaatagtgttaggctagcctgtgctaaaagtaaattctaggtcgagcaagtctcacagtgggaggtcctgtttggggaaaaaataaataaaacaaggaaaaattattattattattattattaacaaacttatttcccatgagataaagtatatgttacttttttcccttttttgagttctttatactttgtattaataaagagtttatttttcttttaaatttaaataataacagaatacttctggggtaaattatcaacaagtttgtataatctaggtaacattaagtagaaagggaataatttacatagtcagaatctcatccagatttggttttacagtgctagtgattgagccaccatttgacttaattatgcttaatactttgatgtataagatacatctatgtgcatgtgtgtgtggctccaggaagcatgtcgttttcagcctttgcacacagtggtatctgtcttcagttcacacacttgtcctccctccccctctgttgtactccctgtatacacattcatacatgggaagcattgtggatcttttcctgaaggcctttgctgcttattgcacgtgtggatttgcctttcccagtgcctttattaacctagtattcattttgtttctgctgctttgttattgaaaagtgaaatttggatttttaacataaatctattagaaagtggggtgagctttagttatttatcagctttcctgtttactgatgaattggccagtgtagtgctcggcatgttcataaagttgtgttcgccctgcagtgaactctgtacagattattgcctatctcaggacatcagagcagccttccagccagcctctgctgtacagctctactccatatgttttcctgaacagagcattcactggtcttttccactgagtttttgattgtaatgtttcctgtgcttagtatactcactattttctttttaaccacatgattctaagaataacagtatttgcggttagtgatttttttttttatagtgtcattttattgccatataaaattgcctatttaccatataactacatgaatctatggtgtgaagttcacctacttttatcttccttggaagtttaccttttcaaagaggcttgtcatttggcactcataccatatattgttaaccattttgacttgactttttatcctgttgagttcatatgcttggtcgcagtggttttgagatggtttttgctagcctaggcagcatggagcatgggccttcttcctcagccttctgacttgggttgcctggcaggccatggtgagctatattcaatttgtaatcatgagtcctaatattggagccagacaagtgttcacgtacttaaactctgctgcatgagtatatcttcaaactcttctctttttttctttttgatttttttgagacagggtttctctgtgtagccctggctgtcctggaacgcactttgtagaccaggctggcttcgaactcagaaatctacctgcctctgcctcccgagtgctgggattaaaggcttgcaccaccatgcccagcttcaaactctttatttcttaaaattttttttttttttttaagttttggagtttgaatatagtgtctcataaatgatagactcttccattgagttatgtctccagccctaacttaaaaaaagatgttgtaattatcctttcagataagcattaaaatggttttggtctcaaaagcttttgatgattggcataggagctaacagataggtgatactcctaaatgtagttcttcatctgtctgatgtcaatattttctaataaatataggttgattttgaaatatttgagccggcgtggtggcgcacgcctttaatcccagcactcgggaggcagaggcaggcagtatttctgagttcgaagccagcctggtctacaaagtgagttccaggacagccagggctatacagagaaaccctgtctcgaaaaactttaaaaaaaaaaaattgaaatatttggaattgtctgtgtctgatgtagaacagaggggcaaagttgcctgaattcacttgtagtaaagcagacctcttctcactgccagttcacatttcatggtctttgcacagccaagtcgatgagattcattagcctacaagttgtagcactgaccttcagcgtgtatgtaaggtatgtattttagcggcaccacctaaaatgaggctttgcaagtttctggtaagacctgctatacagtgttaggacaaagttgggagtctttaatggcaagctttgcttctttttaaaggtagtaaggtttgagtgacagtttgcattatgtggcttttcaaggtcagttggtgaagatgctgcttttcacagaggtcactcgttacatggacttcaaagtgattgagggaagctttgtctacaagggagggaaaatctacaaggttccttccactgaagcagaagccctggcatctagtaagtaattctcattttatttaacacaatgatgagatttttctggtgaaaaggaatcacagacatccatttatctagtcacaaatacttaccaattatgtaccagttaactttaatgtctgttccgtttagaagaggatgggaaaggatataaaactaggagttttcttatctttatctttcttccagctgtgtgttagtaggaacactgactcagggagaaagcttagggtttgcatatattgccctgtctctctcagcctctctgtgtacatcatacacattattttttagacaaggttttaggatgtagctctgctagaccaggttggctgaaaactcacagagatccacctgcctttacattcaagtgctgaaattaaagatttttttttttaagttttgtttcattatttgcctgtatatatgtgtgtgcaccacatgtgtgcctagtgcccatggaggccagaaggaggcattagatctcatcagcctggggttacaaatggttgtgagtgaccatgtgagtgttgttaactgaacctggatcttctgcaagagcagcaagtgctcctaactgctgagctcttacacacgttcgcgcgaccggccaggaaagacgcaacaaaccggaatcttctgcggcaaaagctttattgcttacttcttcaggagcaagcgagagaatggcgaaaccccgtcccttttaaggagaattatcctccgcctaggacttgtcactccctgattggctgcagcccattggccgagttgtcgtcatggggaaggcagagcacatggagtggaaaactacccttggcacatgcgcagattatttgtttaccacttagaacacaggatgtcagcgtcatcttgcaacggcgaatgtgagggcggctccccacactgagccatctctctaggctgtgtagagcagtgcactgattgtttaagatttcattaaagtaagtgacatacagtgcagtcactaaataagttgtggctaattcttccttggtgtcttggtcttttcccatgaggtctaagtgtgttgtagcattcggaagaaagaaagcaacattcataattttgggaactggctgagttacagataagcatcatagaggaagaacattggtatagatgcctttggagcaatttttttcagtgttaacttattttgtgcctgataagatacagaattcaggctggtaagatggctcagcggttaagagcactgactgctcttccaaaggtcctgagttcaaatcccagcaaccacatggtggctcacaaccacccgtgatgagatcttccgccctcttctggtttgtctgaagacagctacaatgtacttatgtataataataaacctttgggctgaagcgagaagggacttgagcaagcaaagttgactggagcgagtggacttgaccagagcaagtagagagaggtcctaaaaattcaattcccaacaaccacatgaaggcttacaaccatctgtacagctacagtgtactcacatgcataaaataaataaataaatctttaaaaaaaaaaaagatacagaattcaactctgaaactatgtaccatttactgaggttctgctgtgcaattgagtgctgtgaatgatctgtttagagagttgtgcaactagagtccaggttttgtcatgttgagtcatgacattggtgtttaaagtgcctccacagtcttactttctcagtgtcttattccatgtgctttttgaaaaaaatatttttcaggcttaatgggactgtttgagaaacgccgtttcaggaagttcctggtttatgttgccaactttgatgaaaaagatcctagaactttcgagggtgttgatcctaagaagacctccatgagagatgtgtataagaagtttgatttgggccaagatgttatagactttactggccattctcttgcactgtacagaacagatgagtaagtaggctaatggctctcatcacctagctgtgcagaggctgtgagctattgtctagcagtgctaggaggtgtcttcctgcatgtggctttaggcaactttacagttcctgtattagatcagatatttattagagagtatcaacagcagaaaaaagggtgaggattccagtcaggaatgtttggttttcagatctgtgtttttctttaaactttgaactctgagactgttaagtgtgaaacttaggacttgtatgttgctgtctggccctgggaaagagggtctatttgcaaatgagtctaagactgttttaattaggggatagtcctttgagattactgcaggaaaaagagtttaaaatcaataagaagtagtgtttttctaatgttcatttgcttttttttttcccagctacttagatcagccgtgttgtgaaaccattaatagaattaaactttacagcgagtctttggcaagatacggtaaaagcccgtacctgtatccgctttatggtcttggagaattgccgcaaggatttgcaaggtgagtacctattttacccattagccctgaagaccttagatttcatcctgactggtgaaggcaaaaaatgtctctcaataatgaaatgctatttgcttgttttctatttttgagatttttttattcttattaaaattaaataaatttatgcataataaacacaaagcttcagttaagtgaaatatagtttgaaaagtatatagactttatagacgtgtatcatcaaaaatggtttccagccgggcgtggtggcacacacctttaatcccagcaattaggaggtagaggcaggcggatttctgagttcgaggccagcctgggctggttccaggacagccagggctacccagagaaaccctgtctcgaaaaacaaaaacaagacaaacaaacaaaaaacatggtttcctcccccacaaagttaccttaggtcaatcgtaactagtccccttccacatagaaaactacattctctgctcattcgcctctgtggcttctttttgcttagcagtgttgatgagatggctttaggttgatgcatgagctgaggacccacctatattgagagtcacgatactgtgtagattacatggttataccacactccttgcttgcgatgtctaggtttccagttgggagctattataaatgaagtttttatgagagttctgtgtacagataatattgctgactgatgttgaaagtaagattttaaaagtaataagccactgcttttctgagcacttgggccatttttatacacacaacactgggaattttatttattccatacttatttggtactgtttattggcattaaggttatatttattaatatatgtgtgtgtgggtgtacgtgtgggatggacatgggttcttccctacgtagtgggtcctgtgacttgaacttgatatcaggtatatatagtaagtgtctttatcaattttcttttttaattaaaaggtttttgttgttgtttttgtttgtttgtttttgaatttttgagacaaaagtctttctatgtggccctggctatcatggaacttactttgttgatcagagtggatttgagatacattttcctctgtctatcatggtctagaatttaaagcctgggttacagagctcagttttatctttaccttttttgtttttgggttttgttttttgtttttgctttggttttttttggttttttttgtttttttttttttccgagaaagggtttctctgtgtagccctggctgtcctggaactcactctgtagaccaggctggccttgaactcagaaatccacctgcctctgcctcctgactgctgggattaaaggcgtgcgccaccaagcctggtttatctttacttttaatctatgtttttgccagcagtggatattgaacctatgttcaatttcccagctgagccatctcacaggctctatagcttgattttgcatgtctagaaaactaatctttatcaccttttcatgagccatttgtaattttgtgttgtgattgtccaagtcttttgcctagttttaaagatttgggtagttttttgtttttgttttgggggtcatcttgatgttccaatcttttgtcagacccgacgtactacaagtattttcttccagttggtggcttgccttttataagaagttttacattttgtaaagctcactatgtcaaacttattttacatgtgttttgagaactatgaaatctttgggtagcccaaggacacaaaaggctgcttacaacagttttgccttttcatgtaactgtaactgttctcattcactttgaatgagttgatgcataagtgttggagggcttgggcctctccccagggccctgggatgtagttattctagctgtgtttgtgtgtgtgtgtgtgtgtagctgtgggtttttctcttctgtcagtgatctggctttccagttttcttcagtttttgacagtcttgctctttgattatttagattacttttaaaagagccaaaatcagaattttaggtcatgatttctttggctacttggtcacagtttgctcacatgagcagtaatctctcatgtgcggtccttggannnnnnnnnnnnnnnnnnnnnnnnnnnnnnnnnnngttttcccttgcccattcagtcctcctctcccacagagaccacattctactttgatatggcacacatgtacattttttatctattaatatgtcacattatgtatgaaatatatgtatgcacatctaagtcctctgtttgataactgtgatttaagtctctattttgcttaacatgattttcagatctctttttatactgatacttacatttttatctacaatctgtcacccttttttgcctttatttacctcccaatatctcctttcttcccacctctcaaatcctttcttcccagcaattctgtctcatactttcatatcctgtttgtttatggcccactacctttaattagtagatactatagttcatctagatttaagaagggagattttagcggggcggtggtggcgcacgcctttaatcccagcacttaggaggcagagacaggtggatttctgagtttgaggccagcctggcctacaaagtgagttccaggacagccaggggtatacagagaaaccctgtctcgaaaaacggaaaaatggggggggatttttaacagttcttataattgtgaatataattgatgaaaaaaacttttttaggttaagtgccatatatggaggtacctacatgttgaataaaccaattgaagaaatcattgtgcaaaatggaaaagtggttggtgtaaaatccgaaggagaggtaagtaactattgtgaaaaaatgtgctaaacaatgtggtgtggacattgatattacatgttggatatacacatgtgtgctctctgggtctgtctgattgtttaaagttctttttttttttaactacagttttttgttcttccttctatatcttcccacaggtgtctttaggaagcttcagggttttgatacaaaaccgaagtggctgtaatacatttgttgcataactaagtcttaagatgatggcatcatctgtttacagtgctgtgccatactactccctgctagcacacatatggcaatctaataatgatctcttgaattacttctgattaccttgcaactgcccagggaaacttattatttgcaaagctcatttaaatgcttacctgtatttcaataattatgaacttattatgaagagatatagttgttggcttggagattggttttggtggtgcttggggtagaatctaggaccttatactatgtagactcagtccagtattgttttaaaagaaaaaagtataaacactggttaaattataatttagccaaatagttattttgagtaacactccagcgagcactggtgtacaaataactattttcaaaacttgccgtcagttcttttggtttatatttcaagaggctgaactgctgaattaaatagtaattttgtttgtttgtttgtttgtttattgattgagaaattgccatgctgtgacatcaaccgtattatgttccattctcatgagtgtgcaaaccctgccatcacgttctgttttggtagtaggcatcttaataggggtcttatgtttttaatttgcacattactggtgcttttaatgatgtgctatttagctattctttaccctttgtttttgtttgaggccagctttctctatatagctccggctgtcctggaacttgctttgtagatcaggttaacttcaaactctgagatctacctgtctctgtctcctgattgctgggattaaaggcattgccatcactgccggtctgtccattgattttactcgggtcttttttgaagatttttatgaattttagcacttcttgataatacgttgactattactccctatcagatatattatttgcaaatattttttgtcatgtttccttttcttttaactgaattaaaaatttaatacatactgatatacacaaatgtctttgatgtgctaaaatttcacgtcataataaatgaagcttttaccttatatctcctctcttcagaatttttggaattttagttctttatgttttgggttaagttttagattttgttagggtattaataatagttttacaagggcaatgttttttttctgtgtttttggatctcatgcaggtagcccttgctgacctaaagtataaacagtttgtcctctaaattctgttctacctctaagtgatgagattacaggtgtgcactacaagttttttaaatttgccatgtcccagaactggtttgtgaaaaaccacttgaaagcatgcacatttatttctagcttctcttctctgtgtgccaataccaggtaccacactgtattgactgctgtaggctttaagggagtccttaacatgtgttcttttttcaagattgttttattgagtttagtctttagggttcaatatacatttcaggattgatttagagagcttaactttctccatgaatttaggacatacatattgctatgtttccacatctttacaatgaccctttaaatgttttgtcacagattgctcgctgtaaacagctcatctgtgatcccagctatgtaaaagatcgggttgaaaaagtgggccaggtaatcagagtgatctgtatccttagccaccctatcaagaacaccaacgatgccaactcctgccagatcatcattccacagaaccaagtcaaccgcaagtcaggtgagttttgaaggacagatgagggtagaatttgtgaactgtcttagtgttttcatccagatttcctgcctttactctgtactagagaccttgttgtgacatgggaagcagacctgggaagggaagccaggtgtggtctaatacaagtgcactgaatccacttgtgaatccactgcctggaatgtctgcttcatgtctggagtgcatggatgagtcctgtgggcttccagctttgttagttcacttgttctctgttgtagccaagtctgtgtccctggggtgttaatgattatatttgttttagcactgtgctagaaaagaatgtcatttctctgattcaagtcaggacttaacttacttcatctgaaatttcaactccaattttgatttaagcagtgctttttttcaatacaaggtttgtgtattttgtctagaagcaccacatctcagatttcagtcaaatgtggttttcaatgggtttattttttccttccacatagaaactaaaccttgtaacatttttactaaactatttttttaaaatgactctcaagggctggagagatggctccctggttaagagcactgagtactcttccagaggccctgagctcaattcccagcaaccacactgtggctcataaaccatctgtattgggatatgatggcaaaaaaaaaaaaaaaaaaaaaaaagactcgcaagcagtttcagacctgtaaaaacttaaaaatttcaacatttgaaattgtacttagtggtaaatacattgaatctagtttataagcgtaattcaacacaaaatagttacataatctataaatatagaatttccaaaaaataagattcacctggggaagatcttataagatggatgcatggtacctgagcacaggtaaccagctatgtggcagagtgtaggctagaataaatgggatataatctagttaagagacgagcctacctgtatggtcaaggtatttgtaaatttattttgagtctgagtcttataactgggagcatggggctggaaggaagaactggaccaaacttctgtgatgctgttatgaaccccgaaaactaaatgtaaaaattaatgggagtgtctgcagacccacggcctccttctgtatgtctgcccactgtctggagaggaataactgataaaataagtgtttagtcatagtctgaccttaagaaaaatgttaaaaataataaaactcctgtctctttgtggcctatgtaaaatgcttaagatttagctgacttcagactcaccagaagagggcatcagatctcatgatgtgtggttgtgagcaaccatgtgattgctgaaatttgaactcaggatcttaggaagagcagtcttgcccactgaaccatctcaccagtcccaatgcttaagtttttaatataaaaataagcttttaactatttctatcttagaataaccttgactttagtacaaaactaccatctaaaatcctttctcatgggaaagcttttgaaaatttaatcattattagatatatacactatataacttttatatgcattatcttgattaaaatattttaaattatgtaaaaaaataaatgagcaaatcaatacttaataagtcagcttagtgctggatggtggtacacatggcctttaattcccgcacttagcagaggcaggaggtttttttttttttagctgaaggccatcatggtctacagagtaagttctaggtcttccaggactacacagagaaatgctgtcatgaaaaacaaaataaatcctcttagttattcaaaaccttcccaaatgcaggctctagagtggtagaaaagtcccttaatttttttttttttttttttattttgaaacagggtctcactgtctggccttgagccccatatatagacaaacacacccagttactatgattttttttttatatttgatgtgagccatacttggggcagagtttagcatttcatagtcacatacatcctaagtctcttaatgttttagttgagcatttctatgggaaaaccaccccaaggaggagaattttgctcacgtttttagtctgtggtctggtgactcagctgtcattggtctctgtggtcattaacttatgtcaatatgaatatgtggcaacaactgctgcttacctcaaggaaactaggaatgcaaagacaaagggtcttgggcaaagatatgcccactagataattacaatagaatttgtaacagtgggctggtgagatggctcagtgtcaaaggtctcgagttcaaattccagcaaccacatggtggctcacaaccatccataacgaagtctgatgccctcttctggagtgtctgaagacagctacagtgtacttacatataataaatcttttttttaaaaagttgaatgttaaatttacaaggcagagaaaacgtgatacttaagtgtcctgatgtccaaagtttacaagtgtcaggtatgttgttatttgcttctagatatctatgtttgcatgatctcctttgcacataatgtggcagcacagggcaagtatattgccattgtaagtacaaccgtggagaccaaggaaccagagaaagaaatcagaccggctttggagctcttggaaccaattgaacagaagtgagtattgtgcttattcatgtccactaaaatcaaaactgagatgttggtatctgttgcatggtcacataattctgagaacaagattgccattggatgttgtggatctttagagtgcttctggtgtagataataaatcaaagctgtgatacttatctgtttttccccatatagatttgtcagcatcagtgacctctttgtacctaaagatttgggaacagatagtcaggtgagtgtgatgatctaaaaaggatgttactagtctttactgagcaatgtccatccctaagtagtctaattcttacttccagatcttcatttcccgtgcctatgatgctaccacgcactttgagacaacctgtgatgacattaaagatatctacaagaggatgacaggatctgagtttgactttgaggaaatgaagcgcaagaagaatgacatttatggagaagactaacagcagtacatattatgtaataattaggacaaacttaaaatttggcaaataatgtatattgtatgaaatcaatactgtaagccctgcttttatgatcaaaatggagattgaagagtgctataccagtgaatgctccttcactttctaatatcatgtattaacttgttttcatggaatggctagtcagaattggttggttctgttcagtttaaccagactgcattttgttctaaaacaaatattgatatcgatagagaacttgtatcatttaatcagtgtagcctttgcgattgtgtgatccaagagctggatccatacaatttgtgccaccctgaaattgggactctaaattgagtatcctttggtttctgaagacgttcaacgttttctctattttgttatgtcaagtatcacagcagggccaatagaagagagccacatgttttgtttatgagggtagccaaacttcagacctacaacagttgctgagaaaaggaaaggagccttaaggtaaagcaggtaaaatacaggagccccttttatcccagacacggctcctcccccgggaccaagctgcaatgcagtattgatctgacagagcctcaatgtcaacgatgcctgttccaaaatggctccagatgatttctgtactgcaaaataaagccaaactctggaaaccactcttggtattattgagtgtctgtgtcctggactaaaagaactgctgtgcgctaagattttggatgggtgtcatttcctggcttcagtttagtagtcagtgatcttcaaataccagtacaagaagcaacctgtgtttgtttcatggtttgagtgtacaattctttcttaaaggtatcctggtgatggcctaaatgttgcacacagactacaaatgactgcattttcaattctttatttaaaaaaaaaaaaaaaagacaacacaaaacaacaaaaaaaaccaaactagaaactaggtataaaagcctaagtatacaaatggtttttttcttgtttgtattttaaagatttaagaagtttctaatatcataaataaaggatttcttcctcaattgacttttgtagtgcagcattaaaaaacccaagtgtaaaaatttgtcatttacaaaaaattttctttatctatgtagtgtttcttacgtaacagcaaataaccattacagattatactttctacaatgtggtaaaacctctcaaacatgcagttcttaatcctctgaccatatgcaaaaacagctatttctcaaaatagacttagctttagccacataaacgtgagggtctcaagttttaatatttagatcaattaatagttctgaacgcattatgtttaggttgaaaataatttacaacaatattcagcattataacccaaagctaatgctttgatgagaagcaaaacattattcaaatgacagttgtttgtatgtatgtatttggagttttttagacacaggaaaaatatgaagttcttgttgatgtactccatgtatagccaactcccaaaattacctgtaggaacacaaaaatggtaagaaaatgagcaagaaatacaactgggacaataggggggaaaggcctatgtgtcatatatcagtttaccaggtcaacccagactggctacaagtgacatcactggacaaagttaaagctggctgattaatcaaagagcagtttttgatcagcattttcccccctcagtggcagatatctgctgccaataactccagtttccaaggggagttttacaaaaagttcttaccaataactactcctaaatggagctgctatcttttgtatattttcagtgaagtagtttacatctgtaacaaggattccattattttcaaagatttctgtggaaactgtgggcttgtctgtaaaggaaggggaaaaaaaatctatgataaaaggccagggtttttcatttgttcaaggtagcagaattcattaaagtgagaagagaaatgaagacttcagggcaggatgggtagagggaagggatataagctacaactgtaccagcttcagaaagccagacagtccacctaagacttagaagatgtgatatagtaaaacatgcatatgtaggacctgataattagaagagtgttaactagacaaacactccttggcaagcatcctctggacttacaagcatttgtcaaaacacatgctactagctaaggcattcaataactaattaggaaggatatttctacagctgtcctggggtagcattaactgagtagtgaagattacaatttagcttatatttacctgttaggaagacagcaaacctggcactgatatgttgaatttgcaagtttaacaagcatttaaaaatttcagcttttgttgatgatggagaatcacagttgtgataatgaagtaagtcaatgatatttacactctgatatgactttagaattagattctttttatgtgcaattgaatctaccctgtaatatacaaagaaatgttagtaccttttcttgcttaaaattcattttaaattgtgtatttgaggttgaaaaggtatacacgtgaatgtaggtaccctaagagtccagaagagggtgtttgctttcctggacctagttttagaagcagtttaggtcatgctgggaactgaatttggatcatctctcttaactatagaaccatctctaactgtctttcattttaagtagttgtattaaaacacttggtcaacaagcctgtgcttttttcttaatgatcttgtattcaatgtcctgattagctgcctctaaacattatataataattatataataatgacacctttgaaaatagattgtaaccttgggcctcattccaaggcccaagtcacaacccatgtagcttctgccacttcaaccatttatgttagcaacttcaaagttcttaggcagtcatacaaatagaaccactttctcactagacttagtggacgtttccacttatatcaatgctagggatatgtggtggagtcagtcagcaaagaacctgctgggtaagcataaggatgtgaccacagaaaatgccaggtgtcatagcacacacccagggtgacaggctcactggctagccaaccagcctgctgcaatagatgagttccatggttaatgtgacctctcaaaacatacattggacagtgacagaagacatctgatgtaggccaagctccatgcaacctacacaaacacgggcatataccacacacatataacagatcattgctttagattaaggtgacttgcctcctgttaatctgttaaaccctgacaactcaatatatgactaagtacccacaaaaagcactagcactaagcttactgctcactatgtctgcagcttatggcagcagagcctgacttaactgtgggtgttaatcctgactcaaaatgttgctataaatactttgcactgaatgccctactataaaaaccaaatcccaaagctaaccagcagacataaaccttaggaatgtgactcccatgctaacactactttctggctgtggtgcttgaattacactaagcacaacaaacattggaccaggggctactgcacccttcacacacactgacctgacgtcttccttgagatttttactttctctgtagtgaagcagccacttccatttgccattttcatttagtttttctaggattttgagaatttccttcagttgaactgcagagtaagttaagtatgagaagaagtatcttagtttttgttgcaaggtccattgccacttatgaacaacatttgtctccactggcaacatcagtgactccacaaactattctatctggtcatgctataatggcaaagatcattttataacatgatcagtgcacattaatgccattagggaatagagattgccaccactttttcagattcactgcagtacagaacagcattcatcaggaagccaaatgaccacaatacaagcatgtaagtgaggaaaagaaccttcactcactggggaaggaactgaaatctgaacaatttaataattggtctaaatttctctgcaaattctagaaatatagttcccaaatgaaccagctattatacaccaaggttatatatgcaaagccttggtatctagcttgtgttacatgtttattggactctgttcacaatagctatgaacataaatgtccatcaattgaattactatagtaaaagcatgtagtgcagcaattggcacaaattaagccctcaatatacagtaagtgatttctttttgatgaaacagtatgtcactggaagaagagaaactgaactaattagatttcaaaattaaagactaacctaatgttaaactttctagtatgacatcatctgataccacaaagccgcctgatcgaaacagctcttggtaggtttcatttacaatgtcttcagggctgtccactccagcaaagacgacactggggaaatgctttagcttcagtagagaaggaatctgttatgacataaagggacttccataaggaaaggcacatgcaggcaacaattaacattcccatggatttcaatgaccctgaacagctgaaaataaggtatcttcagccaagatcactaaccgacaactttgaaacaaagagtggttctgaccttctcattagtggccatttcttcaccaaaattaattaaaaagaggactttagaaatggttcatgagagaagaacgtgactgaagttcaggggacctataaatagctaggtcattcaaactcactctgcttccagcttacctgtggtgccaaacccacaaggctcatgtcactgcctactgacaatagaaatatgtacctatccactgtccacaaagtgcttcttgggcaaacaactatttgtcaaccagcaggtaaacattacagaagtcctttcaaagcatgattttcttacagtcagacatgaagtacctctttcatagttctccctcagttaacacactattaacctgccctacagaacctgcatgattctatagagttccaccctgtactctcagggattatcttcccactaaaggatcaatggaagtctgtcggctatacctctacacagaatagcaatgatgacttatgatactacagaacagtgtcagtgcctagaacacaaaacttacttgatgcaaatgtgaaatgatgtcttcatttttaatgataactaatagtgtctcattttctctgtgaaacgcttgacagaaatccagaagttcaatttctatatggcctcctttctttagaatgctctgaaaaatttacaaacagctgttatttaaaaaggatacttgtacagaactttttgtttctagagacaaaaagtctctctctataaccttggctgccctggaatgtactatgtaggccaggctggcctcaaattcagagatccagctgtctatgcctccaagtgctgggattaaaagtatgtgccactatgcccaggtacaactatttttatatattaaaatcaagccaccagctgggcatagtgatgtatatatttttggcacttgggagactgaggaagaattatgagttctaggccagcctcagctacttaggaacacatctcaatacgaagcagacaaaaatatttaacagtatgtttaaaaaaaggaaatcctatttctaaggtagcgcaaatagctactggtcttattactaaataaacacacacataattatgaactggatttcagtttttttttttaaagattttttaaaaatttattttatgtatataagtacagtgtggctgtattcagacacaccagaagagggcccattacattaccatcagaccccattacagatggttgtgagccacctctccagccccctggatttctctttttagttcaattattagtgtttttgtgtatatatgtaaacggatgcacacacacatgccatggactgcatgtggaggtcaggtggtaactttcaggatttggttctctcctaccatctgggtcctggggctccaactcaggttgttaggtgtggtgtccggtctcttttcttactgagccatctcagcagcccaagcaagaagttcattttagtgataaaagcagtttataaaatatcataggctgctttaaagaaaaagtccttagccaggcgtggtggcgcacgcctttaatcccagcactcgggaggcagaggcaggcgaatttctaagtttgaggccagcctggtctacagagtgagttccaggacagccaggggtatacagagaaaccctgtctagaaaaaccaaaaaaagaaaaaaagaaaaagaagtccaaaatagtacgcatacatgaagtttcacattcaagggagtgagactggacaggtttgctaggtgtttacataatgctgttacgtttactatataccgagaattttagcaacataccagtaatgagaaccaacttgaagagttaattgttccttggctgtccatatctgaataaaagggtaatgcactttccttagccccatcctcccttacgcctcttatgtaatgcttttgcatgaaggattacggcttgccattggacaccccaactatactccacgtgcagtcagaatgtttattgtctttgtgatgtattactttgtctgctttggatctcccaaacaggcaaactgactattttattatcacgcaaaagggacaatataatttttaatcaagttcttttaatagtctactgaaatatttaagattgatctgtcactgtttgcagatcctcatcttacaaacagtcctgcatcccaacactaaagaatagttcacaacttgccagagttattcagaatgtttccaagtcttatagaactctgtgctgtgagagtcaggcttcaaaccatctgtaattctcccatctcagtcagccaactgctaccacacccaacacacattgtgctcttgaacacatataaatctcaagttaattttagtatgtgttcatttcttcacttgaaaattgtacctttgtacaaacatgttactctttattataaacagtgggctcatggtgaaatattttcattattttcaaaccattcaaaagccggtgggcagttatgagttactgggtgggtgctgggaaccaactccaggccctctgcaagaatagccaagtatagccgggtgtggtggcgcacgcctttgatcccagcacttgggaggcagaggcaggcagatttctgagttcgaggccagcctggtccacagagtgagttccaggacagccaggactgcacagagaaaccctttctcgaaaaaaacccaaaaaaaaaaaaaaaacaaaaaaacaaaaaacaaagcaaggaagcaaacaaaaaaaagaatagccgagtattataactgctgggccatctgtacgatccctgctaatacctttaaaaaaatattagtgagtcctttcctagcatggttctttcatgtgtctccaaagtcatctcttgacagtaacctatgtccagtgatgttgaccagcctgtcatccttgcaagctgggttcttgtcccttctgttccctctgttttacatattttgttttctgctgccttgtttttgtctgcatcactaagccctttgtagaatatatctgaattagtataaaaattacttttcccaaaatgttaccatgacagacatgccttcatttcagaatttattacctacttccctccagtgtatcatcaatgaaaaggatatttggtgtgtgagttctgtgtaaaaatgaatgtgggcaccaaggttggtattcaggtgtcttctattgatctctaccatattgatatagggttttctacctatcccagagctatttgactagaatggctggtcagcaagccccaggaattcacaagtgtttggatcacagaccacatacacagctttttgaatgagtgctgtgatcaggccttcatatgctgactcacattttactgactttatgtgacatcatcaaagtcctggaatataatttttctcttaaaaaaaatttgaatggtaggtaagaatgtggtcactgtaaactaatgtaaccatggtcaaagtgtgacatttggggatgccatcatttgttttgattcaccattagccttttcacttttgccccattggaatttctgttccatttgagttattgacaacacctgccacgtagcacacaggattaaaaactatatatcccatcccatcccatccctttataagcccaaacttccaagtttcttacttctaaaataaactgagaagataatgcagtatatagagtaagccagtactttacctttgttcttaaaaggaatgacttatcttctgtttcaacgaggtagaaccagaaagggctcttacaagcctctctcacaactccttttagtttgacatgcagagtggcacataagtctgtgatcacatcttcgtaggatactggctgtcttggctggtatgcctcctggaacacagcttctgcagaagctacatttaattcttcatcttgggaaacaatttgcttgctattcatcattatcttattaaattcagcatattcatttagaataagtgaaatatcatttctagattcttttaaagtactgttgtatttcagtttattgaggtggaatggaacagtctgacttctttcagaatttttaagatttctactttggctacattttttcttccaaaaagaggaagaaccgtcgagactgctgggtgagcagcctcttctgtgatgactctgctgcctcgtgtctgcgcgtacaactgtcaccagaatggggcttctgctctcgggtggaagatgcagacctgaggcctcagatgtttgtgtggaaggggatgttccacttgagatttggacgagcgattccttagggaaggaagattgttgagaacctcccttctttatttgttttagcttatgatcaaaacgcaagtactctaggtctaatgtatgctgagtaaggtcatctgtcacatgccaggtactagtccaggagctgagaaggttgcagtttgcactcaaattccgatgcctcttcaggctatgcaaccttcttgtggtatctttgaattcttttgttatagtaaagttagcgtaagtcttggggataccatgggaatctgggatctggatgtagcgtggtatacacttatttggtgagataagacgtggctctgtttcctgatctctgggtggaatgtgtgtctcaagcgttgaaattttgctagaacaggcccaggtgtcatcactgttgtttaagcttgtgaaagagtcacagctatcttttacagcatctttctggctttcgtgattacctctcaaattctccacatcgaatttgcagcttttacaatcatgagaatcctgaacataggctccagaacgtggtccacagaacatggaagcatttacacttatctctgtattcctgctcagtgtttcagcatctgccttggtttcatgtaccatgttagggctttcattgaaagtatgttctttgtagacgccacaaatagcatcaacaaattctgggacaaaggaagcagaaggctcttcactgatacttttactgaagtctactgtattttgacaagaatgagcattttgggagaaaacatcaccattcaagaactcttttacttcacatattgtgtcctgcagcacatgcattgttttttgttcatcttttgcagacatggagttagactgaagtccagtagcactgagatccatcttttcttcatgtaattcaactccaatattcttaagtaagctggccattctgactactggtatttcctgtgtttgaaaccctggctctacacttactggttttgcatgataggtgcactgagcactatcagaggaagaaacaaactttgagacttctggatgagagtatgcctgaacatcagttttgtcaatcaaggcagagttcactgcctcagtctgcatattactat

SEQ ID NO: 944 - DNA, 1391 bp, Mus musculus
cgagcccccgcgtgcgctcctttccccgccatgaatgaggaatacgacgtgatcgtgctgggcaccggcctgacggaatgtatcctgtcggggataatgtcagtgaatgggaagaaggttcttcatatggatcagaacccatactatggaggagaaagtgcgtctataacaccgctggaagatttatacaaaaggtttaaattaccaggacaaccgccagcatcaatgggaagaggaagagactggaatgttgacttaattcccaagttccttatggccaatggtcagttggtgaagatgctgcttttcacagaggtcactcgttacatggacttcaaagtgattgagggaagctttgtctacaagggagggaaaatctacaaggttccttccactgaagcagaagccctggcatctagcttaatgggactgtttgagaaacgccgtttcaggaagttcctggtttatgttgccaactttgatgaaaaagatcctagaactttcgagggtgttgatcctaagaagacctccatgagagatgtgtataagaagtttgatttgggccaagatgttatagactttactggccattctcttgcactgtacagaacagatgactacttagatcagccgtgttgtgaaaccattaatagaattaaactttacagcgagtctttggcaagatacggtaaaagcccgtacctgtatccgctttatggtcttggagaattgccgcaaggatttgcaaggttaagtgccatatatggaggtacctacatgttgaataaaccaattgaagaaatcattgtgcaaaatggaaaagtggttggtgtaaaatccgaaggagagattgctcgctgtaaacagctcatctgtgatcccagctatgtaaaagatcgggttgaaaaagtgggccaggtaatcagagtgatctgtatccttagccaccctatcaagaacaccaacgatgccaactcctgccagatcatcattccacagaaccaagtcaaccgcaagtcagatatctatgtttgcatgatctcctttgcacataatgtggcagcacagggcaagtatattgccattgtaagtacaaccgtggagaccaaggaaccagagaaagaaatcagaccggctttggagctcttggaaccaattgaacagaaatttgtcagcatcagtgacctctttgtacctaaagatttgggaacagatagtcagatcttcatttcccgtgcctatgatgctaccacgcactttgagacaacctgtgatgacattaaagatatctacaagaggatgacaggatctgagtttgactttgaggaaatgaagcgcaagaagaatgacatttatggagaagactaacagcagtacatattatgtaataa

SEQ ID NO: 945 - protein, 455 aa, Mus musculus
RAPACAPFPAMNEEYDVIVLGTGLTECILSGIMSVNGKKVLHMDQNPYYGGESASITPLEDLYKRFKLPGQPPASMGRGRDWNVDLIPKFLMANGQLVKMLLFTEVTRYMDFKVIEGSFVYKGGKIYKVPSTEAEALASSLMGLFEKRRFRKFLVYVANFDEKDPRTFEGVDPKKTSMRDVYKKFDLGQDVIDFTGHSLALYRTDDYLDQPCCETINRIKLYSESLARYGKSPYLYPLYGLGELPQGFARLSAIYGGTYMLNKPIEEIIVQNGKVVGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLFVPKDLGTDSQIFISRAYDATTHFETTCDDIKDIYKRMTGSEFDFEEMKRKKNDIYGED

SEQ ID NO: 946 - DNA, 54701 bp, Homo sapiens
  misc_feature (1)...(54701): n = A,T,C or G
caacttctttaacaaactaagaaacataatttacttgataaccaagttttcacatagtgaagattaactattgtgttatgctgtaacatggtgaagccatgaagaccccgccagctttgtaggaacttttgccccctttactctcaggctgctatgctttttgagctcttcagtttactcttcatattttttccctctatcttactttactgttaggctggcaacatttacttttctctgctttcagcatgtgtaggcagcctctcaccacataatttgcacatagttcactatggacttggaaataaattcacgagtcttgttagacatagtagattaaaacaataagagtaactagttccacagctgtttgtgcttcccagaggtttttttcttcccattttttgttctacacagtaagaatttatgaatagaaatatatactttagtgatgtataccagatgattctcagcatcatatgtttaaaaacttgctttacatcccagatacttttcctcatttctctttatcagaattttgtgatttcagattcagagaaggttttatacttgattttaaaattctgaactaaaattcagattgcctcttggatttgcttaatctttgatttgctctttgagagttcttgcttatagctgtgttagagttctgtagacaaaggactttctattcactacagtagtgagcataggatcaatatttgcaaatgctgttacacttgggagctgtgttgtaggcagtttaaaccagcgttaagcatcctggccaaaagaaaatataagtgaaattagacatattttagcatgtagagatgacaatagtgtgacattggtttttaaagaccactggtagatgttcacatgcgtgatacactgcaattacctctgtcttccctcccatggtacctgattggagactcttactggagtaatagtttcagtttcagttatttaaacccagtgactattgtgatcagttatgggcagtaaaaaggtaaacacagaacctgtctataagtagcttgttctcgtgttggagagtaactaataagaattagtatgagaaagcattaagtcccctaagaggtgcacttatatgagttcagtcagggaatcaggaaaaccttcgtaaagaaggagatatttagctggctttaaaaaaatattggcaaggtttgaatggaggaatgattttttaggcagagagcagtcagtgtaagtcaatgctaagtcaaggatgtatgtagggaatggggagtggtttgttttgcttgaaacagaagctttggagagagattctaggctaagaaatgtgaaaattatcttcaaggcagtgagagaggactttgagcaggagagtgatataattagccacatttcaagagaaggtatcttttgacagtttttttttttgtttttttttgagatggagtctcactctgttgcccaggctggagtacagtgatgtgatctcggctcactgcaacctctgcttcccaggttcaagcagttctcctgtctcagcctcccgggtagctgggattacaggtgcctgccaccatgcccagctaatatttgtatttttagtagagatggggtttcaccatattgatcaggctggtctcgaactcctaacctcaggtgatccacccgcctaggcctcccaaagtgctgggattataggcatgagccaccgcgcctggctgacagtttttaatgagatgcattagaggggcagagtcatttaaagaaacattcttcataaaacagccatttttattatgttgctgtaagatacttgccattgaaatgaactgatttaaaatttttctggttaatttctcatgtttctaggtaagtagttttgaaaaggcactttaatattagttattagatactttgtactcctgatcacatttgtgtgtgttgtgtgtgtgtgtatttgtagtttttttttttttttttttttaataacaacaatactttttatttctgagacagagctctctgttacccaggctggagtgcggtggttcaatctcagctcactacaacctctgcctccccggttcaagtaattctcctgcctcaggctcccaagtggttggaattacaggtgctcaccaccacgcccggctaatttttttgtatgtttagtagcaatggggtttcaccatgttggccaggctggttttgaactcctgacctcaggtgatctgcctgcctcagcctcccaaagtgctgggattacaggcgagagccaccgcacccagcccataacagaactttaaaatgcagtaggatttgatagggtgtagaggattttttgtttgtttgtttttgagacagggtctcggtctcttacccaggctggagtgcagttgtgtgatcacagctcactgtagcctcaaccttccaggctcaaatgatcctcccacttcagcttcccaagttagctggaactacaggaggcatgtagtttgggtattttttgtagaaatggggttttgccatgttgtccaggctggtctcaaactcctgggctcaagcagttcttctgcctcgtcctcccaaagtgttaggattacaggcgtgagccaccttgcccagccagggtatagagtttagtttgtcactaggaaggtatatcaaaatattaataaattttggctctattcccttccaagtctaaattgctctgtaatcggggttggggagtgggcattaatttttcagcataccattgttactggccgtggaaacaccatgtaggtgtaacaattcatatatagaaatttcattcagcctcttcaggtgctttgtctaatatatttgggtgttgtccaaatgagttattctgtttttgatgattgcaactctggtggtatgtgtagggtgctgaaggaagagaacgtcagtatcgctgatggttctgtcccccagccccacatccacatatctacacgtactagcactttggtgcaattaaatattaaaaaccattttggttggttacctgtttttatgtaggagaacgtcaagtgccaggtgggtggcagatgctagtgtcatacagaacttggattctgaagatggttttatagtcttagtgattttggatgtgaatatgtattcttatcctgcttaggtcatttgtaggtgagtttgaagttacagtgggtactcttacctgttacatttacaactcatgttggtgaatattcattcacatacaagtttcgtggttaaagttacttgatgtacatgatagatggaccagcttttctagtgtgaaaaagagaagcttagtttttatggctttaatgtgctttgcttgtgaatattgtgtattcatcagataggttgtagtagaatttaattttgagctggtaattttggaaaaatattaaaattttaggatcattaatatatactgtgcccagatatgactgataaattctatcaattaatgacttcacccatgttttaaaacaaagtttattatgtttgtgctattatatattcttttagcagtgtggaagcagtcttttataatagttgggtatagaggaactagtgggcctgcagattttttattagctttagttagctcttgtcatatttgctccaagtggtgcctttgaaggtagttgctgtcagctctttggactcggccacatctttaaattactgggccctttattttaggcctcagtgcttgctttacggccatagtccagtgggtcatgcttagtgtgaaaggttatatatagaagctgtgcaacactccaatttgcttgctgagattttgctttcaaaagtctgcagtctacttttgtcagctgggaatgtaactgtcttcctctgctgtgtcataacttatttttaagatagtaaatattttattttcatatgtggaactatatgttggtgctgctttaggttgttttcttcccccaccccccaaaagtaaattgttttagtcagtattagggttgatttttgtagttgttaaaataccttcatttccttttatgaagacataatgaagaaagtgaaaaggcaggccacagaatggaagaagataattgcagtacatgtaactaataaaggatttatatatagtatataaagtacttttataaagcagcgagaaaaagcccatttaaaaaatggggaaaaattttgaataggcacttatcataagtgccttatcacttagcttgatcatcagtaaacgtttttttgtttttttttttttaaattttcttttgtagagatgggggtctcactgtgttacctgggctggtgttgaactcttgggcttaagcgattctcccaccttggcctcccaaagggctgagattataggcatgagccaccatgcccggtccctaatcattaatcaactatttaaaaagtgttcaaccttatttgtcctcaggaaatgcaaattaaatcacttcttaactagaatggctaaaattaaaaaggcaacagtgtaagtggtcaaggatttgaaacagtggggactcactgcggacaaaagtgtaaattggtacaaccgtttttggaaagctgtttggtaatatctgttgaagttgaatgtatttatactcttcttgatatataacagaaatgcacacttagaagacacatgcgagaatgttgatagagcattatttgtaatagtgaaaaactggaaactatccaaatatccaccaggagtaaaatggagaagtaaattgtggtatagtcattcagtggaatcgtctacagctgtgttacccaaagtgtgctgcatagatcagctgcatctgcaacacctgagaatttaccagaaatgcggaagtttaggccccaactcggatattacacagaatcagaatctacagtttaacaggatctccaggttattcttatatataataaaatttgcaaacacagctttagtaattcttgaaattggtcctggaccagcatcatcagtatcacctcatcagcatcagtggtggctgacacctgtaatcccagcactttgggaggacaaggcaggaggattgcttgagcaaaccttgctttgcaaggccaaggctgggctacatagtgatatcctgttgctacaaaaaattaaaaaatttggcaggcgtggtggcacatgtctgtagttccagcttctcaggaggctgaggttagaggatctcttgagcctggaggttgaggctgcagtgagccatgatcacaccactgcactccaggctgggcaacggagtgagaccctgtctgcatcctgccaaccttttttttttttttttttttttaaagagcaaattctcagatccaacctcagacctactaactcagaagctctgtagatggggcctagcagtctgtgttttcaagccctccaggtgatttggatacaacctgaagtttggaaatctgggtagaatttacatttctaacaagttggcaggtgatgccaagtcaggaaccacactgagatgccctgcttgcagggttagccatacactctgaaaagctcccgatagtagccgggtgccatggctcacccctgtaatcacagcactttgggaggctgatgcgggtggatcatgaggtcaggagtttgagaccagcctgtccaagatggtgaaaccccatctgtactaaaaatacaaaaattagctgggcgtggtggcgcacacctgtagtcccagctacttgggaggccgaggcaggagaatcgcttgaacccaggaggcagaggttgtggtgagctgagatcgtgccattgcactccagcctgggcaacaagagagaaactctgtctttaataaaaaaaaaaaaaagctccagatagtaaatattttaggttatgtagacgttctggtctctgtcacagctgcccaactctgctgtggtactaggaaaacagccataaacagtatgtacatgaacagatatgggtatttaccaataaaacttcacagaaatagccttcaggctggatttgtctcatctctggggacctttgctctatagcaatgataataaatagaccatgcacaaaacatgaaagaatcttaaaacgtgttgcataatgtcagacgcagaaagttaatacacatgattagatttttagagttcagaagcgggcagaacaaatctttgctattagaaattatgagagtgctgggggatggtggtggttatgattggaatacggcatgagggccttctggagtgctcagaatgttttgtttcttgagctaaagaaagaatgattcaggctgggcgtagtggttcatgcctgtaatcccagcactttgggaggccaaggtgggcagatcacttgaggccaggagttcaagaccaacctggccaacacggtgaaaccccatctctactaaaaatacaaaaattagccaggcgtgatggtgcatgcctgtaatcccagttatttaggaggctgaggcaggagaatagcttgaacctgggaggtgaaggttgcattgagccaagatcgcgccactgcactccagtctgggcaacagggtgagactcctatctcaataaaaaaaaaaaagaaagaatgattcacactcctatagtgaaatttgaacctcatggtaagtaatttaagacatttaagaaatactaaatgaatagatacattatggaagaaaacttgaaatttgtgtgaattttaaaaatacgggtttcaaagtcaaatagacttgtagagaataagattgttctttgacatctagggtcctttggataaatttgagaaatattaaagatttataaagatacatggaatttcctttgtctctttaagaaataaagcactgatcactcaaaccctttttgagtgattatatgccccatctctgtgtttcttcacattaattgtattaattttttccctcttcttaatttggtttgtcttagtgtattcatgcttgctttatctttttcctgagagtggtcatttatacttttcggttgatggtcaatttattggtggttgtcctatatgctttgcttagggctctagttttcaaactttttagtctcaggatctgttcacgtgctaaaaaattcaggaccttgagcttttgtttataaaggttgtagctattgatatttatcatattagaaatggaggaataaataaatcactgacaaataataaaccgattacatgttaacatgtataacaattttaactgtatatgtactttttttttgttattgagataggatctcactttgtcacccaggctgaagtgcagtggccttatcacggctcactgcacctttgccctcatgggttcaagtaatcctcccacctctcagcctcttgagtagcagggactacaggtgctcaccaccacacccagctaatttttgtattttttgcagagatagggttttgccctgttgcccagactggtctccatccaactcctgggcttaagccatctgcctgagtatattttctaaaacaaaattgtgagaagactatcaatatttcacgttttctgcaaatcctttaatgtctggcttaataaaactgaattcacatacatgcttctgtgttcagttctgttgcgatatattgtctaggctgaagtatatgaaaacaggtctcacacagacatgtaattggaaaagggaggagtaatttaaatatagcctttcaggttattgtagatattctttggtttacacaaaagcacaagtggtagtttttaagagatagcagtatgaaatctgaagccacattaatgaatgttttatattctgatatattaacacccactgatctagcttgcactttgaattcctcttttttcctcctgtgtgattttgtaatttcattcacccgttatttggaaaacaaggtttactctgagtaaagtgggtcttaatgttgacatgtttcattttacattatcaaaacatcatatttgttagtattgtcactgataatgttagaaaagttcttcatatattggggaacctgacgtgtgcccatggtggtagttgtaagttttccataattcttttttttttttgagatggagtcttgctctgacaccaggctggagtgcagtggcgcgatctcggctcactgcagcctccaactccctggttcaagcgattctcctgcctcagcctcccgagtagctgggattacaggcatgcgccaccatgcccagctaagttttgtatttttagtagagatggggtttcaccatgttggccaggatggtctcaatctcctgaccttgtgatccacccgcctcggcctctcaaagtgcttggattacaggtgtgagcagctgtgcccggccaagttttcggtaattctaattttcatttaaaatttgacttattggcagcacgtgtcagttattttcctttaggttttctttgagaaaatgtcaaatacctaaatctgaataatcatagtttgttggtcagttctttcaaataaaaatgattattcataaaaaaaagcggctagttcagcttacagatcagtggcacaggttttccctgagctgaagtgctgtctgtattcttcccattttttcacacacaatgtttaaaagatgactattgaagggtatatgtttattaaataactttattaattctttttgctactcagtcttgctctgtcacccaggctggagtgcagtggcgtggtctcagctcacagcagcctctgcctcctgggttcaagcagttctgcctcagcctcctgagttgctggaattacaggcatgcaccaccatgccctgctaatttttgtgtatttagtagagacagggtttcaccgtattgcccaggctggtctgaaattcctgggttcaagcattacacccacctcggcctcccgaagtgctgggattgcaggtgtgagccaccatgcctggccaataaagttactttttaatgcttttatcaaggacatccttttttttgttcttgagatggagtttagctcttgttgcccaggctggagtgcagtggtgtgatcttggttcaccacaacctctgcctcccaggttcaagcaattcacctgccttggcctcttgaatagctaggattacaggcatgtgccaccatgcccggctaattttgtatttttactagagatgtggtttctccatgttggtgaggctggtcttgctcttctgacctcaggtgatccacctcccctggcttcccaaagtgctggggattacaggcgtgagccactgtgcccaccctatcaaggacatccttaaatgaatgcctggcgatgaagactgtaatgatgactagtatagtttagagccctgtcttaatttgttttatccaccattgattttacatcatcagtggaagtgtcaacactgaaaaggtgactaggctgggcacgatggcttacgcctgtaatcccagcactttgggaggctgaggcgggaggatcacctgaggtcaggagttcaagaccagcctggccaacatggtgaaaccctgtctctgctaaaaatacaaaaaattagccgggtgtggtggcgggcacctgtaatcccacttactcaagaggctgaggcaggagaactgcttgaatccttggaggtagaggttgcaatgagctgagattgcgccattgcactcctgcctgggcaagaagagtgaaactctatctcaaaaaataaataaaaaaaaaaaattaaaaggtgactaatgtcttagtgttattatgaaacagttttaatcttgggatgcataggagcccacagaccacacctggacccctggtttcttaagggctttcttcataaattatgtcatgttgcatgaatataagtgtaattactaagagaatgtgtaatggcaggcttgaaaaaaatgatctgttttaaatatgctgtagaactttcttttcaaggtactatgctttttctataggaatgtatcctgtcaggtataatgtcagtgaatggcaagaaagttcttcatatggatcgaaacccttactacggaggagagagtgcatctataacaccattggaagatgtaagtgttagtcaaatttcatacgcctctcacactttgtgagtatttcacttgtgaatctctaccttattccttagagatggtcttaattttgttttgttaaatggaatatctggagcactgtttttcaggagcttctggtttgaagctcatagaaatttacattttgacttttgttgctatgtggagcagttatctcttagcgttaacagagaatagtctaggaagggagggtagaggatcgtctgatgtgccagcgcaagtccagtgctttcctcatggctttatttattttctcagtccctcaaagattttttttttaatctccatttaacatagtctctgtggggttaaaatctgagatgggttgtaaacccaagttacatgactacaaagcttagttccttttgctatactgccttgtttcctactttttttgaacgtggacacatagcatttccacagtgtgttttaatatattgattgtttttctgcgtgaggtttgttgaacacctacgtatatggatatgatgtgtactgtgtcttatgggagatagatatcatcaatgactttaatcagtgacttattagacaatacttaccaaaaaggatttttttctatattcagtaatactgaaaagtttaaagaataatacgatgtataaaaaaatcttccatcagagttcagcagttaaagtttgctgtatttttttcatgtctctttttttgttactggttttgatccattgaaagtgataagacatcatgaggcttgagcaaaatatttcagcattcatctgctaagaataacattctcctgcataagcataataccattatatcatatccagaaccatattcaaatttcccagtggtcccagtaatctcttacgtagctgtttgtatttggtataattttctctttattctcttatttatttttctggagacagaatcttgctctgccgcccaggctggagtgcagtggcacagtctcgcctccctatggcttccaccttctgggttcaggtgattcttctgcctcagcctcccaagtagctgggattaaaggcgtgcaccaccatgcctggctaatttttgtatttttagtagagacggggttccaccatgatggccaggctggtctggaacccctgacctcatgtgatctgtctgccttggcctcccaaactgctgggattacaggcatgagccaccacgcccgagcgctttattctttgttgttgttgtttgtttttaagagacagggccttgccctgttgcccaggctgaagtgcagcagtgcgatcgtagcttgctgtagccttgaactcctgggctcaaacgatcctcctgtatcagcctcctaagtagcggggctaaagatgcataccacctgcctggcttattttattttttgtagagatggggtctctctgtgttgcccaggctggtctcaaactcctggcctcaagtgatcctcctaccttggtttcccaaagtgttgggattataggtgagagccaccatgcctgggcacctctttattttcttaatctacaaatctcctcacaatttttttcttttcttaattttgttttattttatttttatttttatttttttgagacagtcttgctctgttgtccaagctgatgtgtagtggtgcagtctcggctcactgcaacctccatctcttgggttcaagtgattttcatgctcagccttctgagtagctgggattacaggtgtggaccaccatgcctggctaattttttgtatttttagtagagatggggatttcttcttgttggccatgctggtctcgaactcctcaaatgatctgcctgccttggccttccaaagtgctgcggttacaggtgtgagcctctgtgcctggcctagtatatttcttagctgatcttcaatacaatgagtaagatttcttttcttttttttctccccagatgtattgagggagtcatgaattttttcttttttttttttttgagatggagtctttctctgtcacccaggctgcagtgcagtggcacgatcttagctcagtgcaacctccacctcctaggctcaaacgattctcgtgcctcagcctcccgagtagctggaattacaggcgtacatcatcacgtctggctaattttttgtatttctggtagaggtggggtttcaccatgttgatcaggctggtctcgatctcctggtctcaggtgatctgcctgccttggcctcacaaagtgctggaattacaggcatgagccaccgcacccagccagaatttttattgaataaatacttactaattttgcttattcttttccaccttagcagtaggattcatgagctcaagtgactgttctctaactttataagctttttgaaatctgagcttcatttcaattcatgtgaattataaattaatttgagtattcttaccacaaaacatcataaaagaacaaaaggacaattttggaggtgatggatatgattggtaccttatggtgatgttatgggtgtaccttgtgtctagactcaccaaaatgtatgcaggaagtaggcagttctttatgtatcagttatacctcagtaaagctcaaaaattataaatgaactagaactaattttaattatcttttctgattaggaagaatctaaggtttattttgaattccttacataatacaaaagcaaaattaagcctttgatagctttttatttgggagagaatgaatttagatgattgctatttgtcagtgacaccctagttctgcatatacagtccgtatagagaactatacagtgtcattgacaaataatcttgttttatttatttatttcttgagatggagtcttgctttgtcactcaggctggagtacagtggtgccatcccagctcactgcaacctccacctcccagattcatgtgattctcctgcctcagcctctcgagtagctgggcttacaggcacacaccacaccccgctaatttttttttttttttttttttttttgagatggagtctcactctgtcactaggctggagtgcagtcacgctatctcggctcactgcaacctctgcctcgcatgttgaaacgattctcctgcctcagcctcccgagtagctgggattacaggcatctgccaccatacctggctaatttttgtattttcagtagagatggggtttcaccatcttggcctggcttttcttgtactcctgacctcctgatccacccgcctcggcctcccaaagtgtttgggattacaggcatgagccaccatgcttggccaatttttgtatttttagtagagacggggtttcactatgttggtcaggctggtctcaaactcctgacctcaagggatccacccgcctcatggattacaaagtgctgggattacaggcatgagccattgcgtctggccttgttttatattctttcttttctgctagtgaaaaaccttacttctgccatatttgttaattttaacatttatgagtttagtaattaatttacatatatattggaccttgctaaaaattttatctgataaaagatgaaatgcccttatactttactagcatggtggtgtttagttatactaaaagcacttaataaaaaatatgtacatattgtaataaaaaattaaattttgttaacattatggctatgtttttccttgcttttagttatacaaaagatttaaaataccaggatcaccacccgagtcaatggggagaggaagagactggaatgttgacttgattcccaagttccttatggctaatggtaaagaatttctaacttaaatttatgacagtactttgattacaattttaatatcaaaactaacttttgacagagtactattctgggtatgaggaactggattttgttgaatgaaacagcatggtgagtaacatggtccattagatgtctggagtcaataagttaggaaaggaaggaaggggttgtgacttactagtaattggttctggagaaacaaatgatgctgtggcataatacataacaagattgtaagcctttggcacagacttacctgttgatgcttatgacagtcttaaataactgggccttttgaaacagcattattttaatgtttttctagtttgtagggttttaaaattttcacatttttttaattttagaggatctaagttttctttttctttttttttttttgagacggagtctcgctctgtcacccaggctggagtgcagtggcatgatcttggctcactacaacctccgccttctggttcaagcaattctcctgcctcagcctcccaagtagctgggattacaggtgcgtgccaccacgcccagctaatttttgtatttttagtacagacagggttttaccatgttggccaggctggtcttgaactcctgacatcaagtgacctgctcgcctcagcctcccaagtactgtgattacaggctaagtatttttttaaattgctgtaatattagtacttttttctgagatgacattgaaaaactaaatttttggttataggtctgtttgtgcacatgaaataaagcatctgctatcctttttccttgtttgagtttatattctattgtttgtttttattaattttttttagagacaggggtttcactctgtcacccaggctggagtgtagtaatgcaatcatagcttactgaagccttgacttctaggttcaagtgatcctctcacttcagtgtcccaccacacctggtgttccaccacacctggctaatttttttgtgttatggtagagatgaggtctcactgtgttgtgtgggttggtcttggactcttgggctcaaacaatcctccctccttggcctcccaaagtgctgggattacaggtgtgagccacctgtgcctggccaataatactataattccaaacctcatatctctaataaatttttcattgcttttgcaaaagcaagttgatagaattattaacctttaagttgtaacattaaaaaaacctatgtattcaaccttgaataggaaaaaaagataaaaaataacaaaaacgtgtaatatgcagtgcaataagtttgcattctggttgtcctatttaaaatacagctttggaggttattttgggccaggcgcggtgcctcgtgcctataatcccagcacttgggaggccaaggtgggtggattgtttgagcttaggagtttgagaccagcctgggcaacgtggcaaaaccctgtctctacaaaacaatacaaaaaaaaattagccaggcatagtagtgccaggtactcaggagcgtcaggctggaagcttgcatgagcccaggaggctgaggttgcagtgagctcgtgattgtgccactgcactgtagcctgggcaacagagggagactgtgtctcaaaaaaaaattattttgttggagttattgaacatcgttagaaaaaattttagaagctgttagtattagtaagtgttctttataatttatagacttaagttatagtttgaattatgtgacttttctaggtcagctggttaagatgctgctttatacagaggtaactcgctatctggattttaaagtgactgaagggagctttgtctataagggtggaaaaatctacaaggttccttccactgaagcagaagccctggcatctagtaagtagttttattttctctagtaactagttttattttctcagaataatgagattttatactggaaaagagtcttagagaggacccagtcaacaaatatttattgaatgtctatcatgtgccagacactgttctaggcagttgggaacacatcagtgaacaaaatgttcaaaaattcctacccgtttgaagcttagagtttaaatgatcatctatagatcatgtaccttgtggctggtggatctgagcttatctagggttaatagtgttcttttcacagtaattcataatagctatgctttctgttgagtatttcctgtgtctaaaggctctgtactgaacactccatattgttttcttatttgacttctgaaacatctctatgacatagggtctccattttataggtgatgaaactcaggcctaaaattgcatacgtaataagtagctgggataagtagctgggttggaagtgaaatgctggtagtgtggctccagagccctggtgcttaatcatgttactaagcttaccctacgctatattacccaacgtgccaacaggagaagtactcattctgatgatgctcatcttctaattggtcttgttagtaattcccaatatctttgattttaggaactcctggtgagttttatnnnnnnnnnnnnnnnnnnnntttttttttttttttcttttaaagacagagtctcgctctgtcacccaggctggagtgtgatggcgcgatctcagaggctcactgcaacctctacctcccaggttcaagcgattctcctgcctcagcctcctgagtagctgggactataggcatgtaccaacacgcccggctaatttttgtatttttagtagagatggtgtttcaccatgttggccaggctggtcttgaactcctgacctcaggtgtttcacctgccttggcctcccaaagtgctgagattacaggcatgagccaccgcgcccagccttggagtgatcttattctctgcccaacattatttcctctgttgcctcaccaaagagttctggttaacatttcctatttcagcgtctctcttaaatagcaaacagtccagaaaagacctttttgttcttcaagatgttttagtccttgtatggagcagtttggagaaggataaatttgtataactaagggtaggtgagggctctaggagcttagaagagggaaagtgctcataagttctctcataattattttggcatcagcgctgaaaagttttctcatctgtaaacctaatttgaattattttggcagtttcctctattaacttctgattaggggagaaaatattgggtataaaatattaaagacatagccagaaagtaaaaaatactgcaaagaatcagggctaggttaggactgataattggggaagggaaggaacagtttctcattcagttgcgggtagttagtagtgtaatcatgggttcgaaattattttaaatcttttaaatgactatgaaaatttaatccaaataaagtatcttcatagaagtaggagtttgagtttgaatagaatcctttttaacagtggtgtggtgtggtggctcacgcttgtgatcccattgctttgggaagccgtggtaggaggattgatttaggccaggagttgaagaccagcctgggcaacatagcaggaccctgtctcttcaaaaaataagaaaattagccagatgtggtggtacattactgtagtcccaggtattgtggaggctgaggcaggaggatcgcttgagtccaggaaatcaaagctgcagtgagctgtgattgcatcactgcgctccaacctgggtgacagagggggaccctgtctcaaaattttttttagataaaaataagaaatagaattttttttttttttttttttggacaaaggtcgtgggttctttcttttacattttctttcttggagctcttacttatattaaagcttcagttacctccttcatctaatagaaattatcgtttggcagttttattttctctgattttttcagatatataaaacatttacagagcttgaaagttaaaaggtatatttcgagtcttggtctcattcttacttttctacttccattctttctgacctgttaggtaatcattttctggcttatccttcttctgttttttttttttttgaataagcgcatatgcttctgtatatatttttaaggctaggtttattgaggtataatttatgtacagtagaaatcacttgttttagtaaacacttttatgcattttgaccaaatcactaccttatcagcatctccttatattaatggaaaggattttgaaatcttgagttgcaggcaagaaaattctaggcagaatgaaggaatggggtaaggaaaggtggagaggtggcaaagttcaagagatgggtggataagtaccagttgttttataattttaataagaactcagttttttgagcacttacatgctaggcatatatgtattaagtacttcatgtgtattatctaactttacatagttcttcactgcaatcgtgtgagatgcaggtgctattactattttttattttacagatgggaaagctgaggtataaaaggaaagcacaaagtagtatagctagtaactggtttggagccaggtctgtctgactttagaatcccacactcttaaccacaagaaatactatattcttacggtatataaagctattaatatattgctttttagatattttaacaatgattacataccttctaattcttttttttccaaagtaaatacttgagtctccttagttgtttctcatataatatgctatctagatctcttggccactccttggaaattctctaattagtcaagatcctatatataatatggcagccagaccagagacagtatcccagatgttttctgctcattcagtgtaaacaggactgtttttttctttgtcccccaggctagagtgcggtggcacaattttggctcactgcaacctctgtctcctgagttgaagcaattctcctgcctcagcctcctgaatagctgggattacaggcgcacgccaccacacctggcttatttttttttttttttctttttttttgagacggagtttcgctcttgttgcccaggctggagtgcaatggtgcgctcactgcaacctccgcctcctgggttcaagcaattctcctgtctcagcctcccgagtagttgggattacaggcatgcaccaccacgcctggctaattttgtatttttagtagagacggggtttctccatgttggtcaggctggtctcaaactcccgacctcagatgatccgtccgccttggcctcccaaagacctggggttacaggcgtgaaccactgtgcctggccataatttttgtatgttttagtagagaccgggtttcgccatgttggccaggctggtcttaaactcctagcctcaagtgatctgcccaccttggcctcccaaagtgctggggttacaggtgtgagccactgtgcccggccccagaacatttattattttatgtatttatttttttgaaacagggtctcactcttgctctggctggagtgcagtggcatgatcacggctcaatgtagccttgacctcctgggctcaagtgatcctcctgccttagcctcctgagtagctgggactatagggatacacatgcctataatggtgcaatttaaaaaattttttgtagaagtgaggtcttgctatgctgcccaggttggtcttgaactcccggactcaagcagttacctctcctcagcctcccaaaagaggcatatcccaccatgcatgcctatagtggtataattttttaaattttttgtataaatggggtcttgctataattgtctaggctggtcttgaattcctgggctcaagcagtcatctctcctcagtgtcccaaagtcttagcactacaggcgtgagccactgcacccagccaagaacatttataattcatgggaggaggtcaaaataccaacattaaaaagagtttggaagaagtgagttttaaccctcttagatcactttcagagattaagacttcaagacttttgacacttctgaaactactaatagcctgttgttgaatggaggccatacggataacataaatagctaagtagttgattaacatttattttgtatgtgatttttttttgttttttgagactgagctttgctcttgttgcccaggctggagttcaatggtgtaatcttggctcactgcaacttccacctcccaagttcaagcgattctcctgcctcagcctccccaagtatctgggataacaggcatgcaccaccacacctggctaattttttgtatttttaatagagatagggttttaccgtgttggtcaggctggtcttgaacttctgatttcaggtgatccacctgcctcgttctcccaacgtgctgggattacaggtgtgagccaccgcacctggccttgtgataatgtattatatactgtgttcttacaatcaagtaagctatagaaaagacagtgcccttaagaagatgataaggaagagaaagtacatttacagtaccatactggacttattggtaccaaaagtttaggttgtatgtgtatgagatgaattgtctgtctgaaatggcgggcaactgcagccgcagacctgaagtcagttggtacgtttcaaggaattcaactttttcttgtaatgtcatgactttgcttcttgggagcacttccagcatcagtggcattccctgtgggtcctacgttttactcagtgtttatggtgttgcactaaacacgatgaaaaatatgtgagaacaaggagagatcactttttactgtgacagataatttactggagaggtgaactgctcatgcagagatgattattgtcacatagagttttaagatattcaaacacttgagctcaccacattagcaacaaaaggtggctccagagttattacagtagtacagtatgtactgcagttaatcttacgcagttaagacttaatactacatctttctttgtttacagtggcaccgtgtatggtctgtgtttgtgtgcctaagttttgtgattaaattttaactttgaaatagaattgcatatatttatgatagtaaataatatctacatatattttagcattcatgacatacataacttttttctaatttttttggtatttctaggctatgcggttcatctgcaagttttttcaaattgtcacaaatctgctgggcatgttgctgtgcacctgtaatcctagccacttggtaggccaaggcaggaggattgcttgaacccaggcatttgaggctgtactgtgctatgttcacacctgggaatagtcactgcacctctagcctggacgatatatccttatatagcaagaccctatctcttaaaaaaaaaatcatttggccggctactgtggctcatggctgtaatcctagcactttgggaggttgaggtgggtggatcacttgagcccgagagttcgagatcagcctgggcaacatagtaagacccctgtatctacaagaaatagaagaaaaattagctgaataccctgtagtcccagctactcaggaggctgatgcaggaagattgcttgagcccaggaagttggtggctgcagtgagctgtggttgcgccactgcactctagtctgggtgacagagatctcatctcaaaaaggaaaaaaaaaaaatcaagtaaaataaaacgtagaactgaaagaaaaaacaaacctggctgggcatagtggctcatgcctgtcatcccagcactttgggaggctgaggcaggcggatcacttgaggtcaggagtttgacaccagcctgtccaacatggtgaaaccccatctctactaaaaatacaaaaaaaaattagccaggtctgatggtgcatgcctttaatcctagctactcgggatgcttaggtgggagtattgcttgaacctcaggggcagaggttgcagtgagccgaaatcgcgccactgcgcactctagcctgggcgacagagtgagactccttttaaaaaaaaaaaaacatgcaaacctccaaaaattttttcagtacatttattgacaagaaaaaatctacatcaagcttgtcctgtctgtggcctatgggctgcatgtggtccagggtagctttgaatgcagcccaacagaaatttgttaactttcttaaaacatgagattttttttcacaatttttttaaagctcattagctatcgttagtgtattttatgtgtggcccaaggcaattctttttcttccaacgtggcccagggaagccaaaaaattggacacctctgatctacataaaaagtggcagttcagatgtgttattcaagggacaactgtaaatacagaaaggcatatcccatggtgatccattgctgtgggggaaagaggaaggagggagtgtgagaaggacgctttaaataaagtgatctgggaaggcatcagcatagataaatagtagttgtaaaaaattatctacctagtagggactaggtgcagtggctcacacctgtgattccacactttaggagcctgggagtttgagaccagcctgggcaacatggcgagaccttgtttctatggaaaaaaaaaaaacacagtaggaaacacgttattgatttgaactttttcaattaggagtttttcagaatgagcactgggtgtttgaagtatttgtaatacaattatatctggttctcatgctgttaacagctagtcattgagatcactatttggcgccatgcatagcaacatggaattaagggatggaaaaacagccaggacgtctctactgtgctgtgtaaaacaggagtggcactgatttctatccctctctgggtaaggatcaggtaatggaggaaaataaaggagaggaaagagaaggaaacatgatagatttttattttgattaaaacaaaagttggtaacagcaactcaggtttctattaaataaacaaaagttgggagatactccaaaataactgttagtaatagctttaagttctgacaggctgtgccgaccggaatatgatacctaagttttaagtgcattgaaatagtgattcatgtttccttttgcctgtcttatacccagctcttacaactacacttgtgtcttaagtatagtgctgatgtggtaataggatatttctattcagccttatgcctttactgtgtgtacattctgtccatttaaaaggctgaattgtaaatcttaattttaaaaaattaaatgtagtcagttgtcattaatagcctcatgtttcttttttttttttgagacggagtctcactcttgttgcccaggctggagtacaatggtgcaatctcggctcagtgcaatctctgactcctgggtttatcaagcgattctcctgctccagccttccaagtagttgggattacaggcgtgcgccaccacacccagctaattttgtatttttagtagagatggggtttcaccatgttggtcaggctggtcttgaactcctgacctcaagcgatccaccctcctcagccttccaaagtgctgggattataggcgtgagccactacgacctgaccagcctcatggttttaattttcagttttgttggctggaaaatgatcttggatgtaatattaaatctatcaaaacattaagctgtcaatagaaacatttgagagtttgtttttaaaactgtagttgtattttaaaaatagctgtacagcttaggaatggggggagaagggagataaaatcagaaaattttcttttttgttggctatttgtctatcatctatgattagttgaaatacagcctagtaataaaagctgaggatttataaagtggtaatttgtagcttcttcatctgttttttagtgtaaaatgcagcgaattggttgcttatgtaggacttcagtaaaataagtgactagcagcagtagcagcagcatcgaaattttatcgaggtcaatttgttcttgttatcttaagctgttatcattaagtgcccggttgtatcttagcatacagaggcggaaaagcaagagcattcagaatttaggcaattggctgagtgtagatcagagttgtcaaagggagactcttcagatgggtggcttcatggatacttgttcagagtcacatttaccttgtacctagtaagaaacataatttgacatttttcattcagttaagtagtagttttaattacttgtaattgtatggtagaattgaagactttataagtaacctgttataatcgtgtcagtttaaggtgttgtgaaactggaagccatgctgtccaaactcccatatcttaaattgcatcctgcattttaggcgcggtggctcatgcctgtaatctcagcactttgggaggccgtggtgggcggatcacctgaggtcaggagtttgagaccagcctaacatggtgaaaccttgtttctaccaaaagtacaaaaattagctgggcgtaatggcggttgcctataatcccagctactcgggaggctgagacaggagaatcgcttgaacacgggaggcagaggttgcagtgagctgagattgcgtcattgcactccagtctaggcgacagagcaagactctgtctcaaaaaaaaaaaaaaaaaaaaaaattgcatcctgcattccgcagttgataacaaggcatgtttaaactttgctctcatacttcgttctcctcaatgtctgattgtgagtgtgctttttgaaaaattcttttttatttaggcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgagtaagtattttggtttttagatttgtatttttcttgaaattctcactaaatttcccaagtcttccaagtggaaattctaacaaaacaaatacttagccatattgcactatgaatgaagaggttctagttgaaattagtgttgggaccttttaagtgatttaaatataaaggtagtgggccaggtgtggtggctcacgcctgtgatcccagcactttgggaggccaagttgggtggatcatttgaggtcaggagttcaagaccagcctggccaacatggtgaaaccccctctctactaaaaatgcaaaaattagttgggcggtagtggtgcgtccctgtaattccagccacttgggaggctgaggcagaagaatcacttgagcctgggaggtggaagttgtggggagccgagattgcaccactgcactccagtctgggcgacagagtgagaccctgtctcaaaaaacaaaaaaacaaaaaagaagatagcggattgaaatcgcttcaaaaaaaattataaattgaacaccatgaatgaaaactaaagccctttcctaatactcatttcctttcttccagttacttagatcaaccgtgttatgaaaccattaatagaattaaactttacagtgaatctttggcaagatatggcaaaagcccatacctttatccactctatggccttggagaactgccccaaggatttgcaaggtaagagcctgtgtttaaaacctcagtgattcaaaacctcatcttcaacataatgtgtatatgagatatagtttaaataatgagatgagatcagtctatgagtaataagatgctttttatttttattgaaataaaattaacatataatgatatgcacggatcttcagttaaaaaaaatccagttttatacaactgtagctgatgtgctcttgtaagtgccaactcctggctggaggccagccaatacaaaaccagcgcacttaacaaaaatacaaccaaggaccttcacagaatctacttcacacccctgttacctccaccagagtaagtgctggtatccacgcctgagagacctggagacagatcacatcacaggactctttgcagacactctccagtaccagcttagagcctgattatctccactgggcggctagatcaagaagagaaataacaatcactgcagtttggctctcaggaagccccatccctaggggaaaggggagagcaccacatcaagggagcatccctgtgggacaaaagaatctgaacagcagcccttgagttccagatcttccctctgacatagtctatccagatgagaaggaactggaaaaacaactggggtaatatgacaaaacagggttctttgacactctgaaaaggtcacactagcttaccagcaatggatctaaaccaagacaaaaatctctgaattgccagaaaaagaattcacaaggtcattattacgccaatcaaggaggcacgagagaaaggtgaagtccaacttagcaaaacaaaaaaagtgatacaggatatgaatggaaaaatttccaggaaaatagcataaataaataatcacaacttctgaaaatcaagggacacacttagagacatgcaaaatgcactggaaagtctcagcaatagaattgaataagtagaagaaagaaatttcagagttcgaagacaaggcttttgaattagcccaatctgacaaagacaaaaaagaatttaaaaaaatgaacgcagcctccaataagtttgttaaacaaccaagcctaagaataattggtgttcccaaggaagaagaagaatctaaaagtttggaaaacaaatttgagggattaattgaggaaaacttccccggccttgctagagatctagacatccaaatacaagaagcttaaagaacacctgggaaattcatcacaaaaagatcatcacctaggcacatagtcatcaggttaactaaagtcaagatgaaggaaagaatcttaagagctgtgagtcaaaagcctcaggtaacctataaaggaaaacctatcagattaacagatttctcagcagaaactctaaaagctagaagggattgggatcctatcttgagcctccttaagttatcagccagtaattttgtatccagtgaaacagagcttcataaatgaaggaaagtagtctttttcacacaaacaagtgctgagagaatttgccactaccaagccagcactacaagaactgctaaaaggagctccaaatcttgaaacaaattctcaaaataccaaaattgtatctccttaaagcataaatcacacaggacctataaaacaataacacaatgaagaaaaaaaacaaggtgttcaggcaaacaaatagcacgatgaatagaatagtacctcaaatctcaatactaatgttgaatgtaaatggcctacatgctccactttaaagatacagaatagcagaatggataagaactcatcaaccaagtatctgctgtcttcaagagattcaccagacacaaaaggactcaaggtaaaggggtggaaaaatatatttcatgtaaatggacaccagaagcgagcagaagtagctattcttatattttttattttataactatatatattttaaaaaaaatcagtttgataaatttatagacctatccctgtcctgggtttaactaaaacctgagtgaaggtatagaacattttcctcaccccataaagttcccttgtgtcacctcataatgaatactgccccccatccccagcaaccacctctgtgatttctgtcactatagattacttttgcttgttttcaaagttcatgtaaaaggaataatacaatatgttctcatttgtgtctttttcattttttgagattcatccatattgatgcatgtgtcagtaattcttttttttggagatggagttccactcttgttgcccaggctggagtgctgtggtgcagtctcagctcactgcaacctccaccccctgggttccagtgattctcctgcctcagcctcccaaggagctgggattacaggcatgcaccaccatatccggctaattttttatatttagtagtgatggggtttcaccatgttggtcagtctggtcttgaactcctgacctcaagtgatccacccaccttggcctcccaatgtgctgggattacaggtgtgagccattgtgcctggccaattctttttttttaattgttgagtagaattcctttgtatgaattatatgagcatataattctccttttggtggacatctagttagttttcagtttttggctattatgaatgaaggcactgtgaaatttttatgtaaaacactttctgtggggatataggttttcatttccttttgggtaaatactgggagtgaaattgctgactaatgtggcagatagaagtctgaattcataagaaactgtaaaacagtgttctggagtggttgtgtcattgtgtatacactcagcagtgtatgagagttctcgttgctccacatccttgtcaacatttagtattgtaagtttttaattttaattgcccaagtgggtgtgaaatgctatctcattatggttttaatttgtatttcttgactcatgttgctcaccttttcatgagcttattgaccatttgtataattttgtgctgtgattgttcaagtcttttgcacatttctaaagattggattgtctttctgtttttgacttgtaggagatcttggtgtatgatggtggcaagtcttttgtcatatatgtattaagaatattttctcccagtttatggctggtcttttgataagcataagtgttaactttttttttgagatagagtcttgctctgttgcccaggctagactgcactggcatgatcttggctcactacaacctctgcctcccaggttcaagcaattctcatgcctcagcctcccgagtagctgggactacaggcatgtgccaccacgcctggctaatttttgtattttgggtagacggggttttgccgttattgaacaggctggtctctaactcctgacctcaagtgatccacctgccttggcttcccaaagtgctgggattacaggcaggagccacagtgcctggcctagaagtgttacattttgatgaagtccagtatatcaaagaaaaaatttttttaatgtttatagctttttgggtcctattttagaagtcttttttttttttttttttggagacagagtctgggtgttttgcccaggccggattgcagtggcactgtctcggctcactgcaagctctgcctcctgggttcacgccattctcctgcctcagcctcctgagtagctgggactacaggcgcctgccaccgcgcccggctaattttttgtatttttagtagagacggggtttcactgttagccgggatggtgtcgatctgctgacttcatgatccgcctgccttggcctcccaaagtgctgggattacaagcgtgagccactgcgcctggccctattttagaagtcttttacttgcccccaagggcacagaaatactctcctattgtctttttttttttttttttagaagttttataattttatctgtgcatttaaatctgattcatcttgagacagtgttggtgtgtgggatgaggtaagacttgaggttcttttttttttttacatacgaatatttagttgttttagctgcatttgttggaaagacttccttttctaggtagtcgtggtgcctttgtgggagatcagttggctacatatgagtttgttttgggactcagttttgtttcagtgatttgtatttcctatgccagtactacactgtctggataattatagttttatattaagtcttgaagtaggtgataacactttcgccaactttttcttcagaatttgttttgggtgttcgcatttccatatacgtttttaaaatcaggttgtcaatttctagaaaacatgcttgttgggattttgatattgagttaaatttgtagatgagtttggagaaaatgatcatcttaattatgctgagtctgccagtccataaatatgattgttctccatgtggttttcttctcagcagtgttttacagctttcactgtagagatctatcacatttttgttcaatctctttgtactgatgccgctgttaatgtattttgtattgatgctgctgttaatgaaattgtcttaattttatgttgaaattgtttgctgctggtatacagaaatgtaattgtatgttgacgttgtatcctatgatcttgtacttaagttttactagttcacttactagtttttctagttttatatatttcttagaattatccttctacacagtcatgtcatctgtgaataaagagattcttcttttataacttttatgtgtttttcccccacttacctttattgcacttgttaggacttcctgataatgtcgcagggatgagaatggacgtccttgctttgttcccagttttacggggaatctagtaaatattttactattaaatatgttttctatagtgttctctttttttgtagatggttttgtcacatcaagtcnnnnnnnnnnnnnnnnnnnnttttttttttttgtagaggttttgtcacattaagttcacttatatttatagtttggtctgtttttttgtttgtttgtttgtttgtttttttttttggagacacgatcttactctgtcacccatgctagagtgcagtggcatgatcttggctcattgcaacctctgcctcctgggctaaagggatcttcccatctcatcctcttgagtagtaaggactacaggcatgcaccaccccacctggctaacttttgtattttggtagagatggagtctcaccatgttgcccaggctggtgttgaacttctgggcttaagtgagcatggtggctcatgcctgtaattgcagcactttgggagggtgaggtgggtggatcgcttgaagcccaggagttggagaccagcctaggcaacctggtgaaaccctgtctctagaaaaacacaaaaaattagctgggtgtggtgatgcatgcctgtagtcccagctattcgggaggctgagtgggaggatcccttgagcctgagaggttgagactgcagtgagccgtgatcataccactgcatttcagtgtgggtgacagagcaggaccctgtctcttacaaaaaaaaaaaaagcatcaaacttttttttttcccctctctctgtgcttcatatcggagaatgcctgttcatgtggcttcaagtttactgaccttttctgctattttcaataggctgttaatctcattcagtgaattttaatttttttatactgtctagatctagagttctcattttctatagttttattttttcttattttttttttttcgagacggagtcacccatgctagagtgcagtggcatgatctcagctcattgcaacctctgcctcctgggttcaagcgattctcctgcctcagcctcccaagtagctgggattacaggcacatgccaccacactcgggtgatttttgtatttttagtagagatggggtttcaccatgttggccaggatggtctcatctcctgaccttgtgatccgcccgcctcagcctcccaaactgctgctttacaggcatgagtcaccgttcccggcctatagttttcatttttgtgatattctctatttacttgactgttttgagtacatttataacaacatatttatccttgaatatgtatctttgaacaaggatatttgttctggaacatattcttgaacatataatatccttgaacgtatttataatagctgcttttaaactgcgtattttaacatttgggcatctgtttctgttgtttgtttttctgttttctttggatcacagttttctgtttcttcccatgtctagtaatgttggattgtatactggacacatgaattgatagtttgttgagatgccggattcttcctctgaaaagttggttttggtttgagtaggcagttacatttttttattgactgttcatcttgcatttgtggagactggattttacaccttgttaaagtgggtccttttagtttttccttttgttgtttgctgattttttttaaatcacaatttattgatttcttacaatcaaatactgccaactagcattacttccactcatgcatcattaaaagcaaaggatatttcctccttggtatttttaaatggtacattatacaataaacaaagttagaacttaaaatgcacccttattaattatgtaaactggtaatttgtttaaaaaagcataactaataatttggttcctttcttcataaaatggaaatttaaatatttctcctgatagtcttgaggtgatcattagtagtgcaaagtgtggcacacacgtatagtttcatctagaaaggtgtgtctcttacacaacttatttaaacaaaatgcacattaacaaaatgcatatagtcaatgcatgaaagaaagcatgtttcaattacaaggcagcccctcgggccaccatattatttaagttttgcatgatcatttatggcattatagattaattatgcataacatacttttatacttttttttaaattatactttaagttctggggtacatgtgcagaacgtgcaggtttgttacataggtatacatgtgccatggtgttttgctgtgctcatcaacccatcatctacattaggtacttctagtgctatccctccctagcccccatcccctgacaggccccggtgtgtgatgttcctctccctgtgtccatgtgttgtcattgttcaactcccacttatgagtgagaacatgcggtatttggttttctgttcctgtgttagttaactgagaatgatggtttccagcttcatccatgtccctgcaaaggacatgaactcatccttttttatggctgcatagtattccatggtgtatatgtgccacattttctttatcccgtctaccattgatggatatttgggttggttccaagtctttgctattgtgaacagtgctgcagtaaacataagtgtgcatgtgtccttatagtagcatgatttataatcctttgggtatatacccagtaatgggattgctgggtcagatggtatttctggttctagatccttgaggaatcaccacactgtcttccacagtggttgaactaatttacactcccaccaacagcgtaaaagtattcctatttctccacatcctctccagcatctgctgtttcctggctttttaacgatcaccattccagctggcgtgagacggtttctcacatggttttgtggttttgatttgtatttctctaatgaccagtgatgatgagctttttttcatgtttcttggctgcataaatgttttcttttgagaaatgactgtgttgagatggagtctcactctgtcacccaggctggagttggaatggcatgatcttggctcactgcagcctccgcctcctgggttcaagcgattctctcacttcagcctcctgagtagctgggatttcaggcacctgccatcatgcccggctaatttttgtattttttgtggagatagtgtttcaccatgttggccaggctggtcttgaactcctgacctcaggtgatccacccgcctcggcctttcaaagtgctgggattacaggcatgagccaccgtgcctggcataacttttatgcattttaaccctgaagacaagacaagtaattgttgcttgaaaaaattattctatgtagccatttggtttgtatctggagaaactgaacctccatgaatttagtgtgtactaagttggaatcattagctcgagtcagtgaatcagatacatttcacagtgactgtttgccaagtcctggcaatgcctcttctcccacagtctgccagatgaagcatttccgggattacccttctatgtggttttcccttttaatttttttgctggattaactgttttcgcattatttcctcttctcccctcttctctggccttccattttaattattcataaatcctttcagaatatcctcagctccataaggggaagttctggagatggaaaatccaagggaggaagattggggattggaatgtccttggctttcctggtatttgctgcaaacttctgccaggttaaagaggctgtagcagtttctgaatgtggcggcaagctccataactctgacttttctacaaaatcagcatctacatccagctccttttctattggaccatttagaagtctgcccttttcagccttgagttgtttattttctttccttaatctttcattctcagccacaaggaattccacatgcctcttcaaatctgcttctctataattgttttatctttcgggcctttgcttctaatacatggctctgctggctcactcttttgctaaagtaaaaatagtagcgtgtctggatccctgtcaaagatcccttgaatctcaggcaggcatttctctgtgaaagggctgtgcttctgagaaagggggctctggctctctgcatcctcagcagagggtttgtgagatgggcagctacatcctgtgttctgctgggctttcagtcttttcacgctgggcccttttccacctgtcttggatgaggaggcgctgtttcctattcctttgcaattccagtgaaaaatgagcctgctcagactgtcagcttcacggcttctgaaggatatgccgcagcctttttgtgacaagaaatagcttctttgtagttgctgataaatggtctgttcatctgctctgttgatgagccaggttgagggatccattattttcatagactccggggtaagtggcagccttaggaaggggagcagtggcgcaggggaacatggaggggactgcagggaagcgcgatgcagccgcagggactgtggcccctctctgcgttcaagagccagcagcggggcgcagagggagcaacaacctcaccacttcctcctccagcactgctccacgggcctgccacctgcgctgctgctgctgccacgcacggtgccatgacgtcacacgcgcaagtggcctctgcttattcttaaacgttactcctctggagtaagcaagctcctttgaacatggcaattttaaacttcagacacattttttcttctgtccttcctctataatctctgctaacctctttgagcctttcagctgtttatttctggtggattccttcgcttttccctcctgtgtgagcacttctggaggtagttaaggatttgaagatattttatcatagatttgttggctccttcttttgaggctccctcttttgtgaaactttcccctacaattttcatctcctctggccgccccaaattctgtcacatctcaaatcaataggactgcaggcattgtgcttctgttgtagctgtaccatgttgcaaggactagggaagttgctgcctgaggggaaaaccatataaactacataaagctctcacccacttggttcctttcaagagtttcttcagtctctggtttttgctgctttaagtcattctccagtgctgcctttccccccactttattactatctttttttgagacagcattttgctttgttacccgggctggagtgcagtggtgtgatcacgacttactgcagcctcgacctctcaggctcaagtgatgctgccacttcagcattccgggtagctgggactacagatgagtgccaccatgcctggttaatttttctatttgttgtagaaacagggtttcagcatgttgccaaggctggtcttaaactcctgcgttcaagccatctgctggcctcggcttcccaaagtggtggcattaggcgtgaaccactgccttcagttccttctgatagtgttttaagtccatagttttatttatatgccagaggattagactaatatagctattactggtcaacccttcccttggccttgcccttgcccttgcccttccccttcccctgggtgtgaatccagagaaatggcagatttgcctctgatgtggatagtcccgcgactgcacaaggccattttagaacacacacacaaggaaaaacaggagaatagacagtgtggggttttgggaaagagccgattttagttgaagaagcagagtaaaacccagacatcgcatggctttaggctttagcctcaccacactcacgagcctcctgtccaggagggccattagtgtctcaggtctgctcagtgtggaccccgaagagccatccatcagggtgagcgaggagggataagctatggatgcagagccgctgcggccgagaggaactgttccggtgattggttagcaagcgggagagtggaaaggggagaagaaaaccgtgtatgggggttgaacgcctccagccaaagaaaatgaggtgtagaggtctcttactactagggaatgtatccgagtcacacagcaccaaatgtgttgctggtggaaggtagccgagtcacaggcaccaaaatatgttaccgtgctgagatgaatccgtacgggtctgcagcaacctcagttcttttctcctcagaagaaagaatgaccaaggggcataaggtagaaggagagactgaggcaagttttagagcaggagtggacgtttattgaaaagctttagggcaggaatgaaaggaaggaaagaaagtacacttggaggagggccgagtgggcagctcgaaagacaagtgcctggttagtgattttttttgacttcgtatttataactgattatgtttgtgtttttgactctgttttcttgctttaatcacttctaagctgacatctttctagaaggaaattgaacaaatgtatattgtctgtaactcattaagatctaagaaaggggactttaggagttgaaacaactatatattattaattgggattttaaaaattttccaggctaagtgctatttatggaggtacctatatgctgaataaacccattgaagaaatcattgtacagaatggaaaagtaattggtgtaaaatctgaaggagaagtaagtagcttttaaaatgaaaaaaattactatgttcttgtgaagaaagttgtgtattctaaatattgattttggtgtggacactgatgcatatgatttctgtatgggaagttagtatttattgtgactaaggactaattacagttgctgtgctttgttttaaaagcatcttttttgttgtcagttgttgattattttaatattgaaatatgcattatgggtgagctctaaatagtaagtattctgtatttatagagtttgggttgtgcctgtctcccaaattttcattgaaattgaactgtacttgcaggccacctacacgggtggggttttgagcagcatttctcaaatgtgaattatatataaagcatcattaatctggttctagtgcatgttctaatcagtaggtctgagaaggctctgcattttcttgaaacctcttaggtgatgtggatgctactgaaaaaaaaaatcacaaggaaaaaaagatcgtttccctttatcaccatatgaattaattcttctgccatttgacactgttactatctgcaacagttcttgcagtagaggatgcacttcaaagtgcactgctttactgtctcactggaattctaaaaatctaagctttatctttttaacattaagctgtgtgggaatgtagcaacctcctgggtggtggggtggggggcatcttcaattatttaggtctcactggaaagtttgagatcagagtttggtaggtggtgtaaggggacaatgagtaagggagagaaaatacaggactgacttggggcaaaaaacgcctgataataatttgtgaagcacattttcaaactcatttattccttacaaggatcctaagaggcgggtattatgtccaggttatacctggaggcttaaatgaagaaacatctacaagggcacacagtttaatgaatggctgaggtagaattggaattaaggtgttccgcacccacagccctcagtcgttatacacctgaggatgtaaattcctgtgctgggtgatgttagatttgtgtgttttatctactaaaatgttatttatttatttatttatttgagacatcaaatcgttttgctctgtcgccgaggctggagtgcagtggcgtgatctcagctcacttcaccctccaccttccaggttcaagtgattctcctacctcagcctcccgagtagctggaattacagatgcatgccaccatgcctggctaatttatgtatttttagtagagatggggtttcaccatgttggccaggctggtctcgaactcccggccccaagtgatccgcccgcctcagcctcccaaagtgttgggattacaggcatgagccactgtgcctggccttctagactgttacttaattgggtcttttgaacatatattttaggcaacttctttataaccctgtttcatcttgactgtcgtagtgtgattggcttatctgctttaaatgaagttacaaagcacaaaagaagtcatattttgtttgacatgtacattactaggttttgttaatgctaacttaattctcaggtatatcagcacaaatagcactgtttaccatccaggtccaacaaacttcactcagccacctttgtggggttggggtcatcagtatcactgtcttccatctccacatcgtgttccactggaagatcttcatcagggacagtaacactgcttgtactttcagcataatagttgtttaggagatagagataaatggtgtgtttttttttttcttctcagtcaccaggctggagtgcagtggcacgatcttggttactgcaacttctgccttccgggttcaagtgattctcctgcctcagcctcccaagtagctgggactacaggcatgtgccaccatgcccagctaatttttgtatttttagtagagatggggtttcaccatgttggccaggctggtcttggtttcttgacctcgtgatctgcctgcctcggcctcccaaagtgctgggattacaggtgtgagccaccgcgctcggccagggataaatgttttaatctgtcttctgaaagttacttttattctgtatttttcttttgtttcattctttgtgtttctgaaacttcagggctttgatatgaaagggaaggaggctataatacatttatcttgcaattcaagtttttcttaggaagcatagccttaagatgataaggattttagtctatgtagagtacatttactgagcatttattttttgtcaggacacccacctataatgacagacttttttacaccatttcatttagttcactaatgtccaaccttttggcttccctgtgccacattggaagaggaagaattgtcttgggtcacacataaaatatgctaacagtaatgatagctggaaaaagggtctgtgcataatttcgtgatgtctgccaccacaaataagcaaaaatgtccttgcattcaaggggctggacgtggctgaattttagtactaacaacaatcctttgaggttaggtagagccaggatttgaaccctgatctgcccaattctaaaacttatacttctgaatactgtgcaacacagttttcctagtatttgaacaggatttacagttcatatatctgttcaaggagaaaatagtagggataattggcaaagctagtttcagtagttaccgacagtttaataattaccttgacttttatattcattagattatgaagataacagattatattcaagggaaaattacattaatatactgtttaaaacattatagacactgaatattagtctttttccctccattttttttttttgtgataaagtacccataaaatttaccatcttttttttttttttttttttttttgagacagtctcactttgttgcccaggctggagtgcagtggcgtgatcttggctcactgcaacctctgcctcctaggttcaagcaattctcctgcctcaacctcctgagtagctgggattacaggtgcccaccaccacacccagctaatttttgtatttttagtagagatggggtttcaccaggttggccaggctggtctcaaactcctgacctcaggtgatctgcccgcctcggcctcccaaagtgctgggattacaggcgtcagccactgcgcccggccagaatttaccatcttaaccattgttaagtgtacagttcagtggtattaaatatattcacatcattatacaaccaccacaaccaccattcatctccataacacttttcctcttctttttttttgagatggagtctcactctgtcgcccaagctggagtgcagtggcatgatcttggctcactgcaatctctgcctcccgtattcaagtgattctcctgcctcagcctccccaggtagctgggattatagatgcataccaccacgcccggctagtttttgtatttttagtagagacagggtttccccatgttggccaggctggtcttgaactcctaacctcaaatgatccacccaccttggcctcccaaagtgctgggattttataggtgtgagccactgtgcccacactcacttttcctcttctaaaggaaactaccaattaagtaataactcctcgttctctgcttccagccactggcaagcaccattctactttctttctctatgattttaactactatattttatataaacggaataatatagtatttgccttcttgtgactagtttatttcacttagcatgatgtccatggttcatctgtgttgtagcatgtgtcagaatttcctttttaaggctgaataatattccaatgtatggaaagatagaccatagtttgcttatccattcatcaatacctggattgcttccatgtttttgtgaatgtattgtgaataatgctactctgaaaatgggtgtacaaatgtctcatcaagaccatgcgtttagttcttttgggtgtgtacccagaagtggaattgctagatcatatggtaattctgtttttaatgtttgagaaactgccataccattttccatagtggctggaccattttacattcctgtcagtagtggacaagaagttccagtttctccatatccttgacacttaattttgttttgatagtagcaatcttaacggttgtgaggtagtagctcactgaagttatgattagtgatgttgaacatctttgcatgtgcttattggccacttacatatcttctttggaaaaatgtctattcaagtccttcgattttttttttttttttcttttgagacggagttttgctcattgcccagcctggagtgcaatggcgtgatctcggcttaccataacctccatctcccagattcaagcgattctcctgcctcagcctcccgagtagctgggactacaggcatgcgccaccgtgcccagctaattttgtatttttagtagagacgaggtatctccatgttggtcaggctggtctccaactcctgacctctggtgatccgcctgtcttggcctcccgaagtgctgggattacagacgtgagccaccgcgcccagccctttgatcatttttgaatcagggttttttttgttgttgttttaggagttcttgatgtattgtggatattaatcccttatttgcagatattttctctcattctgtgagttgcctcaactcttgattagtgtcttctgatgcaaaaatttctttattgtttttttaaaagagacagtgtcttgctgtgtgttgcccaagctggactcaaagtcttgggctcaagcaattctcctgcctcagcctcccaagtagctggggttacaggcacatgccaccatgcctggctatgcacaagatttttaaaattttcatgaaatcctgttttcatgaattctttcctttgttgcctgtgtcttcggttttagatacaaggaattactgccaactccaatgtcatgaagcttttgcactgttttctcctaagagttttatagttttagataccacatttaggtctttgttccatttttagtttttgtggatggtgtcaggtagggtccaacttcattcttttgcatgtggatagttttcccaggacggtttgttgaaatgactttttttcccctcattgaatggtctttgcaactttgtcaaaaatcactgtactgtggatgcgagggtttatttctggctctctcctcgtttcattggtccatacgtttgtcattatgccagtaccacactgaattgatcactgtagctttttagtgagtgagtcctccagctttgctgttcttcttttaagattgttttggttgttccagaattcaatcccttgggaaccaatatgaacttgaggatggtttttgatatcttaacaatactaagtcttccaaactatgaacatgggatgtgtttccctatatccttgtccgcttcagtgtcttcttaaatgctttgttatagattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcaggtgaggtttgaagaccagcagatgttggtagaattttgtaagatataatttgctttgtgttttatcccaaattcctaattttgtatgctgtattagtgaacagaccttggtttacatatgggggaaaaaaatctttgtacctcctcctgctccggcagcattgtgtcaacgcggacagattcaactcggagccagccttggacttgtgtccatcacctgtagaatgaacagactgggcttggtgaaccctgcgtctcccagctctaactaacagtaggttcctgtggaggtttatgcttaatagttaactgacccgagtatattcttgagctaatgacatagctgcttctgtgtccttatttgtaatcctagtacctacatttgattctagcagtgtccacctttcatttctgtgatcaggacatggctctaaaattgcaagtcctaacttatttgtcttagccagttgtttgtaacccttcgatgttcccattttcctttcaactagaagccccaaatctttttatttatctaaaattcagcttaaaaagggtaatcaggctttatgggacaggtaagagctatctgtataatgattttttttcccccatataagaaatgaaatcatgggaggccaaggcaggaggcttgcttgaggccaggggttcaagaccagcctgggtaacatagtgagagctcgtctctacaaaaacaaaaaacaaacaaacaaaaatggctaggtgtggtggcacacacctgtagtcctagctacttgggaggctgcggtgggagaggatcacttgagctcaggagtttgaggttactgtaagctgtgattgcatccctgtctccaacctgggtgacagagccagactgttaaaacacaaaaaaaaaccaatcacaaaagatgatctgtagaacaaagggactggacttaatcttccacaaggttcccaggcgggtcctgggtccttgcaagtctgaaaagaataaaggaggtcccagagttttttttttttggcctttaaatgctctcctatccaaatgattttctatcctggaaatgacacagttaactggatgagtggtatacagaccaagtctaatcgagaattctatcgttatgccaactcaaaagtggtttatgtggattctgcagttttacattactgtaataagtaaatgaggacgtcagtactaagtacatcctttcttagccattcagaacctttctaaatgcaaggtccagaatggaagaatctcccagaatagttaatatggtttggcaggttttttagttaggtatgacagagctgttaagagatctcattccaaacttcagcagttcgctaccacttcaattcttaatctctagtaggttaaaagaaattcctattgttaaatatctgtgtactttacatccaactctgtcaccatttagaacttaagtgtagaagatcttgcctattgagagtaattttaactcacacctcatgacatatgggtgatacctgagtatgttgggtcccagatggagacacttgaggcagtgagctggtatcatttgtttctagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaagtgagttgtgttcttttatatctgccgagatgcaaactgaggcctttgattgtggctccatggtgggacgaatgtgagggcaaggcaggtagctgctggctgctctgtgggattcatctgtacctctcagttgacctcaggcagagccatggtcaggtgtgggaccagctcacctgactgaattctctctccctccagatttgttagcatcagtgacctcctggtaccaaaagacttgggaacagaaagccaggtgagtatggaagtgtgaaaggatatgggcaggtttcactggaagacatccctccatggtcttaagtcttcgtaatttttgttttcagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaactactgcccggtgttggtttgtgtgtcctgattgcaagggtcacagctgccgnnnnnnnnnnnnnnnnnnnncttccctgtgagtagacctcgagttttattcttgacacagtaccattactagacctatcatctttgtgcagaaaaaatagtgtttaatgattttgcttgtagcagcagttataagggagtaagtgaactgtcaggtagagtaggtgctttagtaaataatttttgtgtagttgaaatgataaagtgtttacatataaggccctttcccctgacagtgatgagcctcacggcagatgctgttgtttaccacagataaacactgactcttcagagtatgaaggagacagactaaggtagatgatgtgttaaaggaactagggtggtgatttagattgttattcatattgccaaaatgatggagcttctcgacttcagttgatgttttgggctggatcattctctgttgatagggttgattgtagcagcatccctggcctccacacactagatggcaacagcaccatcttggaatgacaaccaaaaatgtctccagatgttgagaaccactgctttacctgtatgataaaattatctgaagtcccagcaagcctttttctcttcccatgcaaaggcccaagctgggttagtaataagtgaaaaaagaaaaaccacgcatcttcatattcttcattcaacgtatttactgaataccttgtgtgccaggccagtggagacaaagatgataatggtagttactgggataactcagtttggtgaacacatgatgtggtttggttattagtagagttacagaaaaggtagcatggaaactgagatggcctcgtgggtgttggaaggcttttcagcaaggggaggtgaatgttattaggtccaacctgaaaggtgcatatttcaggcagatagataggtgtttggcatcttataactgctcactttccttttccttagtaatctgaaagtaattcactgtactgaatagttaatggttcccttaatagactcttgtccttggaaaaataaaatgaaatgactggggttctattagtaactgaaaaattgtcaacaattaaaactctaaaacctactcatgagaaaataaagctcttttgtttaggaataataaaagccgacttaatgacttctgaaagaagtaagtgtccctgtaaaggccaggtgaaactgccattctttaacctgttactcggtgtacttgactgcggaaagaacccagaaacagaacaggccaggcccaaaggatagaagtgtaggtttcctctggaagcttactgttctgctaaatgacctaaaaattgctagaacactccagataagtcaatttctgctataaaaatcattgcagaaagagattatttttagttgtctttatttaaaaaatgaaacacattagttacaaaaaccgttgctccaaatagataccgtgtatcttacaaatgttttttgcttggttttgagtgtttactgtagaaattttcaatatcataaataaatgattatttctttctcagaaagctgatttttgtagtgtagtatttacaaataccgtaagtgaaaaatgatagtttataaatttgtaccatttaggaaaaaatgttttatgtagtgttgtttgtgtaacagcaaataaaaccatttaagattatagtttttacaagggtggtaaaacctttaaaacagagcataatgtgcatcgtatgcctttctgacattagcatgcaaaaacaaagctatttgttaaaatagacttatttttgctccaactaagtaaacatgtaaaattatttttaataagctcaatagcttagaaggcatcttgtttaaaatgaaaataatttaaaacaatatctagcactgcaacccaaagctaacagacaactgcaatgccactgtgacatatttcagcaaaatataaaaaatgaaaactttccaagttgtagaacattggtttttcaaatgtaagactgttcacatgtgtattcacatgttcacaagttttccaaagggaaaatactaattttttattggcatcatccatatccaggcaggctgtagttgagtcacctgaagaaacacaaaattgataaagaacttcttaaaataatacgaacaagaaatattttataagcgggatgctctaatggggaaaacgcctatgcattctaaggttacattatgttctgtactgacgatccaagttaacagcaagtgaaaatgcacattagataaaataggtaattttagtagatggttacttcatttagtgataatttaggaattcctatttatgccaaatagcaattccacccctaaacaaacactttaaatttatagcatgaagtatgtaaacaacagtttcccaactgtttcccttagacacaaatgtcaatatttgccatcaacaactccaactcacatgggaaagttacataaaaagtgttcttaccaatagctactcctaaatggagctgctattttttctatgttttctataaagttatttacatctgtaacaaggattccattattttcaaagacttctctggggatagtaggcttgtctgttaaaaaaaaaaaaaaaaaaaacttttggttaatataattaatgtacttttatataacaggacctggttttttattttaaaaaatctgtggaacttcctcgtgtggggggtagggggagaaaaggtgttgggttccaaattaagaaaagatttgaagctttggaaatagatgcctccatcgggggtggtggttaaagtactgaaaaaaaatccctgaaaaatgataactatggttctttacgtaaatttttcttaacacttttttttttttttttttaaagatagatagggtcttgttctgccacccaggttacagtgcagtggtgtgatgacggctcactgcagcctcgagcaatccttctgccttaacccaagtagctaggactataggcacacatcaccacacctgccaacttctgtagagatgaggtctcgctaagttgcccaggctggcctcaaattcctgggctcagtgatccacctgcttcagcctcccaaagtgctggcattacaggcgtgagccactgtccctggctgccccacaaattttttaaaagcaacctctgcctccggggttcaagccattctcctgcctcggcctcccaagtagctgggactactggcatgaaccaccacacctgactaatttttgtatttttagtagagatggggtttcaccatgttggctaggctggtctctaactcctgacctcaagtgatccgcccgcctcggcctcccaaagtgctgggattacaggtgtgagccactgcacccagccccagtattgatttaaaaaataatacggtataactacttatactgtattgagtattataagtaatctagaactgacttacatacataggaggattgtgtagttacctgcaaatactacattttatataagggcttcagcttcagcagatttgggtgattctggtatccatgggatgccaagccatttagatacctgatactcttcatcaggtatctaactttgacattcctagagctgaccaattttggcattaactgagtaaaatgcgcctgtgaattacctgttaggaggacagcaaacctggcatcaatatgctgaatttgcaggtttagcaaacatttcagaatttctgcttttgttgatgatcgagagtcacactggtgataatgaagcaattcaatgatatttgcactctgaaatgacttcaacattatgttcttcttatgtgcagttgaatccactctgtgaaagatacataggcatattaaaatatttttcagttttattcttaggactttttcttgccttcagtttaaccattcaaactcatgagttcctctgcctttcttcttgacgttctttttcatgacacactttggttacctcaaaacatcacaattgtacctactccttttgtaaatgtggattttaaacatgggcctcattctaagagggacatcatgcatctacctacgaccaatcaagccatgtggcttggcaagcctttcatgaatttcgagtgggccttattgcgttgtatatttgtagagcaatgcacatctatacttctcataccttgtgggcagataatcgccaacttcattaaaattaggtagcagccagaattttcttggtttcttgcttccctgaaaattctatcactactaggaaaatgtgttaactcagtatgtttaaatttttagcatttctgtctctgctcgactcccgtctctctagttttcatcacttacattctcatgcttgttggagaaaacccaaatcacacccattcccataaccctagtgataatcactcttaacatcatgaattaatttcctttcactttttcctgtataaattttttatgacatcatactgaacatagttacatgataccaacttttatgccatccctctttctatgaatagaaactttttacatgcttctattgtgtaagttttgggtgggcattattttgtataaactttaaaatatttaactgtagtctgcatatctccctcctagagatggaactgaggttggttttgcaatgactgataaccacctagaattttgggtaaattccacaaaaggtcaaaggatatgaagagttttctaatgagttctcaataatacataacgcctgttacataatgccagagtggtataatatgaagagcatactgcagcgccaacagcagtgagtacgggcatgtaccacataatgatgtttcagtcaatgacggaccacatatacaatggtggtcccataaaattatactactgtaatttactgaaccttttttgtgtttagacacacagataccaccattgcattaaatctgcctacagtattcagtacagtcacatgtacaggtttgcaatctaggagtaggctctaccatatcagtttgtgtaagtacactctatgtctgcacatagacaaaatcgtcttatgacgtttctcaggctgtatccccgtcgttaagtgacatgactttctctacccaaagccctagaagtgctagattgatttatgcttattttataggtgtgctgtggtacatcagaaccttaaatgtgcttctctacttaccgaagttgacgtttttcccctcaagtgctggttactgaagtccgctgtgaatggtcatacccttgacctgctgaagcctttgcaccctcctttcctgccaaggaaacctctgtgctccttctctcctttgctagctccacttcaagagaaaagctttctgagattctgttcctcaaaggtcacatacagctaacagtcgtttcgtctttctgggattgaaacccagcttcataacttactacttgtttgaccttggtcatgtttgttatctactctgcttcagttctgcattataaaagtgaggatttgctatctagctcctggggatgaagtctgaatgaaaatggatgcacctaacagtgcctgaaatccttatttcacaagggcttgtcaggtctgcttttccaattggtcctgcttgtgagaatgtggaggaatctctcagccccagctctcttcagccaaggaatcaaacatgtatttttttcttttataaattacagctttagacttagtgaagtttgcgtatttataagcctcttcttttagggtacaactgaattaaggatagattatggtcttaatttttccattctccttaaagtggtggcaacttataagtatccaaaaaagcattaatggtacaagttccatatattttttaaagtttgtagtagtagggcttaaatagaatatggacatttcatgactgctaagtttgactcccttacttctgttagtctagataagtacatgcctcatactgttggctacggtcacagcacatagcttccttcattgaatacagagccagcagccctcatgctctttactgatgaaggccattccactgcagcactaggctagagcccatggaacatgaggcgtttctctgctaccccagcagggcaggaggaaccatacacacagcaagtccttacctttcatcttcttttagctttttattttccctgtagtgaagcaaccacttccatcttccatttccatttagtttttccaggattttgataatttccttcagttgaactacaaaacaataaatgtagcaaaagaagatgacaagtttaaggtacttttggctcatgccaagcccagtgataattatttgtaaaacaagaaaaaaacagactaagacccatggttgagtacacaccatcactgtcacttatgtggttgggcagcatcctgctctcacaagcccctcagcctggtcccacctgctcacactatggtgggagataactctgtagacacgaacacagtggagtggtcaccagcaactagagttctgtgtacaaattgtgtgacagaagagaagcaggaggccccgatgcagtagagaaatgaagtttctaaatacagaatcctttttttttgagacagggtttcggctgtcacccaggctggagtgtggtggcatgatctcagctcactatagcctcaacctcctgggctcaagtaatcctccatccttagtctccttagctgggactacaggcacacactaccacagctggctagtatttttattttttgtagagatgggatctcactatgttgcccaggctggtcttgaactcctgatctccagggatcctcctgccttggcctcccaaagtgttgggattacagacgtgtgcctacaaatatttaaaatcccaggttctgtgtagaagtcacactggttaaggtacatgctgcttttgatctagaagtggtatcacttccaatgtgatcagagccggggcaggttttatacataaaagtgccctgagagaagtaaagtatgagttttcaagtagatgattaaataagctgacttagtagccattttttagatttttgtgacatcaagatggtaggggtgttgacatcagaaatggagaaggttgactttaagcaaacaatttaatatggagctgctctgacttggcaagtgaagagactaaatataataaaatcctgaatttgtgttactaggagcttagctgcactaccgagagggagggaactcagaagcaagtgtggtggtaagaatcagttaaaagaggtgaaaagcattgctataagagaatcactgtatgaaaagagcacagcagacagcagaaattatgcctcagtagggggcaactgatattccttagagttgatcatttcttttggatgaaacagtatttaggtcactgggtgagaagttgatctgacttcaaagaaacaggaaaagaaaataaagaccaacctaatgttacagcttctagtatcttgtcatctgatatcacaaagcctcctgcacgaaacagttcttggtaggtgtgatcaagaacatctccagggctgtctactccagcaaagatgacactggggaaatgcttcagcttcagcaaagaaggaatctgcatgacacaaaaaggaccccggtgaagagaggctcactgggcacattttcttagacactcccttgcttttctatccaagagagtcaaggttcaggaacaactgaaaatatttcaacctggattaccgactggtcattctgccctgcatgaggcatattaactgagctcatcatcaccaggggctgcaaactcaacaaaattagttcattaaaaaaaggtctcaaactcccaaaggttggaaataacacgtcatgagggaagaggacacatctgaggttgtgggcactgaaaagtgaggtcacctcacttcgccgtcattcgtctccagctccccttggtgccagcaccgacgactgcctgctgatgacggcaggtttatgcacccagcctttgtccgtagttgggtcttcttgagacaagcaattactttgattcaactagctggtaaatataatggttcagaaaatttccaaaaggtcttttaaggcaagatttcttattgttagacatcaagtgatgcagatttatatctcagatgaaaaaatttagcaacctctcacctaagtctcccttagttaatatgatttttttaaccatctgccctacaaataacttggtaatattgcagtattctataatacaccatcttcccacttaaaggcccaacagtaatgtctgttagcttctcttctacataaaaaaagagggatgagtctgagcattacagaacaacttatgtgcctggaatacgtttctttgtaaggtatttccaaccgacctgatgcaaatgtgatgatatatcttcatttctgatgatgatgattagtgtatcattctctctgtggaaagcttgacagaagtgctgaggttcaatttctgtatggcctcctttcctcagaaggttctgaaagatttacaaatagccattattaaaaaaagggtacttccacagaactacctgtatagtttattaaaataatgaaaagcagtatagtctaataaggcaaccataaatgacaatttgtcttattactaaataagcaccttttatatataaaataaatgactcaggtattgttaacaactggacttagaagttgatttcaaaggtaaataaagtatcaaaggctgattttcttttagaacatcagaataatctacataaatgagtttcatctgcttcaaggcatgagctaccttgagaataccagatatatactttaaaaatgctacctgtagttaaagcatttctagagctttaaaaaacaatacccatgtatttctttaccattaaaggggactgattttggagtcagcagtcccttgggtctacgtctcagaataagacaggtgatgcagttgaaacagcatgcgattgtacggtgccactgcagtgcagcccagtacaatcaacacacagaatggctccctaatcatcctgactgggagggtaaatttgtgtaattaaataaattctataatcctacactccctatgactttgacatttctttgcttttttttttgagacatggtctcactctgtcacccaggctgcagtaaagtgaaacgaacatagctcactgcagctttg

SEQ ID NO: 947 - DNA, 1293 bp, Homo sapiens
gaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaa

SEQ ID NO: 948 - protein, 430 aa, Homo sapiens
ECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNIYKRMTGSEFDFEEMKRKKNDIYGED

SEQ ID NO: 949 - DNA, 32675 bp, Mus musculus
  misc_feature (1)...(32675): n = A,T,C or G
gcaggggagccaaggggtatgtagtcctcatggcagttagtatctgagctgcgggctgcacaacactcagccagtcttgttttattctttgactaggccgcttgagttgccagacgacacctgctggaaaggcttccagggtgagctgctttcttatcattcctctacagccctttgcctagccttcctttaatctttctttgtctatacttcccattttctcactgcatgtacatttgtgcatgtttgtgagggtttgtgtttaggggcagtgcatgatgaaggcaagtgatagtcttgtgtgttgttcttcagggactacccagctttttagaagggtggtggtggtcaggatcctaaactggcttagaatatgctgaagtagactaagattcttgccagcaagcttcaggaattctcctatctctacctctctagcattgggattcaaaacatagccactatacctgtcctttttacatgggttctggagattaaattcaggtcttggtgtttgctttgcctactgacctgtctccctgatcccatgttcccagtttcctttttgttttgttttgttttgttttgtttttcaagacagggtttctctgtatagccctgggtgtcctggaactcactttgtggaccagaatggcctcaaactcagaaatccgtttgcctctgcctcccgaatgctgggattaaaggagtgtgccaccatgcccagctcccagttttcttgttcgtcatttattaattggtttccattcctgtgtcctgccacccatagttccctatattgacccagagatctctttgtgtttcatccctcttatgccccagccatgtcttagttgccatacacacctgtgcatatcactgcactgaagtattagggttaggaatcccttacggtgtccaaaagattgtttccttccccaaggagttcccagcctaaagagaggtcacagaaagaaaggtgccagtgagtgtcctgtgaccataaatagaatcaaaccaaacatgcaaataggctttggtcccagcacttggaaattaagctagaagagtacagtggaggacatgaaggcacatgagctatgactnnnnnnnnnnnnnnnnnnnncggcggtcctccaggatgaccccctccccgcattcctctgctgcccttaagccaaatactacctgccccacaaaccagcctgctgcctctagaccaacatcccgacccactcggggcagggcaaataggtcctctaccaggaccccagaactgattgtccctgtagaccctgaactccagccttccacctccacagaacagcctgtcatcccaaaacttacgtcccaggtcactgagggcagggtacagatgcctgaaccacttctcacaggtcccgagatccagtctcccacctccacagaacagtctgtcaccccagaccgcaaacctcgggccactcggggcaggccaagtaaatctcccaacaagaccccagaaccacttatttctactggccctgaactccaacctcccacctccatagaacaacctgtcatacctaaacccacttctcgggtcactcggggcagaccacgtaagtcttctgtcaggaccccagaatcagttgtctccactggccctgaacttcagcctctcacctctatagaacagcctgttatccctgaacctagggccactcgaggtagaccaagtaagtcttctatcaagaccccagaatcagttgtccccactggtcctgagctgcagcctcttacctctgcaaaacagcctgtcacccctaacctcacatctcgggcctctcggggtagatcaagtaagtctatcaggaccccggaaccagttgtccaaactggccctgaattccatccatccacctccacagaacagcctgatacccgtgagccctcatctcaggctaggacacgtaggtctgctgtcaagactcctgaagcgagtgtccccacaacccctgaactccagcctttcacttctaaaaaacagcctgcccctaagcctacagctctggtcactcagggaaggacatataaaccctccactgaagattgtgaatcagttgggccagtggcccctgattttgagccttccacctctacagaccatcttgtcacccctaaggttacagatcagagcttaacactacagtcttcacccctaagtgcttccccagtttccagtacccctgatctcaagcctcctgtccccatagcccagcctgttaccccagagcccattccacaagccaatcaccaaaggaaacgaagggctgctgggaagcagggttcccgcacagtccctctgggtcataagtcttactctgccctctctgaacctgagccccaatcttcagccagccaaagctcaggagcatcagaagcaggtgagtcagttacaaccactcttgagcctgccatgcccttgatgcataatgaagcagctgggagctcagggcccattcctaagccccagcctaaggcttctcaaaactgaaagaagcgtttcactaccacagactcaccccgtcaaaaacgtcccagaagacaagcctcccagaaaactgtagtcatcaaggaagaacctgtagaaacagaagtgaaggaagaggtgagaggagagctgagggtggggtggggatgtccctagctaggagcaagagctacagagctcaggaattctcactgagatgcttttcagcctcaagagactgcaattccaacaccagaaaagagaaagagggaccatgcagaaagaagtgacccaggggaaaaccaacttcgaagccggcgaactaaacctaaccaagaaacagcccccaagggtagaaaacaaggtgctggggattgagagatgggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacaggagtcatggattctcgtggcgagcgtgcagtgctggctctgggaggcagtctggccagctcagtaaatgaggcctcccacttagttactgatcgcatccgcaggacagtcaagttcttgtgtgccctggggaagggaattcccatcctgtccctgaactggctgtaccaggtgagaagccaggagatgacgaatggctggaaaggactgctcacctagcagtggggaagtagtgggagggaggagatggagaactgggttagcgaagcagtgggctgctttgagaagatacagggctgggatgactcagtaccagagcacttgcctagcatgcttgaagtcttgaggtcaatcctcagcactgggaaggacaaacaagacacaaaacggtcacttcagataaacaacagttctgcctgttccttagtcccgaaaggctggttgcttcttgccgcctgatgactacttagtgactgatcctgagcaagagaagaactttagcttcagccttcgggattccctgtgccgggctcgggaacgaagactgctggaggtaaataagagtctgtcttctgcaccacgctgccgtcctatcccctggagctcttagaggtttcccagtgcctttggcctgtcactgcaggtgtctgtctccatcattcctctcttaggactatgagattcatgtgacccctggcgtgcagccacccccccctcagatgggcgagatcatcagttgctgtggaggcactttcctgcccagcatgcctcactcctataaggtatggcaagcataggaagtgggaacaagagagggttggaggaatgatggagggaaagaggaacaagaatgagggaagagaggaagaggtgctggcctcaaagggactcggtgttgttgtttttttgtttttgtcttgttttggtgtcaggtacttatttttttattttttattagatattttctttatttacatttcaaatgctatcccaaaagtttcctataccccttccccaccccagcctcagtgttgtttttaaggtttaaacattttcaagcagccagatatggtgctccacattggcagtttagcacatgggacttgaagcatgaggagaagttctaggtatatactcatggaagcccctgggactgcgtgtccctttctttttttttttttttttttttttttggtttttcgagacagggtttctctgtagccctggctgtcctgtcactttgtagaccaggtcactttgtagaccaggctggccttgaactcaagatccacctgcctctgcctcctgcatgtccctttcttactcacccccacccccaccctaacatttttttaagtctattttacacacagagaagaggggctggagagacagctgtggttaggagtacttgctgctctagcatgagcacaagcgtttgcatccatcacccacagaagggctcacaagcattgtaactccagcagccaggaagtcagaagcctttttggctttcttttcgtttaagtgactgattaatttattaagatttagttattcggggctgtagcgaacgggggccagagcaagtggtctggagcaagagggagaaggaaaggggggctgggaaggaaaaaattatttattgagctggccatggtgatgatcccagcactcaggaggcaggggcaggaagatctctgaatttgaggccatcctggtctacatagcaagttccaggacagccagaactgtgtctcaaagaaaaaaaaaaaaggaaacaaagaaaaagacttattttgtgtgtgtagatgttttgcctgaacgtatgtcggcactatttgtgcaccttgtgctggtagagggcagaagagagtagagggtattggatcccctgagactggagttacatattgttgggagctaccatgtagatggtgggaagcaagcttgggtcaaaaatagatagatatactttgctttgcgcccatagttaatagtttcaataatgttacacttctttcttttttttttccttccttccttccctttttttttttttttttctgtagtcaggcaacctttttttgtttgtttgtttgtttgttttttgagacagggtttctctttatagccctggctgccctggaactcactctgtagaccaggctggcctcgaactcagaaatccgcctgcctccgcttcccgagtgctgggattaaaggcgtgcaccaccacgcccagcttccaggcaaccttttaatgcagttccttatgttatggtgacccccaatcataatatttatttatttatttatttatttatttattgttttttttttcgagactgggtttctctgtgtagagctctggctgtcctggaactcactctgtagaccaggttagcctcaaactcagaaatccgcctgcctctgcctcccaagtgctgggattaaaggcgtgcaccaccaccacccagctccatgtatttattatattttctgattctctattgtgtagtgcccctcgccctcactccaccccctgcctttgtaggaattgacttccagcagggaggagaccagctgtccctgagaatattcctcagtcaggactttcctgtgttcccttgtttgcatcgtttttatcttatcccactatattctgtgtctcatgcagattatgataaaagctgcagtgggggctgggaatggagcttggtcggtagcctgtttcctagcatatacagaactgggcttgatacctaatacacataatacctacctgtaatcccagcactctggaaatggggacaagaggatcagaagctcaaggttatctttaactatgtagtaaattgcaggccagcttgggttagttatatgaaacccttttcaaagacaggggagggtaggttgaacgtttgcgtgagtgtgttgtgtgtgtgtaggttcagttctgaaacagcttaatgggtcctgcatctgtttcaaagttccttcctaaccgtctttgctgtctcttcacagcttcaccgagtcatcataacttgcactgaagacctaccacgctgtgctattccatcccgcctggggctacccctcnnnnnnnnnnnnnnnnnnnnctgtgctattccatcccgcctggggctacccctcctctctcctgattcctcctgactggagtgctgaagcaggaagccacaccagaggcctttgttctctccaatttggaaatgtcatctacctaaaaaaatatgtacctttaccttctcagaccatcgaacagtcctagaaaacacttggaaaaaggaacacacacatacacaattaagacggggcaaggtggttcacacctttaatctcagcacttgggaggcagaagtaatcatatttttctgagttctgggctagccagaggtacataatgagaccccatctcaaaaaccaaatcaaacaacaaacctcagggtttcacaaaggcctaaggtatattgtatcatcgtaactgtttggggaatgtgaataaggcctaaaatgttttggggaaaaaagggaacttttttcctaagatagccagtttttttagttggctcacctgagctgggtatggctctctaccgagcacctgccatctgcccagctgtgctccgaggaagctgctccaggctcagtgccctgactctacctcctgtccagaagccagcattttctctttacttcccggggttctactcaacatgaagcagctcccaggagtgcttggttgagaagatgagggtagctcatgggtgtggctaggaaaggctttagttttgctgtacttgctctgctttgcagtgttggcagttagctgtggtcatctccagtagctcagtgctcactctgccttcttggtggcaggtttctgtgtggagacacaatggatttgaacttgcacttcatttattattattattaatttagagtaaattgtatttgttttttaaagttggctactttccaggatgtggagaaagtagaactcatgaatactgctggtgtttggcttgtcctctgcagtaaacagtagcaaagttatttcaaagtaagcagagctagccgtgggcattgcctgtagccccagtgcttaggaggctgaagtaggaagctcaccagtgccagttcagcctgggctacagcgtgagagtcgggcgtggtggcgcactcgggaggcagacgcaggcagagctctgatttcaaggccagcctgggctacagagtgagttctagaacagtcagggctgttaacagagtaaatcctgtctcgaaagagaaggaaaaaattttttttggtttgttttttgccattttctctggacatgtgtaaggtagtcagtgctcgttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtagaccaggctggccttgaactcagtaaatctgcctgcctctgcctcccgagtgctgggattaaaggcgtgtgccaccacgcccggctgcaaagaaaacttttaaacatgcatttggtatgtaatcccagcagtccctgtaaaggctagtaggatcagaagttcaagctcatcgtggatttttgggtttttgttttgtttttccgcccccaaggtcagctttggctacataccaaactggcggccagtctaaactgcaaaagattcaaaaatgaaaagcacttgatgttttatctttttggttgggctggggcttgaacctggagcttccttcctttatgcatgctaggcaaagcctctaccactaaaccttattcccagcccctcacctctttccaaatatagaaaagctgaagatttttgttcagcaaggatgagcatatatactgtctgcacagaaagcaatgttcagacatgaagtgaaaacacagtatttgaaggtggtcaaagacaccctaacacaagggcgagacaaaagggacaggtttgattccacctgcataataatatataaagtgtggtgtgaattcacaaaggtaagagcaaattgatgcttgccagaccatgagtacacagaagctgttcaaggggtctagtgttcccctgtggggagttgaaagacttggaatcagaaagaggaagtgattgtacataatgcagaatattaagtactaatgtataaaagggttgggtttttttgctttatgaatttcacttcaataaaaaagttgcttactttatattttcctgcagtgaattatgtataagcttagagaactattggtagttggcacaaatgaggcccaactcatgacaggcaattgctttacaactcattcacaccccagttatatgcttgatctttaaggtttttcttttttggtggtgccgggggttgaatctaaggcttcctgaaatgctgctcaaaagcttcaccgctaagcagtagtcctagaccattgttcatttgatgcctgtggaggccagaagtcagccttggatgtctttcctcgggccactttgtttttctttgagatagggaatctcactgggacatggggcacccttaggctgggctggatgtacagtgagccttaggcatttgcctccctagagcttgcattatgatttaaggaggaaacaggttaaagagaaaccacacatagtcaactgcttgtttcccacctataagctcttctgggaccacttcacagtgtctagaagatcagtggagccaggatgtgatgctaggccataatcccagcacttggaggcagaggcaagaggatctgctcaagatgattctcagctacataacagcaagttcgaagccatcttgcgctacatgaagattctgccattaaggcgtgtaccaccacctggctagattctgccattaaaaatatatatacatttttttttttgagcagtccaagtgggggctggagagagctcagtggttgagggtactgggctcttccagaggacctgggttcaaataccagcacccacatggcagctcaccactgttactccaagatctgacactcacatacatgcaagcaaaacatcaatacacataaaggcaaaataaatgtaagtacagaacttcttcaaaaacattcacagatggagcccactcaatacatttcccaagcagagatcagggtggggaggaaaagtgctatacaatgcattagaacttggtccagacgtcttgggagcaaccagcctccctgcccttgctctatctgtaatctgagagaatcagctcttgtcttctgaggaccctgtacttggatagctatggtgattgagcctttcattactcggtctttggttttagagacagggtttctctgtgtagcctttggctatcctagaactgactatataggccaggctggcctggaacttggagatccatattccaccatctcccgaccttgtctctctctctctctttttttttttaatggctttttcggaaccggtctccatatgcagtccaagctaacttcaaattctcctgcctcacccttccgagtactggaattacaggcacgagccaccacacccagctctaaaacggtcactatacaaaaatctatgttgggcggggtggcgccgtttgtaaccccagcacatcagggattgaggctggagaataaggagtgattatctttaaaaacaagatgttctttatgtttccacgcaagggaggctctgtcttcactttcctcgagaacactgacagcgctgagattcgacccacaagggtagccgcagaccagctgccctgacgacgcctgggattccaactccgcgctgtgacgcgccgctcgcggtccccgccttgccgccagcacccccaaggaggcgggacctgggcagggccagcagtcgcgggaaccctgagcccgccttctcctcaggctccgcgctgctcgccatggcaccggcgctgctgctggttcctgcggccctcgcctccttcatcctggcctttggcaccggagtggaattcgtgcgtttcacctccctgaggccgctgcttggagggatcccggagtctggcggtcccggtgagccgcagggatccagggcgagctgaagcggagaggaggagccgaagcagcgtggcgagggcggggcatggaaacaaatgacagggaaaccgccaaagctgggaggcgctgctgggaagggagcggaggctaaatcagaaactccaagattagtcttgtgcagaaagctgcgagtgaagactgacagagtacggcccggggtgggggtggggttttgtgaggagagccaggggaaggagaaagataaaaaaggggaaacgctgctagaaaaccccagacagcgagatgtggtagctcacacctttaaccctattattggagggggcagaggcaaacggatctcttgattgaaggtctatcattactgatttcaaggcctgatctattgagtgaggactatgtatgtagagataccctgtcttggaaaagcaaacaagaaaaccacaccaaagaccacttccctagtctccttgcttgcttgtgtgtgtgtgtgtgtgtgtgtgtgtgtgtgtgtgtgtgtgtgtgaatgaatataattgtggaatgtgtgcttgtgctcctgtgtgtgcagtgcaaacggctgctgaaggacaaccttgagttgtttgtttgtttgtttgtttgtttttgggtttttttttttcagggtatttctatgtatccccagctggcttggaattcagaggcctatgtattcttttttttttttttttttaagatttatttatttattttggtgttttgagacagggtttctctgtatagctctggctgtcctggaactcactctgtagaccaggctggcctcaaactcagaaatccgcctgcctctgcctcccgagtactgggattaaaggtgtgggccaccatgcctttctttctttctttctttctttctttctttctttctttctttctttctttctttcttaagatttatttattttatgtatatgagtaaaccttagctgtcttcagacacaccagaagagggcataagatcctattacagatggttataagccaccatgtggtagctaggaattgaactcaggacctctggaagagcagccagagcagccagtgcttattgaggggggaggggggagacagggtttctctgcatagccctggctgtcctggaactcactgtagaccaggctggcctcgaatttaaaaatccacctgcctctgcctcctagccaatgcactctctctctttctctctctctctttttttttttttttttttttttttggttttccaagacatggtttctctgtgtagccctggctgtcctggaactcactctgtagaccaggctggcctccaactcagaaatccacctgcctctgcctcccaagtcctgggattaaagatatgcaccaccacttccctgctctagccagtgctcttaaccgatgagccatctctccagccctatctcccacatattcttgggacatagttgttttttttttacagagacctgaggcaaaccaagaggttcgatggctcacctggaactggggttatagatagctgtgagctgccatgtagatgctgagaaccaagctgggtcctcacagcaagtgttgttaaccactaagactctctggggattcttctgtccctgccttcccagcactaaaattactggcacacaccaccatgctgggcttgaattcaggtcctcgggcttatacaacactacatagactgagccatctccccagccctcccaccttgtttttaaaggtgaccctacctaaaaaccttccccaggaggaggcctagagaagatggaagattgaaggaacagcagagtgaactgggaatggccttgacaagatcttgaaagcatcaggggcttgacatagagcttccaaagatgtggttaggggaatgtcctagccatcttaactggccttttgtccctttccttcccaactccctcagatgcccgccacgggtggttggctgccctgcaggaccggagcattcttgcctccttggcttgggatctatgtctgctgctactgtttgtggtacagcacagccttatggcgactgaggcagtgaaggcgtggacatcccggtactttggcgtccttcagaggtcgctctatgtggcgtgcacagccctggccttgcaggtatgaggcctggccaagggagactggtggaaccgaaagaacatgcagagctcagcctccatccctcctgggcatattctcctatcagcaaagctgtatatatttgacattccccagcacactaagagagtctcacctttgcaacattgttcatgttttattgcttcagctctgaattcctcccgggttcttatcctacaacctccctaggcctcacaatagcacttgtcttccagttggtattctcatggatgtttggcataggctagttgagtgattattatccaccagcccccatcccgtccagtctccaaaaaatcctgtgtagggatgggccatcttcatgtccttggtacccctcccagaaccctccacatggtaaatatttactgtttatacctgtcggaaagagtcctcgtaggttattgtggggcaagggagaccactggtgtgcccagtctctcatctttccccagttggtgatgcggtactgggagactacacccagaggcccagtgttatgggaggctcgggctgaaccatgggccacctgggtacctctcctctgctttgtgctccacgttgtttcctggctcctcatctttagcatccttctggtctttgactacgctgaactgatgggcctcaagcaggtgagaatcccacacccctacgtgagatctgcgtctgcaagtctctccctcctgaactcttctgacttctcttggctttgtagtgcctctgttttcctccagcttgccttaaaggagagtgactgtaggtctcctgggctttgagggtggatgctgggaagaggacggaggcaactgagatagagggcttgactttgagttccgtgatgttctctcttccaggtttattaccatgtgctgggactgggcgagcccctgtccctgaagtctcctcgggctctgagactcttttcccaccttcgacacccagtgtgtgtggagctgctgactgtgctgtgggtggtccccaccttgggcaccgatcggctcctcctggctcttctctttaccctctacctgggcttggctcatgggcttgaccagcaagatctccgctaccttcggtctcagctacaaagaaaactccaccttctctccagacctcaggatggggaagcagagtgaggagctagttctaagccctgaatttacttcccacctcaaaatcaaatcccttagtatccagacggagtttgcttcagaccgcggaggaggttggaagtcatgccctgaaggggctgtgccctctcctgctggagaactcagttcctgaatcttgatcctgaattcttattcaaagtttcctccactggtcttcaagatccgcctctcaccagccaagaatggttacaaaactcatgagtctccttttctcttagagcatgacctccacacacactgggtcagctcacacaggggagcacctcagctcacactggggagcactcactcccctggcactgttattggctctgcacctcagggattcccttccatgtttccacctcagggagctatgtcagggcctatctgaaagtttataagtagtggctcttttgtaccgcggctgtgcttcctccccactcctgccttagtttctccttaggtctttccctacagctctgtgtggtctcctaaggcgacgtctcccgattttaactcgggttgactcagggctccctgctctcccaaaggatatgcgctgcagaaaaaataaaattttatacatatgatatccacttgtctgtccatgactctcaagccgcagaaccaattgtgggaaggaagatgagacctagtttttgcggtgatagccgagcactctaaaacgatcgcaaggctggggccacaccccatggacccgccccatctctcagtcgtccagtcctgttccctccaaatattagtttctccgcgtataaatcagggaacccacgggagacagaataactctctgggaggagagcgaactcccaaagccattttgcctcagaccccagggcctggcagccgccttctctgccacagtaacaaagactggctagggaaagaaaaagcgtggggaggagcggcgagagatgggaagggcgggtccgactccaagcagctgccgcttccctccccccattccctcagggggcctgagtcacgggccgccgccccgggtcggccagctggagaagtgggtctggacaccccgcttcttcggggctgcaaggaaggaagcgggtgaaggtctctggagacagacaacggagagcgaggggatagccacagcaagagagaagtcccaccagagtccacgcgggaaggagggcagcgaagccccgcccttcgccgggctcctccctgcgcccccttccctcgccccattgtccgtagacaaagcggtcgccgcccccgcctggcccccagtctgcgtctccgtccctcctcttaggctccctcttccctcctcctctgtttccctccctccctccggatctcccttcgcctctctcctcctcttcctctctcccgacgcctgactccactgcacctcctcctagggaccccgaggcgtgtaagttgactatgtggctcccactttaagagaagtgcctcctggctccagatcttccctggagtgtctccccttttgcatagattgtcccttcagttccctctggtgcacaaccctttgggtcaaggtcccctgagagccggctccctggttggggaagacagcagaggcgtgatgtgggtcctcgtcgcgcccgagttctggagcgtatccggtggggaggccggcgagattgtagggactgaacgcggctggacgccagggttctgggaatgtacggggctgcacacttgctcgggtaccaaaagtccccaaggagggtatttcccctgacccgcctcgggggcgggaaagacagtggggtaggggccggactgaggggcggggccgagcgcagccgggaaggcagccgggagctgcgggggccccgtgcgaagaggcgccggcgcccttgcctgtttcccggtctccccttctaccctggacctctgccctctacatctgtcctcacctcctcacctcctgcccgatctcctcgcccttcgccgtctggttccctgttcttcccgtttatctccccctgcgtaccgggggaggcagtcttgactgaatccgctcacttctcagccccggctcctccggctcctctctctctcctgcttttcctctcttccctttcttatatcttagggacggtctggtgcccacaaaccccaatctagctctgcctctgcccggaatctcgactcttcctctcccactatccccacccccaacttggcacccagcttttctcttcagtttttcagttcctgactcttttgctgtccttcctttcacggccttcctctatcttcattcttaattccactgtcccctcctgcccttcttcgtcccttcccgcatcacttcctcccccaacccccattctcagtctccgggctcctctgaagcttacccttcctgttcctgtcccccaatactctctccttcacttccagtgaccatgaccgctatcccagattggaagctacagttgctagcccggcggaggcaggaggaggcagcggttcgtggccgcgagaaagcagaacgggatcgcttgtcccagatgccagcctggaagaggggaatcctggaacgacgcagagccaagttgggcctgcctcctggtgaggggagccctgtgcctgggaatgctgaggctggacctccagacccagatgaatctgctgtccttttggaggctattggaccagtacatcagaatcgattcatccaacaggagcgacagcggcagcagcaacagcagcagcagcagagaaacgaggtgcttggtgataggaaggctgggcctctggaggttctagaaaggagatcaagtcctggtaatttaagagatcagagccctaagggaagagagtccagagaagagaggctaagtccccgggagtccagagataggaggctggtgatagggggagcccaagagtcaagttcgaggtctcttcgagactggaggcagagcccagcagaggccagagacctgagttccagaccagcagaggctcagaaatggaggctgagccctggagaaactccagaggagagtctgagattagcgggttctggagatgacagtcccaagagaaaggaggtgttggaaagcattctgagccctggggagcctggtgaccagacggccagcccgacagatgtccataaatggaatcttgactcaagagaaccccagaaacagagcttgatacagctggaggccacagagtggaggctgaagtccggtgaagagaggaaagactacttggaagggtgtgggagagaggaagagaaattgagttcagggattgttcccggtgacaaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactctgggacggaaggctccagacagcaggaagaggaagcggcagaaccccggcccccaacaccagcccctctgtctcccccaccctcggccccaactgccccccaaccctctggggatcccctcatgagccgtctgttctatggggtgaaaccaggaccgggggtgggggccccccgccgcagtggacacaccttcactgtcaacccacggaggtgtgcgccccctgccagcccagcccctccagtcaaccctgctacagctgatgctgcagggtctggatctgggaagaagcggtacccaactgcagaggagatcttggtgctggggggctacctccgtctcagccgcagctgccttgtcaaggggtcccctgaaagacatcacaaacaggtaagagagctaccatgcctgactgggtagaagtctctttctagttctgactggatggcttttttatatgtgtgtgttcttgtcttctattctttttattcctgccgactcccttcctccccctgcacacacccttcctctgggtagccttcctttgccattcattttggagccccaaggattctgttctgcactcaactgctgtgttggggtgtgtcgttttcgggtgtgccctgcctgtttcttctttccccactctctcggtcccctctccttttcttcctttgggcttttgacccagttaaccctctggtaagagagaaaagataacgtacctgtgaaggcgtgtgaaaataacccagggggacagagaaggttgacggagaagttcagggaagttggaatgaaggtctcagccccagaaggaggagggggtcaaagctaatggaggacattccagaacagaggtggggggtgggttggggtgatggaacagagctggctgaaggaagaaggagtttagaccccaagtcggcccccactcctggcaagaagaggccatttgaagtgggtgacttcagggttgcctacccctccccccaaactgggcaaatgttagacagtgcttccttctctctagggacaagaaaagccttctcttccaaaatatcccagtcccttcccccatctttcctccctgggcttcccctccccccacagaactgtctcagcctcgggggttttttccccctctgttcctgctaccctggcctctccctcccctggggtagaaacagagagaagttcatttgcgctgagctgagagctgcagagctgcgactggttcaggcactgtgagagttgggggcggggtggggtggggtggggctgaggccagcagagggtcagaggttaggctgaaatgcagacatgcaaggaagcactggatagggtaactattccctttggctccggcccagcaccttcctgatatgtaccaatagttttcctaagtcaaaaaatctctgaggagagacagtgctacagtcagacgcctcagaccagaaggccctccacacaacacaaatcttcccagggcctggcaagcctgtctcacccttctttcatgtgtttgtgtgtgtgttcagtgtcaataggccaccatgaggaccaaagatcagggctaagctcatgagtcacttggttcctcccagttcatctttttgttgtttttaattcatgtacaaagtgtccattttcattatcctattcttgaacgtgacttttcttcccctgcctctgtctgggttattggctctctcttctcagggctgggcagctagaaaggacagaggacaggaaattctcttagggtgaggtgttctgaaaagtcacttcctactgaggctggctgtggctttggagactgagcagagggagacacaaggctttgtggctcctacctaggaaccatctgggggaagccaaggagcctagtacagagcaggacctgtgctggtgaccgtacctaggtcatccagtaggaggggcggaagcagaccttccaaacaggaagcctggggtgggggcccggaaggctggtagcactgagtgggaacactgggcccaggccccgaaagaactactcaggatgtggtgagagaatcaggaagcagctacactggggtgggggtggggaagaggctgcacagttccctagacctgaccatttacctcttcctctatgagtctccatcctcaccgctcagctctctgtctgtgcagcctcagcaaggattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaaggggaaggatgcgaagcacagcctgttttggggggatttctggctttctctgacctctgtttttgtgagtaccctgtgggctgctctccattcctacccagtgtttgcctggacttggctctctatctttgtcagttccatattccaggggactcttctgtatgttgaacatcccttggcttgtccaaacctttctgttgtcttatccattcctgaatctggagtgcccatctcacttcaggttggttggttggctggcttgtatactacctctgcatcacagcagcgaaggaaagagaccctaattctgccttacttacccagtccttgccatggcaaaatctctctctttttttgtggttgtgtgggtatgtgtgtgcttattttttttaaagacttatttatctatttatttatcttatgtgtatgagtacaccatcactctcttaagacacaccagaagagggcatcaggtcccatttaccgatggttgtgagccaccacatggttgctgggatttgaactcaggacctctggaagagcagtcggtgctcttaactgctgagccatctctccagcctgtgtgtgcttatttttaaagacagggtctctatgtagatcaggttggcctcagactggtcacctccctccatctgaatgtcagcttttttttttttttaatttatttatttctttattattttgtgtgcacgggtggttggctgcatgtctgtgtgagagtgtctgaggaactggtgttatagacagtggtgagctgacatataggtgctgagaactacagttacagatggttgtgagtgctaaaaactgaactcaggtcctctgcaagagcagcgagtgctcttaaccactgagccatctttccagcccctaagttttgttttgaatgacgccattagaaggaagaatcaagatgtaaggggaagccaaagccccaaatggatggaagggaaggtctgcctggtgcctaaggccagcccctttccactctcctctgctctctcggccctccctagggtcccctagtaatgaactttcctcctctcctctcacttctctcagctcaagatctcctttagtgagacagccctggagaccacataccaatacccttctgagagctcggtactggaggatctaggcccggagcctgagacccccattgcccccttagcaacccagcctgacgaggaggaggaggaggaggaggaagaggaggagttgcttctgcagcctgggctccagggcgggctgcgcaccaaggccctaatcgtgggtaagcggctgcggcctggttggcggagggcgccccctggtgtctgtggtgtggtggtactttgaaggagcttggcctaaactccctgattcctgaaagccaagtacacatgggatctccagatttgaaaaccagagctccctcgttctccagctctctaatctggttaaaaacacccgtgttgggtcagacggcgtggagttggaattccagcttgtctgttactcaggcgtgatcctgaatcaatccgagctcaggcttccacttatctttatgtggggggtgcatgcctgcactcaagggtcagatccaaggccttgagcatactaggcgagtgctctgctgttgattggtagcctcagccttcatttatcgttctttaaaatcgagttaacgttgtatcctgggcctccgggtgtgtagctcagtgataagattgctgccttgagctgagaataatgtaatcctatcactcaggcagaggtagatctgcctggtctacacagtgagttccagggcactctggactctaacagattgagacccccagcaccacaaacaatttgatactagtaagttgtcctgaggttgttggaagacttgagtggcttttatcaagcacctaggaccatggctaggtattaaattacttcacctttgctgagatgactgtgaaattaaacaagatgcctagcacagactccagttaactgtgatgctactgttcctggtgacaaggcacgcatccagcccgttacaaagacttctctcataccagccactcttcagttctgggatgcatggggaggctgggggccctctccacttctctgccttgatcacttcttttcctgcagatgagtcctgccggcggtgaccatcttccagtttgggcgcatacctccttccttccttccttcccgtacctgaagcttctggagtctggatgattcagagccgacagacctggcagggagcctgcctggcagggaagggggttgagcatattctgacttgcttttcccatcccatttctggggcagagccagtagcctaaatttacccctaactcagggtgtttcccgtgggtgacctaagagtgagcatcaagtcctgggttggaactcagaaagtgatctggaattgagatggagcaccccctagccctgcagccttccttaactcccagcaactcccggggacctacagacacccctttttctaggtcactaccccttcgtttacagcttccttctctcttgatcacagcctggtttacattacccccctccccccccagctcccagtcccacctgcgaagtcccaggtttacaagccatgcctacccacggagagcccccgtgggaccctccaccttcccaccgtttcattgagagtgacttgggaaggtgtgtggccttcttcaactttgctcagtattactgtgcctcggtttcccccaagagggaaggctggggatcctaaccctgaaccccatgaaagttatttaattctgtttctctgtgtggttcatattgaattgaactgcagcgtgggggtgctaaggaagtgcttcgctttccctggcgctcctttgtcagctgcctgatttgtatcgtttttgtaactttccataataaaatggagctcttttcaactctcttgctgccttcctttgtttctttttttaaaagattttgttttggggctggagagatggctcagcggttaagagcactgactgttcttccggaggtcctgagttcaaatcccagcaaccacatggggctcacaaccatctgtaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctggctttttttttttaaggtcttttaaaaaacaggtacagtgtctgaagagatggttcagcagttaagagcacttgttcttgctgaggctcaaattccactcccagcatgcacacaaacataaaatatgtgaatatataaaaatcatatcatgtatatgatatatattgatatgtgcgatatatcaacaatagcaaaacatgccaataccaaaccaacaggagaagtagtctccacatgtccttttaagtttctcattttttaagatttatttattttttattttattttattttattttattttggttttcaagacagggtttctctgtgtagccctggctgtcttggaactcactttgtagaccaggctggcctcgaactcagaaatccgcctgcctctgcctccccagtgctgggattaaaggcgtgcgccaccacgcccggctgtggtcagtgctcttttttttttttttttaaagatttatttatttattatgtctaagtacactgtagctgtcttcagacacaccagagaggccgtcagatctcattacagatggttgtgagccaccatgtggttgctgggatttgaactcgggacctttggaagagcagtcagtgctcttaaccactgagccatccctccggtcccttttgggacctcttgcttgggattgtttggcctcaattacccaaacaggaatgacttcaagcatgtactgtcctgtccacttaggtgcctgaacctgagcagatataacttatgccgtatgtcatccaatagaaataccaacagcagagacgagaatatccaagttatactttattcacagagcttgcatctgaccaggcagtggatcctaaaataactgctttccatcttctctcctgccacaggctttataggaagcagagaaaaggaaacaaaaaccatccattattccagaactcaagttctgtcgctggtcaggtggtcagtcacatttctgagatctgagacatccatgcctgtccactttctgaagctcagagaactgagttagtgtttgttggaatcttctcctgcagtgtcatctcatctgtgttggggaggggttagctcacaacaaaccattagcagtaggtatgtgccaagctgttagcaacacatacctggattgctttttaaaatgtggagtgttttgttttgactttatccattctactcgctccccatcagtaggaaataaaatctacttaaattgcctattattattattattattgttattattattttggtttttgagacagggtctctctgtatagccctggctgtcctggaactcactctgtagaccaggctggcctcgaactcagaaatctgcctgcctctgcctcccaagtgttggttaaaggcatgtgccaccactgcccggctttttttttttaagatttatttattttatgtaagcacactgtagctctcttcagacactccaaaagagggcatcagatctccttactgatggctgtgagtcaccatgtgattgctgggatttgaactcaggaccttcggaagaatagttggttgagccatctctccagtttgcctctcattatttttgattgtacataaattacacatttcagtcaagtgtgatagtacatgtctataatccccacacttgggaagtaggaacaacaggatcaagagtctaaggttgccgggcggtggtgtcgctcacccttaatccctgcacttgggaggcagaggcaggcggatttctgaattcgaggccagcctggtctacagagtgagttccagaacagccagggctacacagagaaaccctgtctcaaaaaacaaaacaaaaaccaaaaacaaacaaacaaaaagagttcaaggttgcgggggtggggggtgggggaggatannnnnnnnnnnnnnnnnnnngggaatagggggagaaactctttcaggggggaccaggagggggcagctttgaggatgtaagtaattaagtgcgtaagtaaataaataaataaataagagttcaaagttatctttagctatgtagtacatacaaggccagctaattgtacatgagtccccgtgtttttttgttttttgtttttgttttttaaatggtgaactggagagctggcttctcaattaagaacacttaggtttaactcccagcactcacgtgatgtctcaaaaacacccctaactacattttcaggagatccaatgccctcctccagattctgagtggtatacatacttgcaagtaaaatgcctacacacacacacacacacacacacacacacacacacacacacacacccaatagaggggctggagagatgattcagtggttaagagcacttgctgctctcagaagactggtgtttggttcccagcacctatatcaggcaggtcccaaccaccagtaactccaagttcagagagacacaatatctctgacctaaaagggcacacacacacacacacacacacacacaccacacacacacacacacatactgtgcagataaattcatgcaggcaaacccacatgcacattaaataaataaatattaaaatcttatgatacccaaactcccacctaaatgtatttattatgtacctttagtttttgttgttttaatttttaatattttaagttaggccgggcgtggtggtgcacgcctttaatcccagcactcgggaggcagaggcaggcagatttccgagttcgaggccagcctggtctacaaagtgagttccaagacagagaaaccctgtctcgaaaaaccaaaaaaaaaatttttttttttaaaaaaattaggtgtatgtgtgtttgtgtatgagcacgtgcacacaagtgcaggtgtcagaagagaccagaggtggtagatcctcctggatctggagatatacgtggttgttggtgagggttgtgggtgcaccgaatcgaactcgacttcgctgagccgtctctccagccctttgttatatatcttgttttcctaaccctgatttgtacttcttttatttatcccagctgtgggaactagttagtcatcactgacagcttgtattgatagagaactgcacccgggcacagatcattagggggcgacggagagcttggacgaggctgtgcatgaaagcctcttgcacgaagcgtcgggaaagaggctgcgcgatttgaacccgcccagccaccgttgatccctggccggaagagcgcgactctttccgggtttcgcggtctgtggaattggagtctctacggcagccggagcgaggcggtagtaccgcaggctctgtccccgccgcagtcctggccgttccgcggttgcgcgcccggagcaggacgcgtcgccatggcgacgccggcggggctggagcggtgggtgcaggaggagctgcactcggtgctggggctgagcgagcggcacgtcgcgcagttcctgatcggcaccgcacagcgctgcgcctccgccgaggagttcgtgcagcgcctgcgggacaccgacaccctggacctcggggggccggcgcgggacttcgccctgaagctctggagcaaggtgtgtgccgccggggcaggccactcacagccgaattggctcgtacgcagtgtggctgtctattctgtgatagcctgcaactttcaatatagtacacaggctggcttagaacttgcagcgagcctccctggtagtggggtgacagagagacctttcattcttggttccgcccaccatttaatttttttcctctgttatctagatatcatgctaggtgttgggtgtatacaggtctgtggagaagactcgagatggggctctacatacatgtttaagctagagccattgttagttacagcacataccccaggcctaaggatgtagctcagttggtagaatgtttgtctagcatacagtaagccttggattcaatccccagccctgggaaagagtcactgagaacagagctaggagaattagcatttaggaaataggatcgaggctggggagggatggcttagcagttaagaccccttgtgcatctggaagacttgagttcagttctcagcaaccaggcctagtggcacacaaccatctgtaattccagctccaaggagatcggagggcttctggcctttgccaggtaccccatacacataaataaatgaaaaataaatcatgaaaagaaaatgggttttagaacataaactacttaagctcagaaccaatactttaaaaaaaaaattctatcgtggggcaagaagagatggctcagggattaagaccacttgctgttcctctagaggaaccaggttcaatttctagaacccacgtggcaactcacaactgtaactccagttctatgagattcagcaccctcacacacagctcacgttgcaggcagaacaccagtgcacataaaaataaaagtaagtcattaaagttaggaagaagttttagttcgtgcatatgcccgtgtgaggctgtgagcgtacaacctgtgagagctggttctttgcctccaccacgggatggctttcagtaatcatttgctcagtggattcctagaaggacgttcagaagctgcggagccctgttgagctatgaccgtagaacaagaccacgaagaagagaaagatggagacaggctttagatatagtaaccggttcgtaggcaaatgagggtactgaggtcaggagctgtcatatctaccggcaggtgccacggaaggctgtggtggaaaagccagctcgggcagctgagcgagaggcccgagccctgctagagaaaaaccgttcttataagttgttggaagacagcgagagcggcgaggaggcagtgggtagtaacgggagcagcctccagaagaagcggaagagacggaaacacctcaggaagaaacaccaggaggacgaggaggacgaggaggaagaggtttccgagtcagggaagaggaaggcagggtaagtcagaaggaaggagagggattggagcaggctgtcggctgtggggatgctaagctttctcagtacccccgtttgatacactgggctgggtttgctgggttcagggggagtaaatcacccacggaggagaagccagcctcagaggatgaatgggaaaggacggagcgtgagcgtctccaggacttggaagaacgggatgcctttgcagagcgggttcggcaacgggacaaggaccggacccggaatgtcctggaacggtcagataagaaggtgagctgaagagagtcagtcaggcaagtctggatttggctgcagagttgtctctgggaagacaagagttgtcactagggttccccgtgggctcactggctatggttctccctgtctggttgagatcgacagaggttctccaccgaggaggggcagcgaaggacattagtcatcctgacagcaatggtacctttggcctcacatccctttacatgatttcttctaggcctatgaagaggctcagaagcgcctcaagatggctgaggaagatcggaaagccatggtgagaccctgggttcaaaaagcagtgtctgaagacaaagatggctggagtggtcggccgtagcaggaagggtcacagagggagtgtgcagagatgtgtctgggtggtcaggctctagaggagaggggcctgcctgacaggaaccggaaaagagtggacttgggttgtagaaggagaaagttacaaatcctctcgccttggtaagatcaagtcattgtgtctctgagacttgatgagacacaaaatagctagcaccaaaaggccccacatcctcctctttggagttttgcacactctgagtgtgcagggagcagggtttcagtgctggtaggatgaggacttgactgtcccttcctgacccaggtccctgagctccgtaagaagtctcgtcgggaatacctggcgaagcgggagcgagaaaaactggaggacctggaggcggaactggctgatgaggaggtcctgtttggggacgtggagctgagtcgccatgagcgcagggagctcaagtacaagcgacgtgtgcgggacctggctcgggagtaccgggcagccggagagcaggagaagctggaggccactaatcgctaccacatgcccaaggagacccgagggcaggtgagggaaccctgcctgctcgtgggagaggcggcacgatggctagtctttcccctctcctgttcatagctggtaaaagcagtggtggggaggacccgggcagccctggccactcttaagttttccctgctcccgtctctctccacagccagctcgaactgtggacatcgttgaggaggaatcgggtgcgccgggagaggagcagcggcgctgggaggaggcccagctgggtgctgcatccctgaagtttggagcccgagatgctgctgcgcaggaggccaagtaccagctggtgctggaggaggacgagaccatcgagtttgtccgtgctgctcaactccagggtgacgaggtgagaaggagaaagagtctgggatgctgactcgagggcctctaaaggtggtggggacctcaccgtccctgtccccatcctcaggagccgtcaggcccgcccctgtcagcccaggcccagcagaaggaatctatccaggctgtgcgccgcagcctgcccgtgttccccttccgagaggagcttctggccgccattgccaaccatcaggtcctcatcatcgaaggcgagactggttctgggaagaccacacagatcccacagtacctctttgaggaggtcagtcattacagtgtggcccagcccttgagtcagtcctgacagacgccctttgtgtcccatcctttccgataagtcatgaggcttttgagactgatgaggacactctctctgtcattttgttctccctgccgtcacataccatgcctgggagcagggagatggatattatagatttgaccctcttgggctttcatcctgcatgacctcggccccgctttccctctgcaggggccagagaagtaagagtgaaagccttgttttcctactgtttgacctcttgtctcccattgcttctgggtatgccccagccagtctgtccctggtcagttcaagtctagcagagccctggttgtaagcaaagacgtgtaggactgactcagcatcccccgggcccttggtttccatcttgtctgtcctcttttccctgccttgcctggctcaggacagcatgtctagcagaggaataaccctttcttctctccttttagggttacacaaagaagggcatgaagattgcttgcacccagccccggagagtggcggctatgagtgtggcagcccgagtggcccgggagatgggtgtgaagcttgggaacgaggtgaggtctttggggattcatgaagttgctcacattgccccacacctccggtctgggcattggacattccaacctcctgactgtctatgaccaggtgggctacagcatccggtttgaggactgcacctcagagcgaactgttctccgctacatgacagatggaatgctactccgagagttcctctctgagcctgaccttgcaagttacaggtgtgtgcgtgcgtgcgagcctctcatgggatgccccacctcactgccgactcccctcagagattcctttaatctcctctttattcccagtggggccagttggccattatctattnnnnnnnnnnnnnnnnnnnnnnnnnnnnnnnnnnnnnnnnnnnnnnnnnnnnnnnnnnnnnnnnatgtaaccttagctggcctcagtcttgtggatctcagcaagcaagtactgtgagattacaatcaaaagccaccatgccaccccctatttgctttaaggtcttagttccacttcttccagtgagaatagctgtctcttgactgatccagagatatctgacttgttccaaccctagattaaaggaatctggactcttccctgactttcttttatgtattaaaaaaaaatttgtgtgtatatgtatttatgagtgtgtatgtatgtatatgtatgtgtgtatatatgtgtaagtctatatatgtgtgtgcatgtgtgtatgaatgtgtatgtatatatgtgtgtgtatatgtatgtaagtgtatgtgtgtgcatgtgtgtacaagtgtgactgtattatgtgcatgtgtatgtgtatatgcatgtgcatgtatgtgtgtatgtatgtatatgtatgtgtgtgtgtgtgcatgtgtgtatttgcatgtgtatgtgtatatatatgtatgtgcatatgtgtaagtgtatgtgtgtgcatgtatgtatgtatgaatgtgtgtgtgtgtatatatatgagcatgtgtgtatgtatgtatgtatatatgtgtatgtgcatgtatgtatatatatgtatggcatgtatgtgtgtatatatgtgtgcatgtgtgcacatgtagaggatcagaagacagcttggaggagtcagttctgtcctttt

SEQ ID NO: 950 - DNA, 1638 bp, Mus musculus
acctgggcagggccagcagtcgcgggaaccctgagcccgccttctcctcaggctccgcgctgctcgccatggcaccggcgctgctgctggttcctgcggccctcgcctccttcatcctggcctttggcaccggagtggaattcgtgcgtttcacctccctgaggccgctgcttggagggatcccggagtctggcggtcccgatgcccgccacgggtggttggctgccctgcaggaccggagcattcttgcctccttggcttgggatctatgtctgctgctactgtttgtggtacagcacagccttatggcgactgaggcagtgaaggcgtggacatcccggtactttggcgtccttcagaggtcgctctatgtggcgtgcacagccctggccttgcagttggtgatgcggtactgggagactacacccagaggcccagtgttatgggaggctcgggctgaaccatgggccacctgggtacctctcctctgctttgtgctccacgttgtttcctggctcctcatctttagcatccttctggtctttgactacgctgaactgatgggcctcaagcaggtttattaccatgtgctgggactgggcgagcccctgtccctgaagtctcctcgggctctgagactcttttcccaccttcgacacccagtgtgtgtggagctgctgactgtgctgtgggtggtccccaccttgggcaccgatcggctcctcctggctcttctctttaccctctacctgggcttggctcatgggcttgaccagcaagatctccgctaccttcggtctcagctacaaagaaaactccaccttctctccagacctcaggatggggaagcagatgaccatgaccgctatcccagattggaagctacagttgctagcccggcggaggcaggaggaggcagcggttcgtggccgcgagaaagcagaacgggatcgcttgtcccagatgccagcctggaagaggggaatcctggaacgacgcagagccaagttgggcctgcctcctgtggacacaccttcactgtcaacccacggaggtgtgcgccccctgccagcccagcccctccagtcaaccctgctacagctgatgctgcagggtctggatctgggaagaagcggtacccaactgcagaggagatcttggtgctggggggctacctccgtctcagccgcagctgccttgtcaaggggtcccctgaaagacatcacaaacagcctgggctccagggcgggctgcgcaccaaggccctaatcgtggctcccagtcccacctgcgaagtcccaggtttacaagccatgcctacccacggagagcccccgtgggaccctccaccttcccaccgtttcattgagagtgacttgggaaggtgtgtggccttcttcaactttgctcagtattactgtgcctcggtttcccccaagagggaaggctggggatcctaaccctgaaccccatgaaagttatttaattctgtttctctgtgtggttcatattgaattgaactgcagcgtgggggtgctaaggaagtgcttcgctttccctggcgctcctttgtcagctgcctgatttgtatcgtttttgtaactttccataataaaatggagctcttttcaactctct

SEQ ID NO: 951 - protein, 485 aa, Mus musculus
LGRASSRGNPEPAFSSGSALLAMAPALLLVPAALASFILAFGTGVEFVRFTSLRPLLGGIPESGGPDARHGWLAALQDRSILASLAWDLCLLLLFVVQHSLMATEAVKAWTSRYFGVLQRSLYVACTALALQLVMRYWETTPRGPVLWEARAEPWATWVPLLCFVLHVVSWLLIFSILLVFDYAELMGLKQVYYHVLGLGEPLSLKSPRALRLFSHLRHPVCVELLTVLWVVPTLGTDRLLLALLFTLYLGLAHGLDQQDLRYLRSQLQRKLHLLSRPQDGEADDHDRYPRLEATVASPAEAGGGSGSWPRESRTGSLVPDASLEEGNPGTTQSQVGPASCGHTFTVNPRRCAPPASPAPPVNPATADAAGSGSGKKRYPTAEEILVLGGYLRLSRSCLVKGSPERHHKQPGLQGGLRTKALIVAPSPTCEVPGLQAMPTHGEPPWDPPPSHRFIESDLGRCVAFFNFAQYYCASVSPKREGWGS

SEQ ID NO: 952 - DNA, 34096 bp, Homo sapiens
attctcctgccccagcctcccgagtagctgggacgacaggcacccgtcagcgcgcccggctaattttttttttttttttttttttgtatttttagtagagacagggtttcaccgtggtcttgatctcctgacctcgtgatccacccgcctcagcctcccaaagtgctgtgtaattacaggcatgagccactgcgcccggcctagcaagagtatttcatagacagtatgcggtgtgcttcacttggcttcatattaggaggtattattttagtgatggtaagactggttagtgggtcctgaacccatttctaggattctttttcacctgattttgcctttgctctgtcttccccagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgccttatggtgtagtgtagttttttaaaatgtctaggtctcaagacacaaacttaaaaaaaaaaaagtcatagacttgtatttaattcatcattatcttctatttaggacaatttgtatgacatttcttaagatttttttttttttcttgagacagggtctcatctctgtcacctaggctggagtgcagtggcaccatcttggctcactgcaacctccacctcccagttcaagcaatagtcccacctcagcctcctgagtagctaggactgcaggcacacaccaccatgcctggctaattttcttttttttattgtttagtagagacggggctctactaaatttttgtatttttggtagagatgaggttttgtcatgttgcccaggctggtctctaacttctgacctcaagtgatccacccacctcagcctcccgagtagctgggattacaggcacatgccaccacacccggctaatttttgtatttgtagtagagacggggtttcaccatgttggccatgctggtctcgaactcctgacctcaggtgatccacctgtcttgacttcccaaagtgctgggataacaggcatgagccgccatgactggccttttatctttttgagtcaaggtgtcactctgttgcccaggctgaagtgcagtggctcgatgtcggcttactgcagccttgacctcctgggctcaaacgattttcctctcagcctcccaagtagctgggaccataggtgtgtgcaaccatgcccgatgaattttgtatttttggtagagacgaggttttgtcatgttgcccaagctggtctctaactcgtgacctcaagtgagccacccacctcagcctccaaaagtgctgggattacaggcttgagccaccgtgcccagccagatttaaattttaaaagttggttgattacaaggatgtggagaaattagaatccttatacattgctggtaggaatgttaaatggttcagcctctgcggtaaacagtttgatggttcctcaaaaagttaaacatatggatgggcacagtggctcacacatgtaatcccagcactttggaggccaaggctggcagatcacttgagctcagaagttcacggccagccgggcaacatgacaaaacctcgtctctaccaaaaatacaaaaattcactgggcatggtggcacacactacggtcccagctacttgggaggctaagaggaaaatcgtttgagcccaggaggtcaaggctgcagtgggtggacacgagccactgcacttcagcctgggcaacagagtgagaccttgtctcaaaaaaataaaaggccagtcacggcagctcatgcctgtaatcccagcactttgggaagtcaagacaggtggatcacctgaggtcaggagttagagaccagcctggccaacatggtgaaatcccgtctctacttaaaatacaaaaattagccgggcgtggtggcatgtgcctgcaatcccagctacttgggaggctgaggcagaagaattgctggaacccgggaagtggaggttgcagtgagctgagatcgtgccactgcactccagcctgggcaacagaacaagactccatctaaaaaaaaaaaggccaggcgtggtggctcacccctgtaatcctagcactttgggaggccaaggtgggcagatcacaagatcaggagattgagaccatcctggctaacatggagaaaccccgtctctactaaaaatacaaaaaattagctaggcgtggtggcaggcgcctgtagtcctagctactcgggaggctgaggcaggagaatcgcttgaacccgggaggtggaggttgcagtgagccaagactgctccactgtactccagcctggcgacagagcgagactccctctcaaaaaaaaaacaaaaaaaaaaaagtagcctcttttctggctggaaccctcatgtagagtgttgtagataagaaggagagggccggggtgcagtggctcacacctgtaatcccaacactttgggaggccgaggtgggcaggtcacctgaggtcaggagttcaagaccaggctggccaacatgacaaaaccccgtctctactaaaaattcaaaacaaaattagccgggcatggtggccagcccctgtgatcccagctactcaggaggctgaggcaggagaattgcttgaatgcaggagggggaggttgcattgagtcgagatcgcaccattgcactccagcatgggagacagagcaagaccccgtcttaaaaaaaaaaagagagagaaaaagaaggaggttcttgctatgccagaaacccttaaaaagcgaaggaatttcccagagctgaagatcaaaggcccgagaaagaaatttgcccaaaagatgattcaaaaggcaaggaggaagcttatctatgaaaaagtgaagcactatcacaaggaatataggcagatgtacagaactgaaattcgaatggctaggatggccagaaaagctggcaacttctatgtacctgcaaaacccaaattgccgtttgtcatcaggatcagaggtatcagtggtgtgaacccaaaggtccgaaaggtgttgcagcttcttcgcctttgttaaatcttcagtggaacctttgtgaagctcaacaaggcttcaatgaacatgctgaggattgtagaaccatatatggcatgggggtacccaaagctgaagtcagtaaatgaactaatctaccagcatggttatggcaaaaatcaataagaagcaaattgctttgacagatgacactttgattgctttatctcttggtaaatatggcatcacctgcatggaggatctgattcttgagatctatactgttggaaaatgcttcaaagaagcaaataacttcctgtagcccttcaaattatcctctccacaaggtagagtaaagaaaaagaccacccattttgtagaaagtggacatgctggcaacagggagaaccggatcaacagacttattagaagaatgagctaaggtgtctactgtgattgtttttctaatctaagcacttaagcagtacctgctctcaaattggaggaaaaaaaagaaagttaaatacggaattaccgaacagtccagcaattctgctcctaggtgtacacccaaaagaatttaaatcaggtgtccaggctgggtggggtggcttatgcctataatcccagcagtttgggaggccaaagtgggaggattgcatgagcccaggacttcacgggcaaccagtctgggcaacatggcaaaaccctgtcactacaaaaaatacaaaaatgggctaggtgcggtggctcacgcctataatcctagcactttgggaggcaaggtgggtagatcacctgaggtcaggagttcaagacgagcctggccaacatggcaaaaccccatctctactaaaaaatacaaaaattagccgggtgtggtggctcatgcctgtaatcccagcattttgggaggccgaaggtggttggatcacctgaggtcaggagttcgataccagcctgaccaacatggagaaacccgtctctactaaaaaatacaaaattagctgggcgtggtggtgcatgccggtaatcccagctactccggaggctgaggcaggagaatcacttgaacctgggaggtggagattgtggtgagccaagatcatgccgttgcaacaagagcaaaactccgtctaaaaaaaaaaaaaaattaactgggcctggtggctcacgcctgtaatcccaacactttgggaggctgaggcgggtggatcatgaggtcaggagatcaagaccatcctgtccaacatggtgaaaccccctctctactaaaaatacaaaaattagctgggcgtggtggcgtgcgcctgtagtcccagctactcgtgaggctgaggcagaagaatcacttgaaccagagagtcagagtttgcagtgagccaagatcatgccactgcactcgagcctggctatagagggagactctgtctcaaaaaataataataataataataaaaaaattagctgggcatggtggcatgtggctgtaatcccagctactggggaggctgaggctgcagaatcacgtgaacccgggaagcagaggttgcagtgagctgagatcatgccactgcactccagcctgggtgacagagaaagactctctctcaaaaaaaaaaaaaaaatttagccaggtgtggtggcacatgcctgtaatcccagctacttggaatgctgaggtgggaggaggtcaaggctgcaatgagccatgattgtgcaactacattccagcctgggtaacagagcacgactctgtctccaaaaaaaaaaaaaaaaaaaaaggaaaagaaaacagttattcaaacaaattcttgtacgtgagtgttcatatcagcactttttacaatagccaaaaaggtggaaacaacacaaatattcatcagcaaatgagtggataaacaattgtgatatatccatataatcaaatattattcaaccatagaaaaggatgaaatactgatatatgctacaatattttgaggatgaatatcaaaatattttgctaagtgaaggaaagccagaaacagaacacatattatgtgattacacatgtaaggaatatccagaataggtaaacccatagagaacaagagcagatttgtggttgccagtggctgtggggtgggggagatgagaaaatggggagtaacttcatgggtatggagttttatttgggggtgatgaaaatgttttgaaggcccagcgtggtggctcatgcctgtaatcccagcactttgggaggctggggcaggtggatcacttgaggtcaggagttcgagactagctggaccaacatggtgaaaccctgtcactactaaaaatacaaaattagccaggcgtggtggcacatgcctgtaatcccagctacttgggaggctgagcaggagaattgcttgaacctgggtggcagaggttgcagtgagcggagatcagccattgcactccagcatgggcaataagagcaaagctccatctcaaaaaaaaaaatgttttgaaattagatagaggtggtggttgtacctattactaatatactaatgtactaaataccattatattattctctttaaagtggttaggctaggccgggtgtggtggctcacgcctgtaatcccagcactgtgggaggccaaggtgggtggatcacctgaggtcaggagtttgattgagactagcctggccaacatggtgaaaccctatctctattaaaaatacaaaaattggccagatgtggtggtgggcgcctgtaatcccagctacttgggaggctgaggcaggagaatcacatgaacccaagaggcggaggttgcagtgagccaagatcgcgccattgcactccagcctgggcaataagagcgaaactctgtctcaaaaataaataaataaataaatacaataaagtggttaggcaaggcatggtggcaccctgggaggctaaggcagcaggatcacttgagccaaggagtttgagaccaacctgggtatcatagtgagaccccatcactacaaaaaataaaaagttagctgaatgtggtggcgcatgcctgtagtcccaactactcaggaggctgaggcaagaggaccatttgcccagaagttcgaggttgcagtgagctgtgatcataccactgcactccagcctggaccgcaactcaaaaaaaaaaaaggttaattttatgttgcatgaatttcaatttttaaaaaatagttgattacttatgtacacttttctgcatgtaagtaatacttaagtttggaaaactttggtgtagtagaaatagcatgagatttgccaagcattttgctggctattaaacatatctaatctcataatatacattaagcacagccattgtgggggtggcagacagtatgacccagataaatattagtccccttgcacaactcaaagctttcatactctaaaattgtccatgtcccggaggccctgatttctttctttccatttttttttttttttttttttgagacagagtttcactcttgttgcccaggctgggttcaatggcgtgatctcggctcactgcagcctccgcctctcgggttcaagtgattctcctgcctcagctttctgagtagctgggattacaggcatgcaccaccacgcccagctaattttgtatttttggtagagacagggtttctccatgttggtcaggctggtctcgaactcccgacctcaggtgatccacccaccttggcctcgcaaagtgctgggattacaggcgtgagccactgcacccggctccttttttttttgttgttgttgttgagatggagtcttgttctgttgcccaggctggagtgcagtggcgcgatctcggcttactgcaacctccgcctcccaggttcaagcaattctcctgcctcagcctcccaagtagttgggactacaggtgtgtgccaccacacccggctaatttttgtatttttagtagagacggggtttcgccatgttggtcaggctggtctctaacccctgacctcgtgatccacccacctaggcctcccatagtgctgggataacaggcatgagccaccgcgcccagctccttttttttttttttgagacggagtctcactctgtcacccaggctggagtccagtggcgagatctcagcttatcgcaacctccacctcccgggttcaagcgattctcctgcctcagcctcccgagaagctgggattacaggctcctgccaccacacctggctaatttttgtcttttaagtggagacgaggtttcaccatgttggccaggctggtctcaaactcctgacctcagatgatccaactgcctcggcctcccaagtgctgggattacagctgtgagccactgtgcccagccagagaccttgatttcttaccatacctgctgtctgtagagcaccatgtagcactcagctacactccctcttcatgagtggtactatttaaatgcctcaggttaaacatctagagattagggatcttttcttacacttccttgtattttatttatttatttttttgtttgagacagaatcttgctccatcacccagtggattctcctgcctcagcctcccaagtagctgggattacaggcgcataccaccacacccagctaatttttaaaattttttagtagaaatggggtttcaccacgttggccattctggtctccagcttctggtctaaagtgatccacccacctcagcctcccgaattgctgggattacaggcgtgagccaccgagtctggcctcttacacttccaatgaaccccatagcttgtagcacattgctttgtgtggtaagtgtctctattcatggtcctagcaggaaatgaatagcacagtgaaattaggataatttgggggagagtttaataaagtgataattacaaagaagtaggcagggtgtagggaaatcagaaagaatagtgcagtgccttagtacccacagctctgttgtgatcacctccaagctcaaaaagatgaggacagagcagtcgtgtagagaggactttctttttttttttttcttttcttttttttttttttttttttttgagatggagtcttgctctgtcgcccaggctggagtgcagtggcgcgatctcggctcactgcaagctctgcctcccgggttcacgccattcttctgcctcagcctcctgagcagctgtgactacaagcgcccgccaccgcgcccggctaattttttttgtatttttagtagagacggggtttcaccgtggtctcgatctcctgacctcgtgatccacccgcctcggcctcccaaactgctgggattacaggcgtgagccaccgcgcccggcgagaggactttctcaataaaaactgtgactttcattgataccgtccatttgggacaacttactgaagcagaaagcagggtggagactgaattcaagggaaaacataagatgtctggtacagcatacaacagcattgattcagaggagggtgggagtactgagcccaggagacggagaaggaatgtaaagcctgcgagaggctgctcagcaattatctggtcccttagcctacaggattagcagcttcctaactcaggcaattatctctctggacctgtttcttctatctataagttgatggaattagtctaatgatatctaaggtccctactatgtgtacgtctactgtgacaaggtccttagctgcatgatctttaattctgacaaaggttactatcacaaatattttaacatgtttattctcgtggttactaatcaacaatctctggcactattacaacaaacctttcagtatttacagagaagttatttgccattcttagcaactggccagtcaacaactcaactttatagtaagttacagaatttattctgtatattgtattctgtacaatgtattccatacattaatttattttgtggtaaaacagtaacttttcattttagatgggaaaactagacgagctgagattcaacccacgtgagcggctgcagagccgctacccttaacagctctctctcgggattctaacattcccttctgtgacggagagacagcaggccgggacacgcatcccaggacggatccacagctggatggggaaggctgcgccaggcgggccggaagcctggcggtggcgtgcaggagccccgccctcctgggctggattcagccgggggcggggccgcgggcggggcctgtggcagcgggaatcccgaccccgcccctttccccacccctccatttctcgccatggcccctgcactgctcctgatccctgctgccctcgcctctttcatcctggcctttggcaccggagtggagttcgtgcgctttacctcccttcggccacttcttggagggatcccggagtctggtggtccgggtgagcgggagggatcgaggatgaactgggaggaggaaggtggagccgtaggagagggattgagggcggggcttggaaacaaatgacaggggaagtccaagagagggaactcgaaccttgaaagcggccgagaagctacaggggagggagacctgagttctaaattaggaactcaaggattagagttttggagaggcgggagagtgaggactgagggagccgaaaagggcggtgaccggagtattctaagtaaagtgttttgtagagaggactgttgagaggagagtgttaaaaagaaggagcatttggagaaccgaagtaagaggggcaatccagcgtggcctctccagccatgctttttgcaactgcctaacatgtgttgttctataaatcctcttccccaggtttgcaggaggcctagggaagagggcagaaactagggatggaaaagtgagatgggcacagcctagagaggaagcattaaggctcttgaaagcagtaagggacatggcctggggatccaagaggagatgagggtgggggaaacattctgccactgtttcgatcttttgtctctttttccctcaacttcctgtagatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcaggtatgaggccctggccttgcaggtatgaaatcctggcagttgagtccccaagggagaccaagtgtgggaggggtgccgtggattggaggggcaaaatatgggttcaggaggagaattgaggaactaatctcagcttccattcctccacagcacatatcctactttttatcaagaagggtgtacttgtccttccctaagcacaagatatgcttctcacctctgcaactttgtttatgtcctgcttgagatcccttctcttcagtcctaccctttcttcaaaaccacttccctaggtctgaagagaaggccttgtctgtcttttcactgggtggttggcacaggctactactttgcgtagctatcaggtcaccccatctattctataagttctcagggtagagacaggccatccttacatctttgggacctcacccagcacgcaccctccacatggtgaatatttggtggtgatgcttaggagagaggtgggggagagttgcaggctagcctgtggtgggggcagatctgggtctgggtctcccaaggtcgggcagactaggccactgggatacccagccccttatccttccacagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtgaggctccgagatccctacctatgacctctgacccgttttagaactcctcgttccctttcaagggtttccctcctcccatgctcttctactgtctccctgcttctccctcgtggcccttccctttgactttccctcgtaagggcagcaagcatgggcctcctgggcctggggaaggtacatggatcagaagtcaggatcagggatccaagtctcagaaggggggttcctgggcctgagttctagaagggtggtgcctggaagaggaggaaagaagtgcccaagatgagaaaagggcttgactccatttctaagctcttctccctctcttaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacatatggcatgcagtctgtcagtgtctcccaagctacagggctgagtttgggaaagaaagccagagggagcctgggagcaccgaactggagtctgggcagccaccacgccctctggcaaccgctggggttcggccacccccgcagacccgcccccactttgccagagcggccgggtccccattcccattccttcaaatcccctttttcccggcagccgacctgtagacccaagggagacaggttgaagctagaaagagtcggggcagcagctctggtaggggagggagcatccaaaacctctggcttctgagcgcctctcctgccgcccatccacaaagccccccacagcctggcggctgccctcgaccccgcaaaacaaaggacttcagaggctggacctacagacccagatgagaaggcaaaagcgtagggaggagcggcaggagatgggaagggcgggccccgctcggagcagctgccgcttcctcccaaagtcccacgaggggcctgagtcacgggccaccgccctgggtcggcgagctgggggaagggatctggacacctggcgtgtccgggcgggaagctggtgagggcccctggggacagagcggaggaccagtggttggggcgagaagagggcagtcccgcagcgagtcccacgcggggtgggagggatctaggccccgccctctcctcggctccgccctgcgcccccttccctctcctcattgtccttagacaaagcggtcgccgcccccgcccggccccctggtctctgtctccgtccctcctcctttgctgcctctttccctcctcctctccctccctcctcccctccctccagtctccggatctccctcggtccctctctcctcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtgggtatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacaggtagggaagcagccaagccagacttcttagaagtccacttgtcaattttctctggactctggtctctttcttttttatacccctgttttcttgtcttcctctattctttcttgttaattcctgccaccacccttcctcgctctgcacatacacccttccttctcagagccctccttttccattttgagcccaaaagatcctgccccagcaaaggctgtctctgggtgtgtctctttcagggtgtgccaggctgctcattctcccttcccttgggctctgagtttccaacccccttttctttccttcctttcctgagtgtgacctgccccagcccatccagtgggagagcctaaagtgacgagcttgaatcagtgagggcagggtcaccagggtgagagcacttgcagtttttctggggagaagggatagggagcctggggtggtggagggggtggggtgggtttgtgttctagggagaaactgcagggagaagtgaatggagaaaggtccaactgccccgtgggaaggagggcagagctgaatagggacatcctaggatggaggggagaggggagatggaaccgggccggccaaagagcagagagaaggcttttgaaccccgagtctgccccatgggagagacacagagaggccatttgaagtgggtgacctcggggttgcacacccccagctgggccactgcttcagacagtgctcccttctctcttgggacaagaaaagccttctcctcttccaaaatacccccgcccctcactcccctgtccttcctccctgggtttcccctccctcccaagaactggctcagggatcggttttcccctcttttcctgccatcctggactttccctccccttagggtagcaaaagagagaagtgaatttggagacagttttgagaacaggcactggccagggagcacagtgggagttctggacaggggttggggctgaggccagcagagggtcagaggttagacttgcaacaaagacctgcaggaaagtgggggcagccaggatgactccccctggccctggcctcacttcttccctgtgcacatccatctgtttccagcttgaaaatctctagggagacagaggtcccacactcagacatctcagacttaggaagtccctccagtcacacacatctccccagagcctgggaagcccagtctcattctcatcccatgtgttaacatcctcagatttgatttttttgtgtcctcagtgtcagtggggaaccacagggactaaagatacgggttaagccttgggtggaggggggttcatttgatcccccaattcatcttcacatgaagcgtaagctcccacctctaagccatggttcttgggaacctaccctcagccctctgactgctaccagcctgttcccctcagggctgggcagatgaaaaaaacagaagtccggaaatgctacccgggtgaggtgttcagaaaagtcacttcctactgagagaggcttgtgcctctggggaagaatgagcagagggaagcatgaagctttggggcccaaagcccagggagcatcccaggggagccaggaagcaagtgcagggcaggacctgtgctggtgaccatacctaggccagagagcaggggagccggaagcagatcgcccaaacaggaagcctggggtgggggccggaaggctggtggggctgagtggggaaccctgggccctgggccctgggcctgccagatctgtgctcaggatgtggtgagagaataaggaagcagccgctgcttgggtgggggtggggaggaggcagcacagagttcctctgacccagacgcctcaccctccaccctctaccccctgtcagcaccctgttcttcagggactgggtgccttgtcccagctctgctgcaacacactggctcaggaataggagataggaggaccctgccaccaacccccgcttcaccttccctaaataactcgtttgcaggctaattccatcaaatttatccctgccatcaggagagaaatcccagccctgccactggagcccaggggatggctgtggctggtgccctaccccagaggcctcttggttgggctgagagaccagccccattgtgaccttatatagctgatgggagaggagcgagtgagtcaccccctctctacccccccactcccatgcaggctgtgcatttctgagaagcccagtcagaagttggtggggggtgaggagacaggcagggtagggggggagatataaacatagaccgagagcaaataaaataagtcattttcagagtagaaaataaagtacagaggttattattccaaaagaggatatgagaagaaaacaaaaatgggttcccagaaatgtgggtaaatctgtcagttacagaaacctaagcggtcccttctgagaacttgggatataagcagtctggctgctgtcactagattctaccagcagttccacagacatgaactgggggtcaaatgtgtacaggctggaccacccgcagatcgtttccccagcattggtcctctgatggcacctcatgtgaggtctgaacaaaccctaacctcttgcattgtaccaacttctaagctcctttcttttttcttttcttttcttttttttttctgagacagtctcgctgtctcccagcctggagttcaatggtgagatttcggctcactgcaacctccacctcccgggttcaagtgattctccagcctcagcctcctgagtagctggaattacaggcgcacgccaccatacccggctaattttagtatttttagtagagacggggtttcaccatgttagccaggctggtctcgaactcctgacctcaagtgatccacctgtcttggcctcccaaagtgctgggattacaggggtgagccaccttacccggccccaagctcctttcaacagcagacatgagtataatatattagtaaattatctagtaagttagaaggtggtaagtgattatggaaaaaaaaatagaacagtggaacttagagggtcaggaggtagggggagtgaatatggagacttcaaaatagggtgatcaggagggtcagagccatggggatattttgggggagtgttccaggcagaaggaatagctagtactgttctggtcctgaggtaggagtgcgtggagggaaccaaggccagtgtggctggagtggaggaagaggccagagaggcaaggggagggtggcatactgggagcaccctgtaggctttggtcaggctctgggcaccttgggggcaatcaagtagacttttttttttttttttttttgagacagagtcttgctctgttgcccaagccgtagagcagtggcgcgacctcggctcactgcaacctccgcctcccgggttcaagcaattctcctgcctcgtcctctcgagtagctgggactacaggtgcacgccaccatgcccagctaatttttttgtatttttagtagagacaggtttcaccatgttggccaggatggtctcaatctcttgaccttgtgatccgcccgcctcggcctcccaaagttctgggattataggcatgaaccaccgcgcccagcctggagtagactttttgctccaagtgagatggggagacactgcagggttcagagccaacaaggagtaacatatacagttcctgagttctaccttcccatggggacccaggtgtcatatctggttttctttttttttcttttttagagacagtgtcactctattgcccaggctggtctcgaactcctgggctcaagaaatcctcccgcctcaacctcccaaagtgctggggctacaggtgtgagccaccatgcctgactggtgtcatattgatgcagctcttaacaaccacctgcccagccacccttctggcttctctcttttcatacctcagttcattaggggactcagggatgtacggctgaccccaagtcttcccaaacagatgccagggaaggcctgagtagatcatttggacctttccaagtagttcatatggaatcctcctgctgtctccctaatccctttggctcctagacttaatcccaccctgccccttccccctgagcttcttaatagggcaaaggggaagggtagaaaggcagtgagaacagctgggactcgcctgctcttgggacagtgtgattaccaagggttttctgtgccctgtctggtattttgtctctgtgcctgtccctttgggcacactgtggacccccaccccaggtttgtgtggactttcctttctgcccttgtcatctcccccagccttcagggtgtcagtggctcatctttcccctgtgtgttgctggagtctcttggttcctctcggcctttctgttcatctcccatctcttcctaggccctagactccctttgctatggataggagaggaatgaggagagtaggagggaacaggtgcccagggtcctgggttttgcataggacagcaaggggctgtgggtatgaaaaccttgcttttgtctgagactcgctccccagccagttctttccccactggccagtctgctgggctcctctgggaagttcactcgattgcccccaaggtgcccaaagactcggttctgatcacaagacttatcgccatgtattttaatttctttttacccctctgcctcccacactcgaaatagcagggaccttggtcttatattattcacttctgcctcccaagcccctgccaacgtacagggcaaagtctgatgttttgaaatgatatgatcgaagagggaaactctagaattggagagccagtatggaaaggaaaactggatcccagagtggatggggagagtgagtggggcacctgagtccagcccccacccccacgttccgccagtcccacctgctcccttgcagactccgccccccccgcccccgctttctctccctcaacccccgcgggcttctcccctgctgaccttgcctcctgccccctttttctccctccttcagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtgggtaagcggaggctccgccggcccgagggcgccccctgctgtcagagcgggcgctgtggtccaggagagaggagggaggattacatgtaggcactcggaaggggcttggcgggtcctctggttcaacatgctcctttaacagatgggcaaactgaggtccccggcagtgaagtacacattgagtcttcaggtttcaaaacgagaactcttcctgagtgctgtaatctggtcaaaatcacagggtgggtcgacaggcctgagttggaattccagcttgtctctttaattgtgtgatctcagggaaaccatctgatctcttgctttagtttattatttatgaaatgaagttaataataactacctcctgtggctcatgcctgtaatcccagcacttcgggaagccaagacgggtggatcgcttgagcccaggagttcaagaccaccctgggcaacatggcaaaatcctgtctctacaaaaaaattgaaaaattatccaggtgtgggccgggcacggtggctcacgcctgtgatcccagcactttgggaggccgaggcgggcggatcacgaagtcaggagatcgagaccatcctggctaacacggtgaaaccccatctctactaaaaatacaaaaaaaaattagctgggcgtggtggcgggcacctgtagtcccaactacttgggaggctgaggcaggagaatggcgtgaacctgggaggcggagcttgcagtgagccgaggtcgtgccactgcactccagccttgacaacagagtgagactccgtctcaaaaaaaaaaaaaaaaattagccaggtgtggcagtgcgcagctgtggttccaggtacttggaaggctgaggtgggagcatcgtttgacctcaggagttggaggctgcagtgaaccaatattgcaccacccactgcactccagcctgggcaacaaaggaagacctgtctcaaaagaaacaaacaggccaggcacggtggctcacgcctgtaatctcagcactttgggaggccgaggcaggtggatcactcaaggtcagaagttcaagaccagcctggccaacatagtgaaaacccatctctactaaaaatacaaaaattagctaggcatggaggtggacacctgtaatccctgctactcgggagtctgaggcaggagaatcacttgaacccgggaagcagaggttgcagtgagccgagatgacgccactacactccagcctgggtgacagagtgaaattctgtctcaaaaaaacagaaaccaaaaactacctcctagacttgtagaaaatattaagtaattttatttatttatttatttatttattttgagacagcgtctccctctgtcgcctggactggaatgcagtggcacaaccttggctcactgcaacctctgcctcccaagttcaagcgattcttgtgcctcagcctctctagtagctgggattacagatgtgtaccatcacacctggctagtttttatatttttagtagagacagggtttccccatgttggtcaggctggtcttgaactcctgacctcaagtgatcctcctgcctcagcctcccaaattgcttggattacaggtgctccaggccaagattaagtaattttttgtgaagcaccaagagccacagctggatatcatattacttaatctctcctggagttatggtgagattaaacagttataaggatgcctggcacagagtccgagctaaatgagtgatggatgtggttactggtggtaacatgctttagatatggaagatattataggacttcctgcatgccaactgcccttcaatttgtgtgggggggaagggtgggcagaaggcagaggctctcactcattctctaacattattgccccctctcccacagatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaactcgtctgcttctccttctttgggaaaaaaaaagggtatgtgaggggaggctctggtggctgggggagaggaaaatgatgggggatgaaccaggaactcggcactgacatgtcaaaaggggtctgggaagctgcacgtgggtttcacgcaggacaagcaggtgacatgagaaagggcagttgaagtgtccactagactggaagtgccatgagggctgactacatcagctggattcactgcaatatcctgtacctgtcaactagtagacacggaattatttctagaatgaatgacaacaaatgaatgaatagaagaaaagggttaaaatattacagaggacactttgagttgaagggttctagtattcagaagcctgctgccatgaaggcagctaggtagtgtatgacacaacccatgtggctaatccagggatacttacttaaagagctggggctacgaatactaaatctgaaattgctgcaaaatgaagtaagtatgtacaagagtcagtttcctggaaaaggttcccctctgatagacaatggattttatatcgttaaaggcctaaaggccgggcacggtggctcacgcctgtgatcccagcactttgggaggccgaggcaggcggatcataaggtcaggagattgagaccatcctggctaacacggtgaaaccccgtctctactaaaaatacaaaaaattagcggggcatagtggtgggcacctgtagtcccagctactcgggaggctgaggcaggagaatggcatgaacccgggaggtggagcttgcagtgagctgagattgcgccattacactccagcctgggcagcagagtgagactccatctcaaaaaaaaaaaaaaaggtttaaaaaccatcttgatagtgcatggctttggtgcccatgtagttgatatttggaattttcccatttcaaagaatatcttatacaaatgtggaacatcaatattttactcatcaggaaaatttgtttgtttgttgttagctctccaggctaacaaagatatggttgaatagttatagtccttctaccactacaagttgctcctctcagactggtcagaggaggccccacacctttactataaaacaaaatatatgagacaaattgaacttaagcatacgccaaaggttttcaatttactagcaagagaacaagccaggtgtcaaaagactcagccagttcagagaaggtctgggtagggaaggaaacagaatgattatattagtagcctgttaggtaaaggtcttaaaaagtttccagttgtgacccaggaaaacagagttaggaagctccgaggtgccaggggtgctcacagtccatctcagaaacagaaaacaatgcattcaagaggtcaggccaggtgtggtggctcatgcctgtaatcctaacactttgggatgccaaggcgggtggactgcctcatctgaggagtttgagaccagcctgggcaacatgatgaaaccccgtctctactaaaatacaaaaaattagctggacgtggtggcacgcacctgtagtcccgcctactcaggaggctgaggcaggagaattgcttgaacccaggaggtggaggctgcagtgagccaagatcacgccactgcattccagcctgggcgacagagtgagactccgagactccctttccaaaaaaaaaaaaaaaaaagtcagtgatgtagatccacttgtggctattaataagaacaatgtttcatttcctaacagtagtgcctggtaactgcaattaatcacaaaagtatgatgcaggatcaaacaaatcagacagcagagcatcgagtaacaaattcagctttttgttttgtttttttttttttttttgagcatagtcttggtctgttgcctaggttggagtgcctgacctcggctcactgcaacctctggctcctgggctcaagagattctcctgtctcaggcccagtgcggtggctcacgcctgtaatcccagcactttgggaggccgagacgggcggatcatgaggtcaggagtttgagaccagcctgaccaacatggtaaaaccccatctgtattaaaaatacaaaaactagctgggcgtgatggcatgtgcttgtcacacttgtaattccagctactcaggaggctgaggcaggagaatcacttgaacctgggaggcggaagttgcagtgagccgagatcgtgccattgcactccagtctgggcaacagagcgagactctgtctccaaaaaaaaaaaaaaaattctcctgtctcagtctccagagtagctgggactacaggtgcacacctccacacctggctaattttttgtagagatggtggggtctcaccctgttgcccaggctggtctcaaacccctggtctcaagatatcctcctgcctcagcctcccaaagtgctgggattacagcaagagccactgcacctggccttgcttacttttaaataagcagccaccagtgattttctcaagctgttaagcaaaaatgcagaacacagtttgcctgttccttagtttggagattttgtctttaacaactttccccagttccccagtttcttcctgcctagaggtcttcccttatacctgacctgtcttcactcctgctgcaggcaaaccagtcctagcaacggtcacttttttgtttgtttgagacagagacttcctctgttgctcaggctggagtgccgtggtgggatctcggctcactgcaaactctgcttcccatgttcaaatgattctcctgcctcagcctcccgagtggctgggactacaggcgcacaccaccacgccaggctaatttttatatttttagtagagacagggtttcgccatcttggccaggctggtctcgaactcctgacctcagataatccgcccgccttggcctcccaaagtgctgggattacaggcatgagccaccgcgcccggccaacaatgctaatatgttttatgagcatggacccgatcttccaatctgaaatagaatttcattcctcccttactttgtatagtttttggctctataaaatttccatactttctttattatgtatcctgtccctcccccaccgcaaaatgtaaatttggtaaggaacttttgatttgtcctctgctatatcccagggacggaaagcaatgagcacacattaggcatccattaaattaatttcacttgttgaatgaatgcgtgagcgaagcactcacagactgaccatcagggggcgtcagagaaactggacagaggcgaaatgaagaaaaaagaattaccccgagttttcaggtatggttccgcgaggtttgaactcgctcggccaccgtagtgcttagaggccgaaaaagtacagccccttccgggctccgcggtacgggaagacagctttgggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtgtcggcaggggtggggaggggccctgtgatttgtcccggtgaggctggcctaacggtccatcgagaagttaagaaagctcagttcacaagcacttattctttgtccgttgtcgcgtaggtactgtgctagctgctggacgcccagctcagtggagaagattgaggagggcttaggtgtgtcgggttaagcgcaatagaacggtgtttctcgaactcttaacatgcatccaaggttcttgttaaaatgcagattgcgattcagtagggatcttagtttctgcatttctttctttcttttttttttttttgagagacacagtctcgctcgccccgtcgcccaggctggagtgcggtcgtaagatcacggctcactacagcgtcgacctccctggttgaagcgaccctcccacctcatcttccccggtagctgggactacgggcgcgcgccaccacccccggctaatatcttttatttttatttttatttttagagatgaggccttggtgtgttgcgcaggctggtctctaactcctcagctcaagcaatcctctctcagccccctcagagtgctgagattacaggcgtgagccaccatgcccggcccccctcatcttctgaacttcctttcagtcgtttaattaacagagggggccgggtgcagtggctcacacctgtaatcccagcaccccgggaggctgaggcaggaggattacttgagcccaggagttcgagaccagcctgggcaacatggcgaaaccttcgtcctacaaaaaaattaaaaattagttgagcgtggtagtgtgcacctgtgtttctagctacttaggagcctgaggtgggaggatcccttgagcccaagagggacagagtgaaaccctgtctgtaaaaaaaaataaaaaaccccattcaggatgatgaagatggggtgaagccatgaggaagaaagagaatgaatgctggttagctggtttaaaactaagtaattgtgcccgggtgcggtggctcatgcctgtaatcccagcactttgggaggctgaggtgagtggatcatgaggtcaggagtttgagaccagcctggccaacatggtgaaacctcatctctactaaaaatacaaaaatagtcgggcgtggtggcatgtgcctgtaatctcagctacttgggaggctgaggcaggagaattgcttgaacctgggaggcggaggttgaagtgagccgagatcacgccattgcctgacagtggggccgggccgcgggggcaggaaagactaagtaattgcttaaattaggaacagagctaagtgggagggcagagatcaggagttgctcagacctccttatcttcccctctactgacaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacagggtaagtcagaagcagggtgagagaggatggggcaggctgaagtgttctctatgcccttatttaatcccctggatgggctgcagggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggtgaataggagcagcatgttctgtaaatccccaagatcccagggtgaaatctgaggttggctgtgagtgcagagatagtgatctctgggaagacaaggggctgtctctagtgagatgttcacctctgtggtgagagaagccctgtgcatcctgtggctaagacaactgtctgctgtacctgcaatcagagagattcctcactgagaggggacattttttgtgttagggcgcatctgaatgatccttgtgattctagaggggagcagctgtcagtgtgggggctctttggcctcacacccctccattcttgttttttcttctaggcttatgaagaggctcagaagcgcctcaagatggccgaggaagaccggaaggccatggtgagtcccagggcctagggagccaagatcagaagacaaaaggaaagactttctgatagagtgtatagggagagaggatacagaggaagcacagtgtggatgctgatggggtggtcaggtttctagaagaggggcttggttgttaggagccagctgaggatagacttatgttgttgagggaaggatccttcttaagttgtagggggaaggaggctacccataagtcctccttgactcttaactttaggatcaaatatactctattagtgaatgaaattgtgagctttccctattcctgagtcctaatgagatatgaggcagctggaatgttgtcaagaaggttgctggagggcaagggcagggcagcagtcccactgtacagggatgtgctgaccattcagcttaggcacaccatctccaaataccttcccaccacctaattcctgcaccccttatgtggctttgtgatctccctgtgtcttctcactggacagggacagagcccttgtaattcataaactggactttttatggtgtgaaactaggtagggtaagctgttttccaaaggcctggtcttgtcaagtaaagtcacacttagattccccaataccccaatagaattttgagactcttgaagttcctttttttttttttttaaaccttttttcttttttttgaaacggggtcttgccctgtcaccgaggctggagtgcaatgatgcgatctcggctcactgcaacctccgcctcctgagtagctgggattacaggcgcacaccaccacgcctggctaattttttgtacctttagtagagacggggtttcaccatgttggccagggtggtctcgaacccctgaccttgtgatccacctgctttggcctcccagagagctggaattacaggcgtgagccaccatgcccagccttctttttatttgttttgttttattttttatttttatttatttatttttgagatggagtctcactctgttgccaggctggagtgtggtggtgcgatctcagctcactacaacctgtgcctccctggtggaggaatcaagcgattctcctgcctcagcctcctgagtagctgggactacaggcctgcagtaccacactcggctaattttttgtatttttagtagaggagatttcatcatgttggccaggatggtcttgatctcttgaccttgtgatctgcccgccttggcctcccaaagtgttgggattataggcatgagccactacgcctggccgtttttactttttaaaattcatttatttatttttttgaaacagagttttgcacttgttgctcaggctgaagtgcagtggcgtgatcttggctcactgcaacttccacctcccgagttcaagcgattctcctgtctcagcctccagagtagctgggattacaggcatgagccacctcgcctggctaattttgtatttttagtagagatggggtttctccatgttggtcaggctggtcttgaactcctgacctcaggtgatccacctgcctcggcctcccaaagtgctgggattataggcgtgagtcaccacgtgcccggccaacttttggagttctaagaatggcctactggttcccaggtctctcctgaccaatttatctcatatctcttcctgaaattgactgtggttaggcttctgggacatctcagtgcagttgtggtggtagtggtgttactgttttggcctgaatttaatttttcgggttttttttgagacagaatctcattctgtcgcccaggctggagtgcagtggcatgatctcggctcactgcaacctccgcctcccgggttcaagtgattctcctgcctcaacctcccgagcagctgggactacagacatgcactagcatgcctggctgatttttgtatgtttagtagagatagggtttcaccatgttggccagtctgatctcaaactcctgacctttggcgatccacccccctcggtctcccaaaatgttaagattacaggcgtgagccactgtgcccagctgtaatttttctttttcgattacaaaaatatttaagcacatagggaagttgaaagaatagaacaaagaacactcatagacactattcagattgaaaaatggttaatactatgggtagtatttgcattgtaattgtaaatgtggtatgttttttcttttcagaccatttaaaagagtcttagacatcatggcgttttatctctaagtacatcagtgtgtacctgctaaggataaagatattgtcctctaaaatcagaatgctcttgtcacagtcaggaagttgaacagtaattcttatgtatcgactaagatctctctacaataaaagataccctcattaccctcaaaataactttaatgactgctttttcctaacaagaatgcagtcaaggttcatgcattgcatttgggtcttagatgttaagtttgtttctctctctgtctgtctcaccttgcagtgtcctacattctggatttgcctgattcttatcttgtggtgttaagtacttctctgccctgtgctttctttgaagcaggaattgggtctaaagcttattgacactcagattaaacagttgtggcaggaacacttcttgggcggtgatgtgcacttcatattatgtcatatcacggggacatactatccagttgtgtatctatatattagtattaatatcctttctaccaatagcctttcatcaaatgcttttagaagccactggtaatcctttcctgaacatgttatttttattggggattgcaaaatggtgattttttttttttttttttgagacagagtctcgctctgtcgcccaggctggagtgcaacggtgcgatctcggctcactgcaagctctgccttccgggttcatgccattctcctgcctcagcctcctgagcagctagaactacaggcgcctgctgccacgcccggctaattttttgtatttttagtagagatggggtctcaccatgttagccaggatggtctcgatctcctgacttcgtgatcctcttgcctcagcctcccaaagtgctgggattacaggcgtgagccaccgcgcccggccgaaatggtgattttttgattctgtcattcctgttacgtgtattggctagaatttgtctataaagaagagcttttcctcaacaactaggaacaagctacagttccttcttaaaaagggtaaatgtttgtttccttttaaatacgaatttttagagtaaggcgtttgctgtaacagtcatttcactggtgacagatttttttcccttgttttttgtttgtgtgtgtcaaattggactcatgaatttttatttttcagtattttataatctcacatcattattctttttaatgctcaaatggctctgattttttgcccatattaaaaaaaaaatctatctggctcttccatggaaggaatatttgactgtggtacccagattaggtcatgatcataaactgcattttaagtcttta

SEQ ID NO: 953 - DNA, 2238 bp, Homo sapiens
cccctccatttctcgccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagatgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccaaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccgccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaa

SEQ ID NO: 954 - protein, 620 aa, Homo sapiens [sequence omitted]
